(12) United States Patent
Ladha et al.

(10) Patent No.: US 11,866,728 B2
(45) Date of Patent: Jan. 9, 2024

(54) ENGINEERED RETRONS AND METHODS OF USE

(71) Applicant: ReNAgade Therapeutics Management Inc., Cambridge, MA (US)

(72) Inventors: Alim Ladha, Cambridge, MA (US); Vladimir Presnyak, Cambridge, MA (US); Inna Shcherbakova, Cambridge, MA (US); Brian Goodman, Cambridge, MA (US); Mario Rodriguez Mestre, Cambridge, MA (US); Devin Scott Quinlan, Cambridge, MA (US); Muthusamy Jayaraman, Cambridge, MA (US); Stephen Scully, Cambridge, MA (US)

(73) Assignee: RENAGADE THERAPEUTICS MANAGEMENT INC., Cambridge, MA (US)

( * ) Notice: Subject to any disclaimer, the term of this patent is extended or adjusted under 35 U.S.C. 154(b) by 0 days.

(21) Appl. No.: 18/087,673

(22) Filed: Dec. 22, 2022

(65) Prior Publication Data
US 2023/0235365 A1    Jul. 27, 2023

Related U.S. Application Data

(60) Provisional application No. 63/373,545, filed on Aug. 25, 2022, provisional application No. 63/370,880, filed on Aug. 9, 2022, provisional application No. 63/301,936, filed on Jan. 21, 2022.

(51) Int. Cl.
| | | |
|---|---|---|
| *C12N 15/11* | (2006.01) | |
| *C12N 15/90* | (2006.01) | |
| *C12N 9/22* | (2006.01) | |
| *C12N 9/12* | (2006.01) | |

(52) U.S. Cl.
CPC ......... *C12N 15/907* (2013.01); *C12N 9/1276* (2013.01); *C12N 9/22* (2013.01); *C12N 15/11* (2013.01); *C12N 2310/20* (2017.05); *C12N 2310/531* (2013.01); *C12N 2800/80* (2013.01)

(58) Field of Classification Search
None
See application file for complete search history.

(56) References Cited

U.S. PATENT DOCUMENTS

| | | |
|---|---|---|
| 5,320,958 A | 6/1994 | Inouye et al. |
| 5,405,775 A | 4/1995 | Inouye et al. |
| 5,436,141 A | 7/1995 | Miyata et al. |
| 5,780,269 A | 7/1998 | Inouye et al. |
| 5,849,563 A | 12/1998 | Miyata et al. |
| 6,017,737 A | 1/2000 | Inouye et al. |
| 8,932,860 B2 | 1/2015 | Rozwadowski et al. |
| 11,326,161 B2 | 5/2022 | Church et al. |
| 11,352,623 B2 | 6/2022 | Halperin |
| 2002/0022718 A1 | 2/2002 | Forsyth et al. |
| 2003/0181408 A1 | 9/2003 | Forsyth et al. |
| 2005/0250207 A1 | 11/2005 | Rozwadowski et al. |
| 2009/0123991 A1 | 5/2009 | Rozwadowski et al. |
| 2017/0204399 A1 | 7/2017 | Lu et al. |
| 2018/0127759 A1 | 5/2018 | Lu et al. |
| 2019/0330619 A1 | 10/2019 | Smith et al. |
| 2020/0115706 A1 | 4/2020 | Shipman et al. |
| 2021/0130833 A1 | 5/2021 | Zhang et al. |
| 2021/0230588 A1 | 7/2021 | Church et al. |
| 2022/0233610 A1 | 7/2022 | Duportet et al. |
| 2022/0307007 A1 | 9/2022 | Shipman |

FOREIGN PATENT DOCUMENTS

| | | |
|---|---|---|
| CA | 2075515 C | 11/2005 |
| CA | 2488328 C | 3/2017 |
| CA | 3154384 A1 | 3/2021 |
| EP | 0532380 B1 | 1/1999 |
| EP | 1178052 A2 | 2/2002 |
| EP | 0562206 B1 | 9/2002 |
| EP | 1517992 B1 | 8/2013 |
| EP | 4053284 A1 | 9/2020 |
| KR | 20170128137 A | 11/2017 |
| KR | 101922989 B1 | 11/2018 |
| WO | 00/44906 A2 | 8/2000 |
| WO | 01/48209 A2 | 7/2001 |
| WO | 02/077183 A2 | 10/2002 |
| WO | 2016/025719 A1 | 2/2016 |
| WO | 2017/142999 A2 | 8/2017 |
| WO | 2017/218979 A1 | 12/2017 |
| WO | 2018/049168 A1 | 3/2018 |
| WO | 2018/191525 A1 | 10/2018 |
| WO | 2021050822 A1 | 3/2021 |
| WO | 2021/062410 A1 | 4/2021 |

(Continued)

OTHER PUBLICATIONS

Han, Xuexiang, et al. "An ionizable lipid toolbox for RNA delivery." Nature Communications 12.1 (2021): 7233. (Year: 2021).*
GenBank: MCF7920737.1; submitted Aug. 28, 2021; Cabello-Yeves,P.J., Picazo,A., Roda-Garcia,J.J., Rodriguez-Valera,F. and Camacho,A. (Year: 2021).*
Hoffmann, M., et al. (2012). *Vibrio caribbeanicus* sp. nov., isolated from the marine sponge *Scleritoderma cyanea*. International journal of systematic and evolutionary microbiology, 62(Pt 8), 1736-1743. (Year: 2012).*
Enke et al. (Modular assembly of carbohydrate-degrading microbial communities in the ocean. Current Biology, vol. 29 (9), 1528-1535. (Year: 2019).*
EJ Aird, et al. Increasing Cas9-mediated homology-directed repair efficiency through covalent tethering of DNA repair template. Commun Biol. (May 31, 2018)1:54, p. 1-6 doi: 10.1038/s42003-018-0054-2.

(Continued)

*Primary Examiner* — Nancy J Leith
*Assistant Examiner* — Khaleda B Hasan
(74) *Attorney, Agent, or Firm* — Duane Morris LLP; Thomas J. Kowalski; Lawrence P. Casson

(57) ABSTRACT

Disclosed are engineered retrons and methods of use such as to modify the genome of a host (e.g., mammalian) cell by delivering the engineered retron or the encoded ncRNA in vitro or in vivo to the host (e.g., mammalian) cell.

30 Claims, 72 Drawing Sheets

Specification includes a Sequence Listing.

(56) References Cited

FOREIGN PATENT DOCUMENTS

| WO | 2021/141970 A1 | 7/2021 |
| WO | 2021/178709 A1 | 9/2021 |
| WO | 2021/178720 A1 | 9/2021 |
| WO | 2022/175383 A1 | 8/2022 |
| WO | 2023/081756 A1 | 5/2023 |

OTHER PUBLICATIONS

F. Farzadfard, et al., Synthetic biology. Genomically encoded analog memory with precise in vivo DNA writing in living cell populations, Science (Nov. 14, 2014) vol. 346, Issue 6211, p. 1256272-1-1256272-8.

X. Kong, et al., Precise genome editing without exogenous donor DNA via retron editing system in human cells. Protein Cell (Nov. 2021) 12(11):899-902.

H. Lim, et al., Multiplex Generation, Tracking, and Functional Screening of Substitution Mutants Using a CRISPR/Retron System. ACS Synth Biol. (May 15, 2020) 9(5):1003-1009.

Santiago C. Lopez, et al., Precise genome editing across kingdoms of life using retron-derived DNA. Nat Chem Biol. (Dec. 23, 2021) p. 1-20. https://doi.org/10.1038/s41589-021-00927-y.

Kira S. Makarova, et al., Evolutionary classification of CRISPR-Cas systems: a burst of class 2 and derived variants, Nat Rev Microbiol. (Feb. 2020) vol. 18, No. 2, p. 67-83.

Mario Rodriguez Mestre, et al., Systematic prediction of genes functionally associated with bacterial retrons and classification of the encoded tripartite systems, Nucleic Acids Research (Dec. 4, 2020) vol. 48, No. 22, p. 12632-12647.

Adi Millman, et al., An expanded arsenal of immune systems that protect bacteria from phages. Cell Host Microbe. (Nov. 9, 2022)30(11):1556-1569.e5.

Christina Palka, et al., Retron reverse transcriptase termination and phage defense are dependent on host RNase H1. Nucleic Acids Res. (Mar. 16, 2022) 50(6):3490-3504.

E. Pennisi, Like CRISPR, mystery gene editor began as a virus fighter, Science (Nov. 20, 2020) vol. 370, Issue 6519, p. 898-899.

Max G. Schubert, et al., High-throughput functional variant screens via in vivo production of single-stranded DNA, PNAS (2021)118(18):e2018181118, p. 1-10.

Eilon Sharon, et al., Functional Genetic Variants Revealed by Massively Parallel Precise Genome Editing, Cell (Oct. 4, 2018)175(2):544-557.

Sergey Shmakov, et al., Diversity and evolution of class 2 CRISPR-Cas systems, Nature Reviews Microbiology (Mar. 2017)15(3):169-182.

Anna J. Simon, et al., Retrons and their applications in genome engineering. Nucleic Acids Res. (Oct. 10, 2019) 47(21):11007-11019.

Christopher Vassallo, et al., Mapping the landscape of anti-phage defense mechanisms in the *E. coli* pangenome. bioRxiv (May 12, 2022) 491691; doi: https://doi.org/10.1101/2022.05.12.491691.

Bin Zhao, et al., Bacterial Retrons Enable Precise Gene Editing in Human Cells, CRISPR J. (Feb. 2022)5(1):31-39.

Qiubing Chen, et al., Recent advances in chemical modifications of guide RNA, mRNA and donor template for CRISPR-mediated genome editing, Advance, Drug Delivery Reviews (2021) 168:246-258.

Xucheng Hou, et al., Lipid nanoparticles for mRNA delivery, Nature Reviews (Dec. 2021) vol. 6, p. 1078-1094.

Piotr S. Kowalski, et al., Delivering the Messenger: Advances in Technologies for Therapeutic mRNA Delivery, Molecular Therapy, Apr. 4, 2019) vol. 27, No. 4, p. 710-728.

Kalina Paunovska, et al., Drug delivery systems for RNA therapeutics, Nature Reviews Genetics (May 2022) vol. 23, p. 265-280.

Int'l Search Report and Written Opinion dated Oct. 5, 2023 issued in copending Int'l App. No. PCT/US2023/061038.

\* cited by examiner

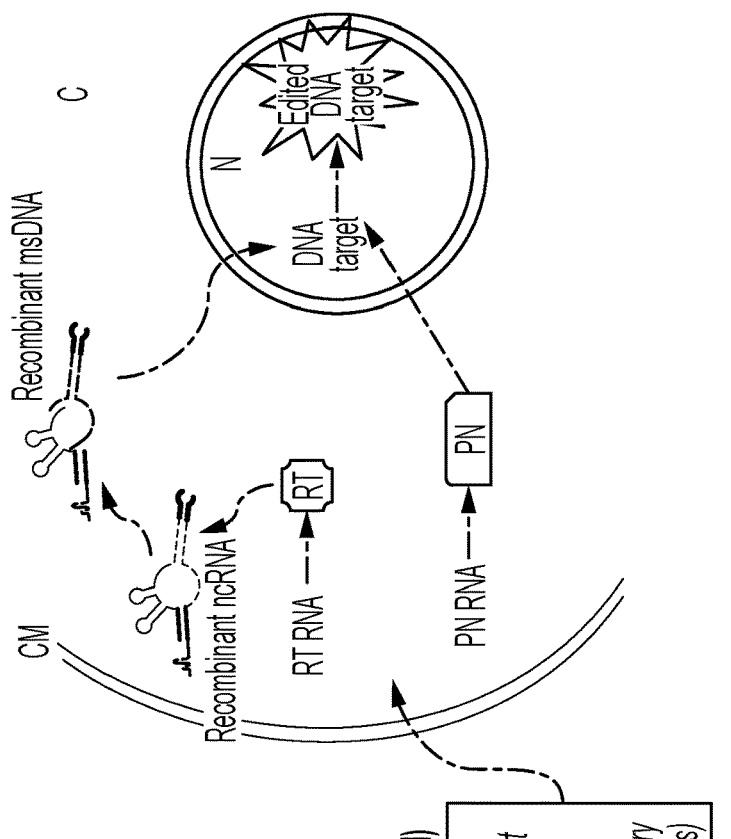
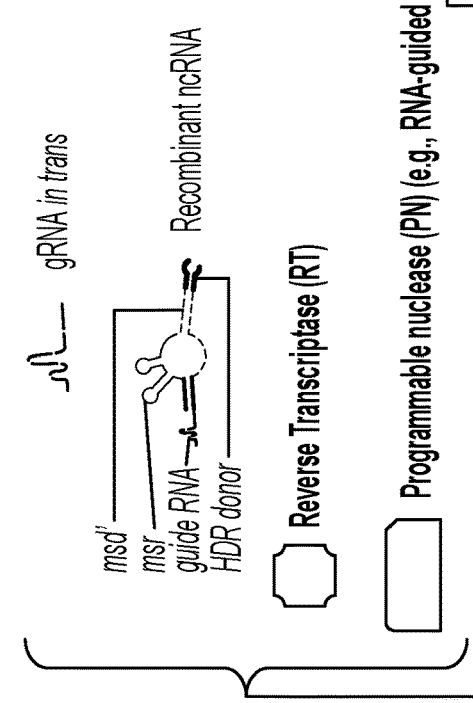
FIG. 1C

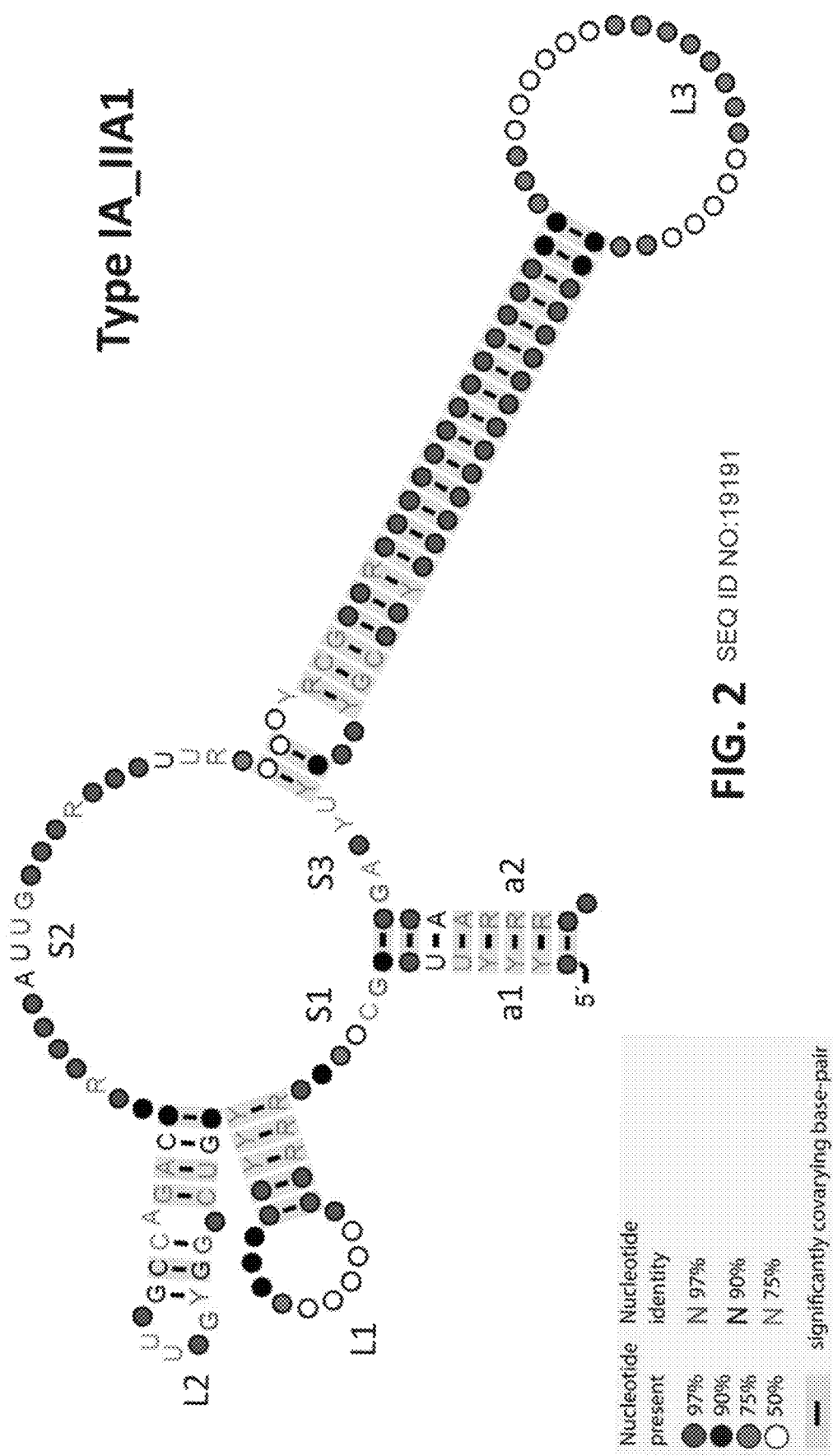
FIG. 2 SEQ ID NO:19191

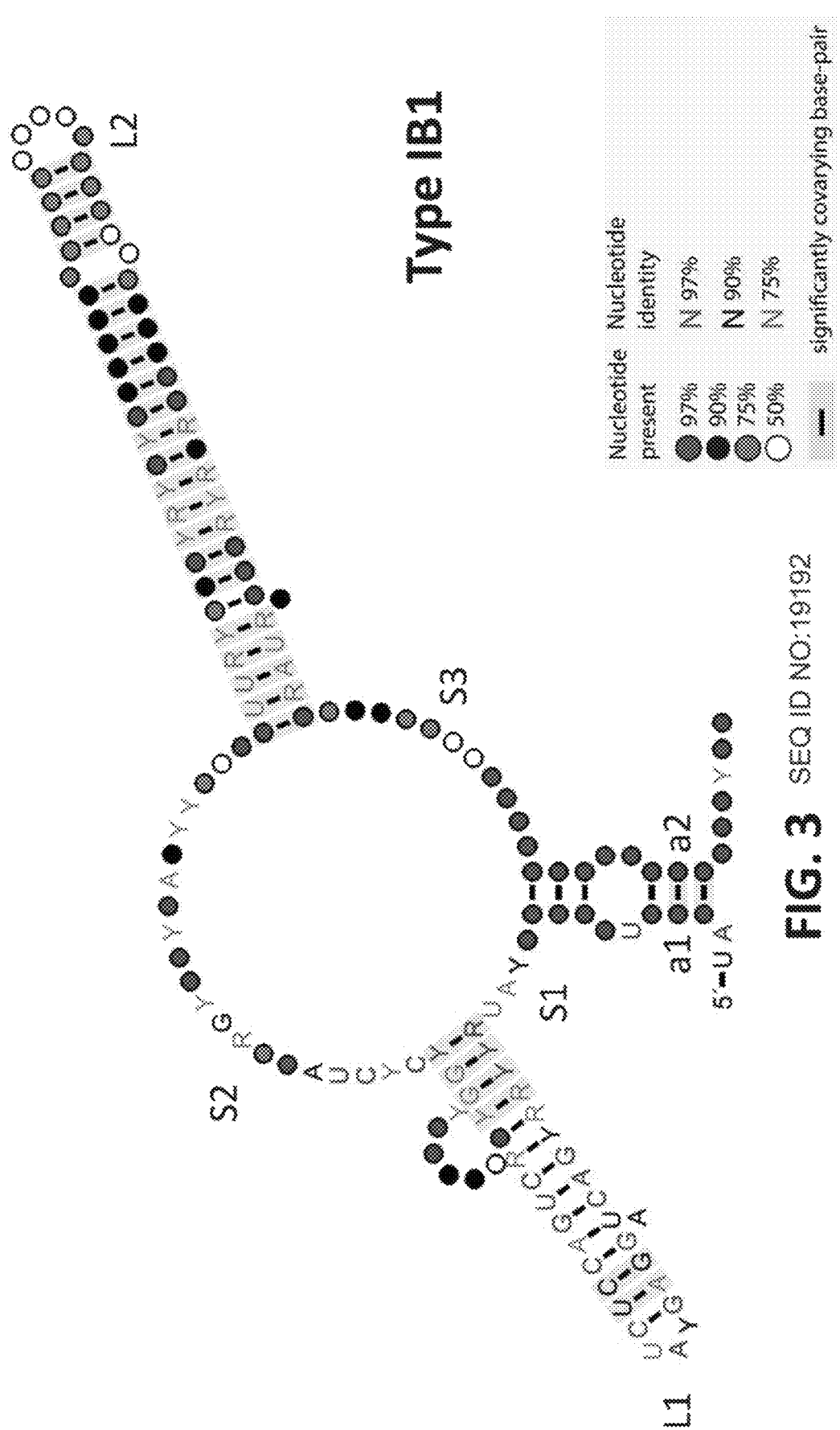
FIG. 3  SEQ ID NO:19192

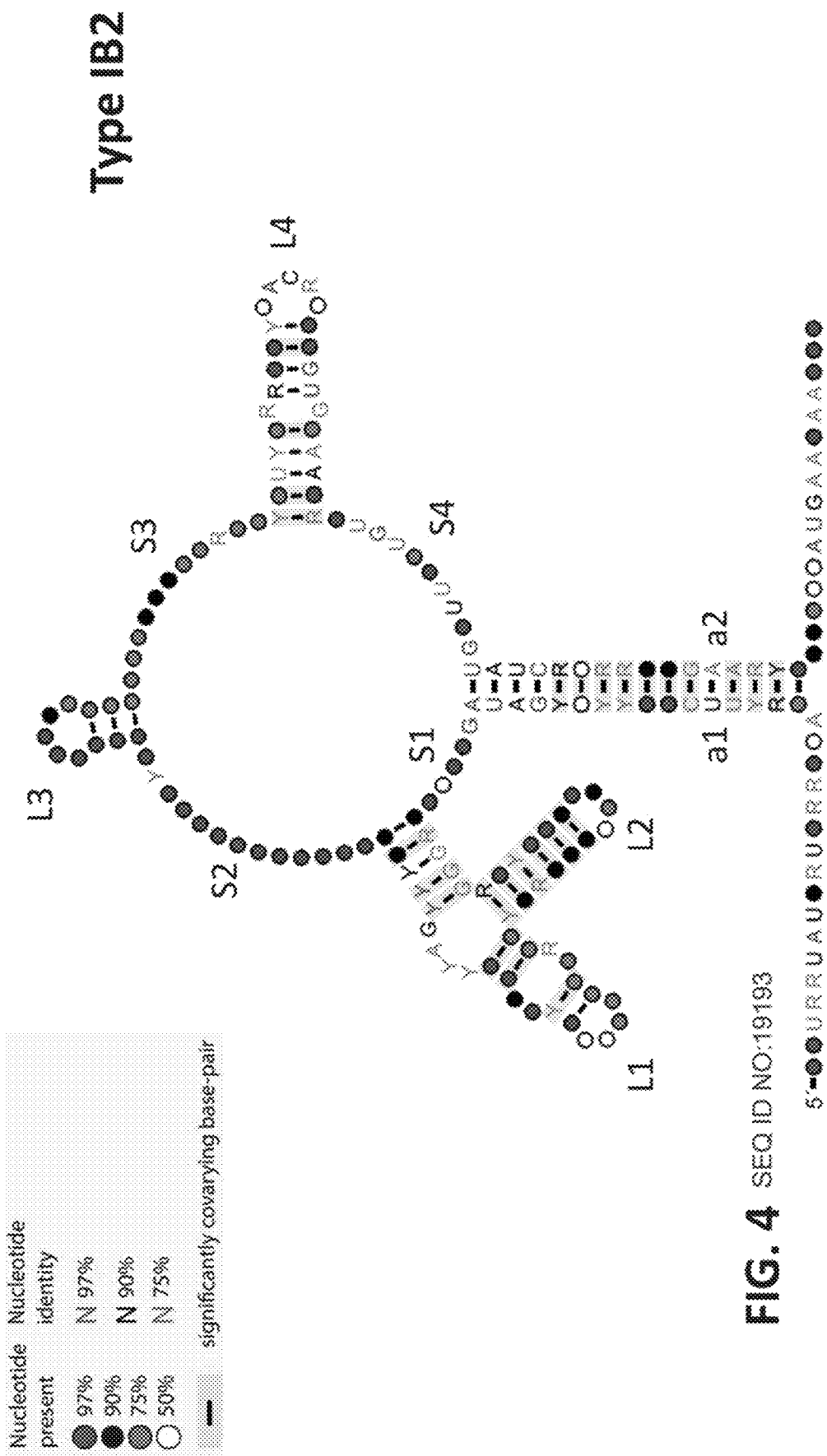
FIG. 4 SEQ ID NO:19193

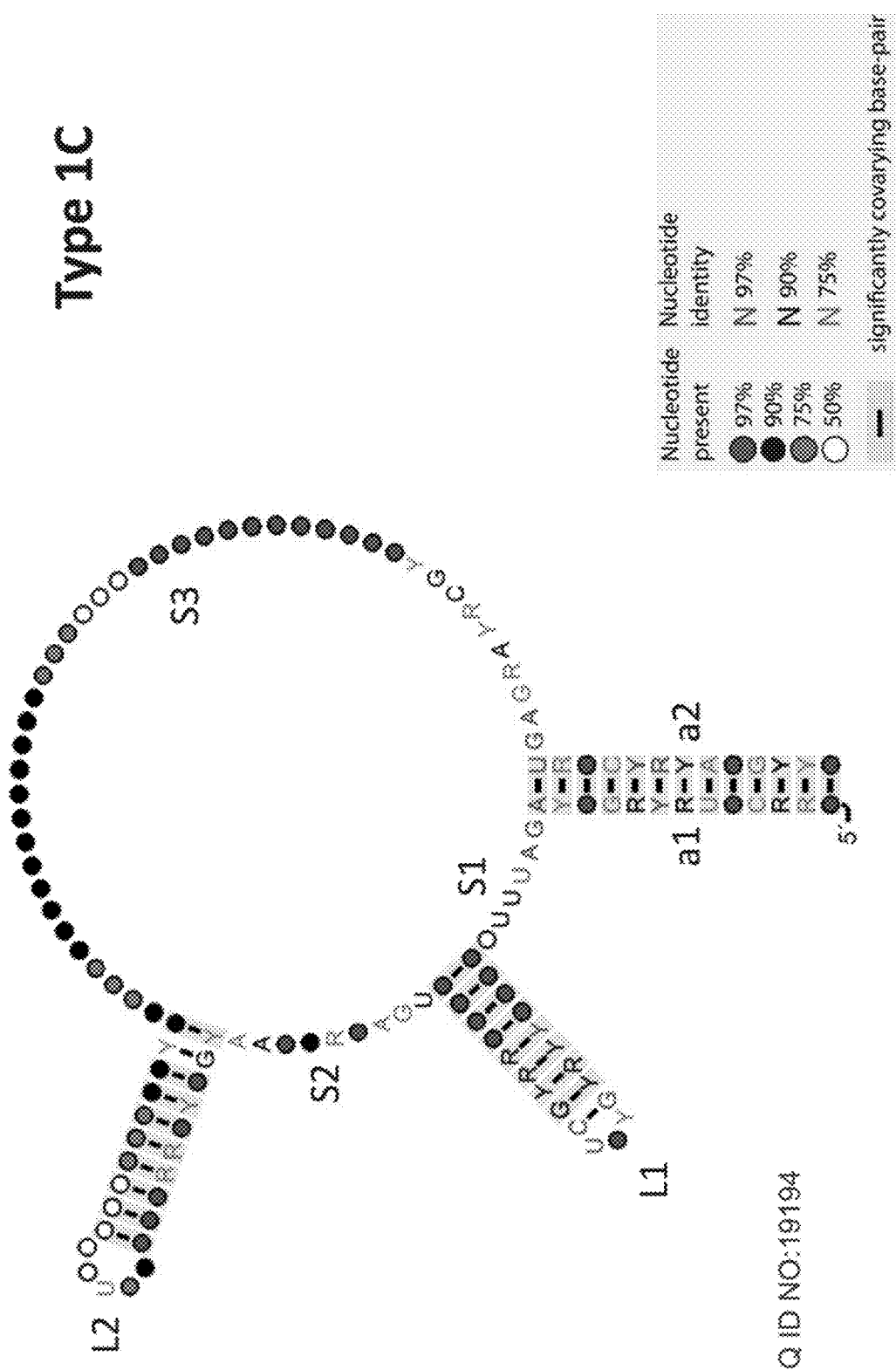
FIG. 5 SEQ ID NO:19194

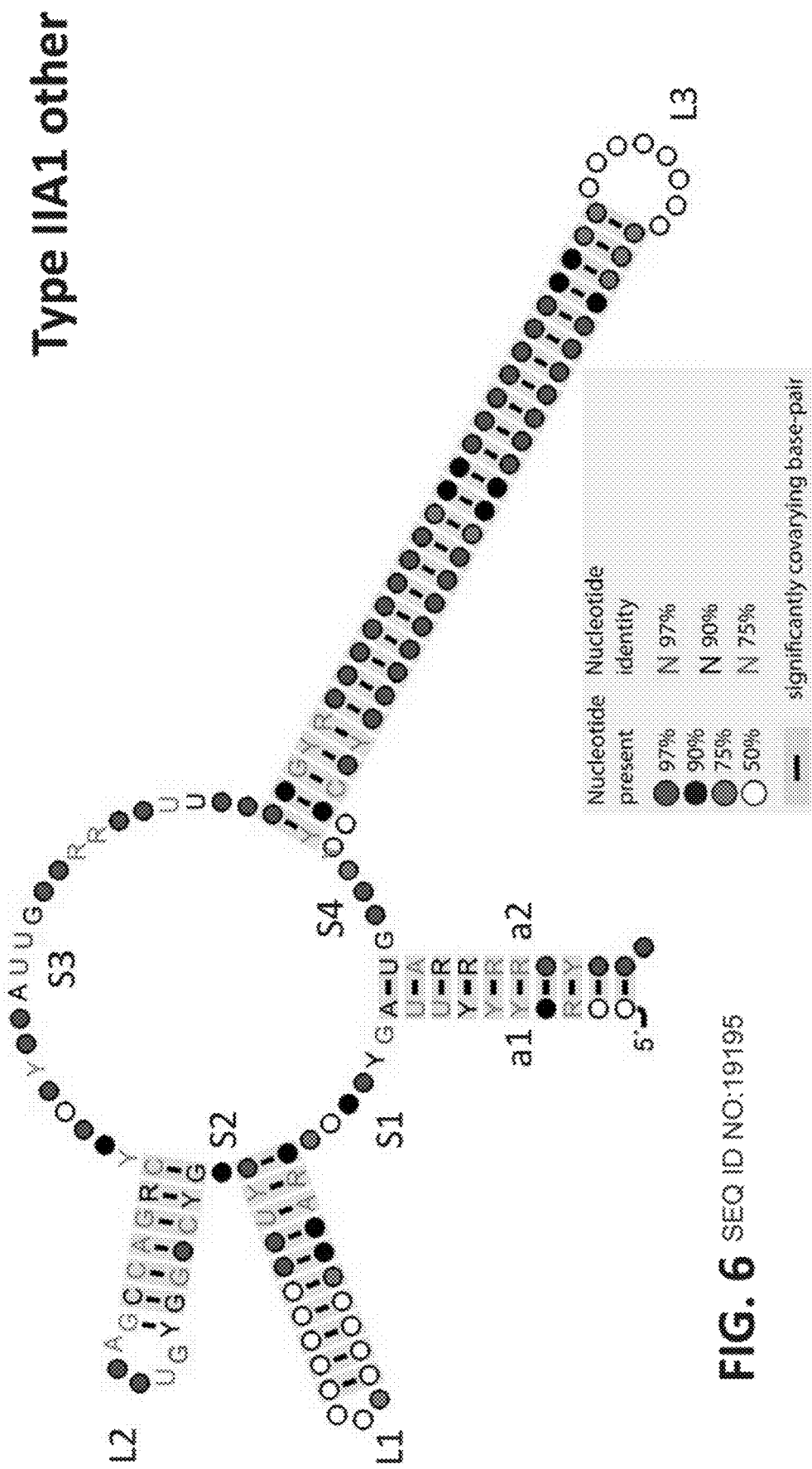
FIG. 6 SEQ ID NO:19195

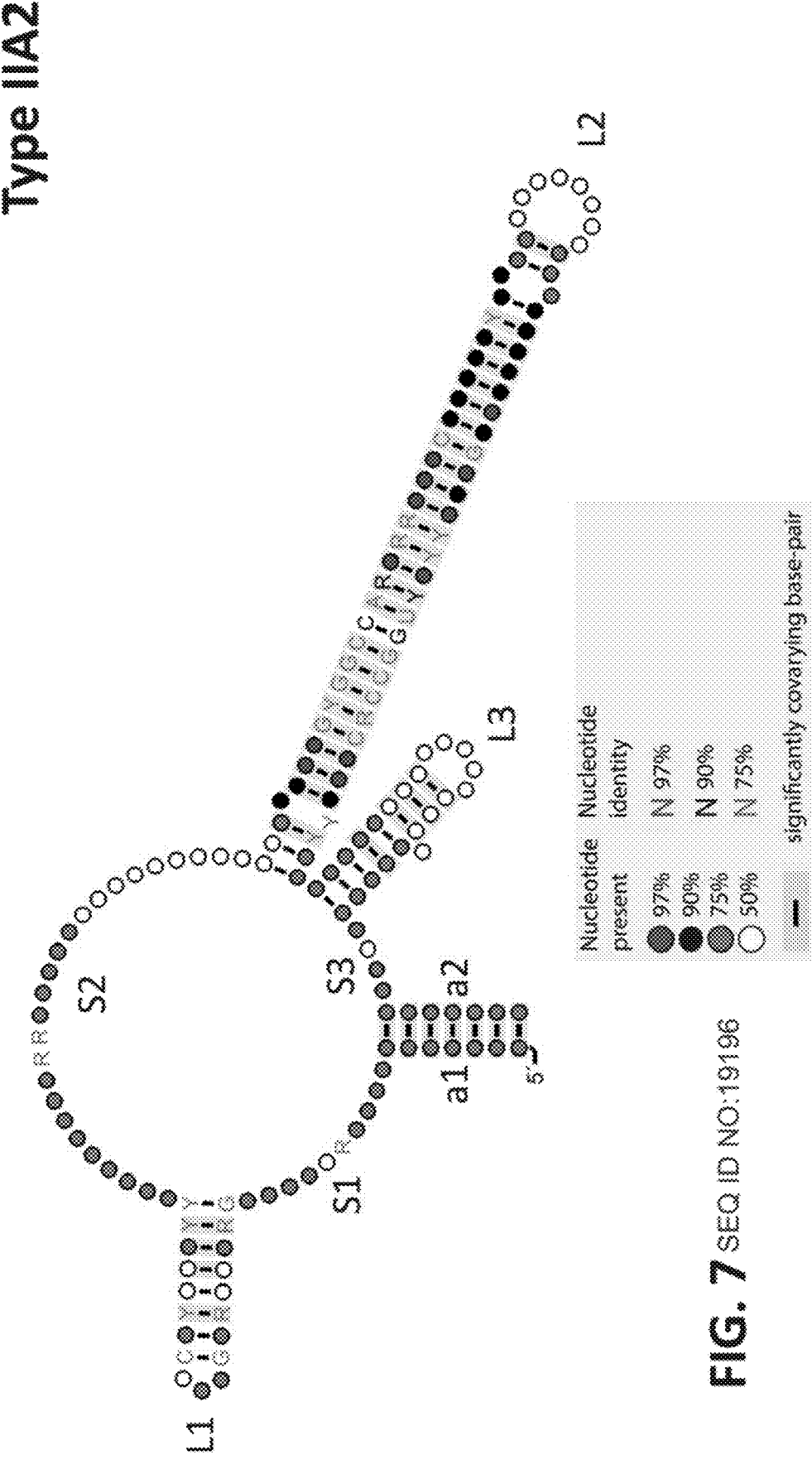
FIG. 7 SEQ ID NO: 19196

SEQ ID NO:19197

SEQ ID NO:19198

SEQ ID NO 19199

FIG. 11 SEQ ID NO: 19200

FIG. 12 SEQ ID NO:19201

FIG. 13 SEQ ID NO:19202

FIG. 14 SEQ ID NO:19203

SEQ ID NO:19204

SEQ ID NO:19205

FIG. 17 SEQ ID NO:19206

SEQ ID NO:19207

SEQ ID NO: 19208

SEQ ID NO:19209

FIG. 21 SEQ ID NO:19210

FIG. 22 SEQ ID NO:19211

FIG. 23 SEQ ID NO:19212

FIG. 24 SEQ ID NO:19213

FIG. 25 SEQ ID NO: 19214

FIG. 26 SEQ ID NO:19215

SEQ ID NO:19216

1. Eco1 (Ec86)
2. Eco3 (Ec73)
3. Eco5 (Ec107)
4. Acol
5. RTX003_2042
6. RTX003_6083v1
7. RTX003_6943

FIG. 30

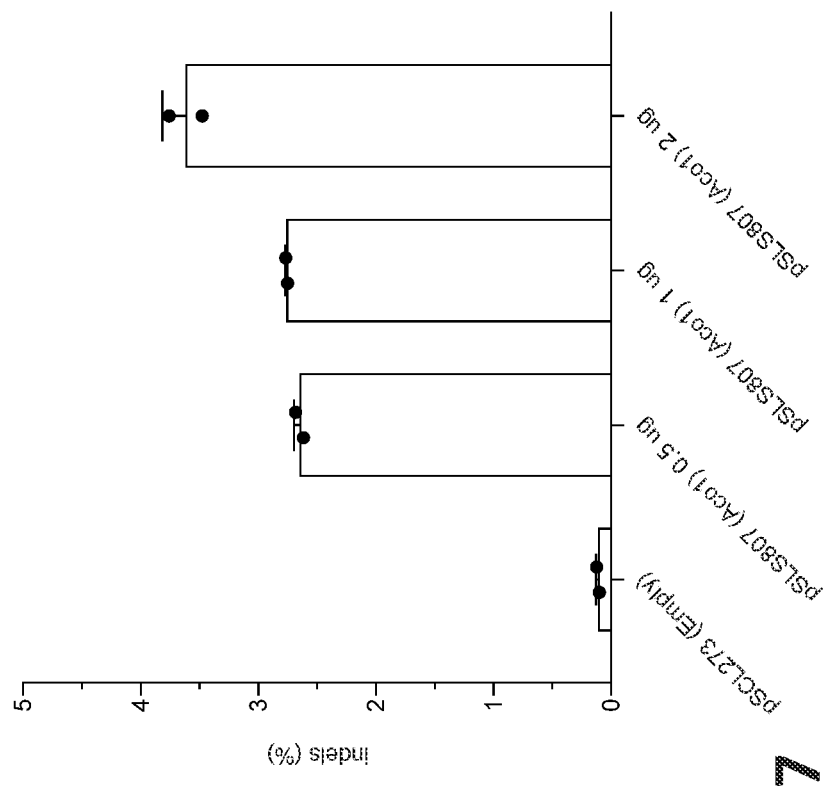
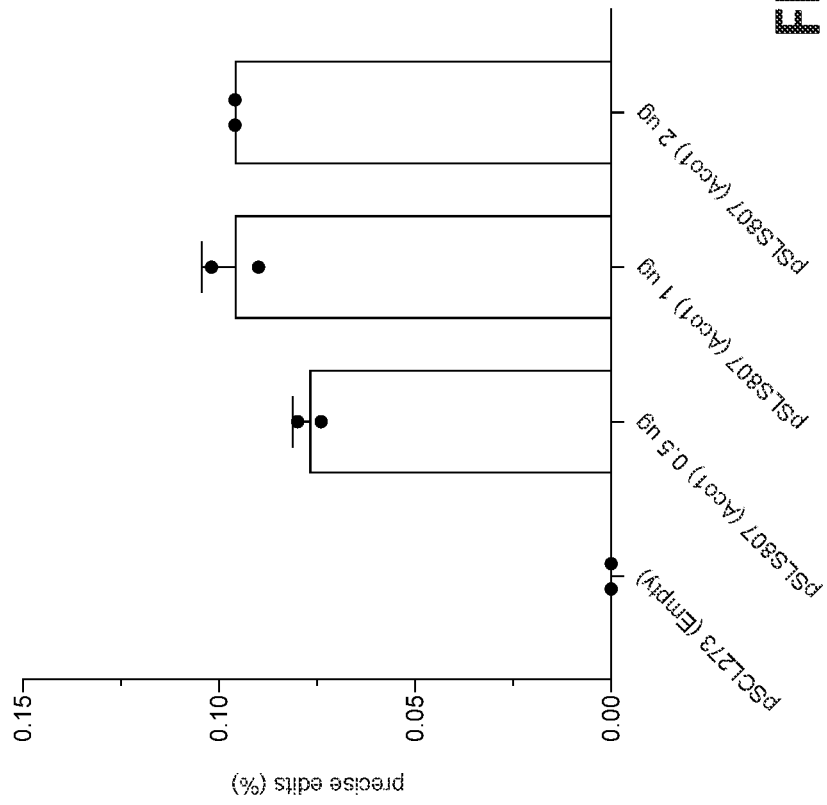
FIG. 37

ENGINEERED RETRONS AND METHODS OF USE

RELATED APPLICATIONS

This application claims priority under 35 U.S.C. § 119(e) to U.S. Provisional Application Ser. No. 63/301,936, filed Jan. 21, 2022, U.S. Provisional Application Ser. No. 63/370,880, filed Aug. 9, 2022, and U.S. Provisional Application Ser. No. 63/373,545, filed Aug. 25, 2022, each of which are incorporated herein by reference in their entireties.

SEQUENCE LISTING

This application contains a sequence listing filed in electronic form in eXtensible Markup Language (XML) format entitled J0356-03002, created on Mar. 31, 2023 and amended on Aug. 14, 2023 and having a size of 35,595,951 bytes. The content of the sequence listing is incorporated herein in its entirety.

TECHNICAL FIELD

The present disclosure generally relates to systems, methods and compositions used for precise genome editing, including nucleic acid insertions, replacements, and deletions at targeted and precise sites, wherein said systems, methods, and compositions are based on novel and/or engineered retrons.

BACKGROUND OF THE INVENTION

Precise genome editing by programmable nucleases (e.g., RNA-guided nucleases (e.g., CRISPR nucleases), zinc-finger nucleases (ZFN), and transcription activator-like effector nucleases (TALENS)) typically relies on homology-directed repair (HDR) and the presence of a donor DNA template at the site of a double-strand break (DSB) induced by the programmable nuclease. It is generally accepted that a limiting step for HDR-dependent precise genome editing is the delivery of donor DNA template to the nuclease-induced DSB (e.g., see Ling et al., "Improving the efficiency of precise genome editing with site-specific Cas9-oligonucleotide conjugates," Science Advances, 2020, Vol. 6, No. 15, pp. 1-8). Various methods aimed at boosting the efficiency of HDR-dependent editing have been reported, many of which involve the physical tethering of the DNA donor to a component of the precise editing system. Exemplary methods have been discussed in: K. Lee et al., "Synthetically modified guide RNA and donor DNA are a versatile platform for CRISPR-Cas9 engineering," eLife 6, e25312 (2017); J. Carlson-Stevermer et al., "Assembly of CRISPR ribonucleoproteins with biotinylated oligonucleotides via an RNA aptamer for precise gene editing," Nat. Commun. 8, 1711 (2017); N. Savic, et al., "Covalent linkage of the DNA repair template to the CRISPR-Cas9 nuclease enhances homology-directed repair," eLife 7, e33761 (2018); and E. J. Aird et al., "Increasing Cas9-mediated homology-directed repair efficiency through covalent tethering of DNA repair template.," Commun. Biol. 1, 54 (2018), each of which are incorporated herein by reference. Despite these efforts, efficiency of HDR-dependent precise editing remains unsatisfactory.

Retrons are defined by their unique ability to produce an unusual satellite DNA known as msDNA (multicopy single-stranded DNA). DNA encoding retrons includes a reverse transcriptase (RT)-coding gene (ret) and a nucleic acid sequence encoding the non-coding RNA (ncRNA), which contains two contiguous and inverted non-coding sequences referred to as the msr and msd. The ret gene and the non-coding RNA (including the msr and msd) are transcribed as a single RNA transcript, which becomes folded into a specific secondary structure following post-transcriptional processing. Once translated, the RT binds the RNA template downstream from the msd locus, initiating reverse transcription of the RNA towards its 5' end, assisted by the 2'OH group present in a conserved branching guanosine residue that acts as a primer. Reverse transcription halts before reaching the msr locus, and the resulting DNA, the msDNA, remains covalently attached to the RNA template via a 2'-5' phosphodiester bond and base-pairing between the 3' ends of the msDNA and the RNA template. The external regions, at the 5' and 3' ends of the msd/msr transcript (a1 and a2, respectively) are complementary and can hybridize, leaving the structures located in the msr and msd regions in internal positions (see FIG. 1A). The msr locus, which is not reverse transcribed, forms one to three short stem-loops of variable size, ranging from 3 to 10 base pairs, whereas the msd locus folds into a single/double long hairpin with a highly variable long stem of 10-50 bp in length that is also present in the final msDNA form.

It has recently been reported that retrons may be utilized as a means to provide donor DNA template for HDR-dependent genome editing (e.g., see Lopez et al., "Precise genome editing across kingdoms of life using retron-derived DNA," Nature Chemical Biology, Dec. 12, 2021, 18, pages 199-206 (2022)), however, producing sufficient levels of donor DNA template intracellularly to sufficiently support efficient HDR-dependent editing remains a significant challenge. Improved retron-based genome modification systems are highly desirous in the art.

SUMMARY OF THE INVENTION

In one aspect, the present disclosure provides recombinant retrons comprising one or more genetic modifications which improves the functionality and/or properties of a retron. Such genetic modifications can include a mutation, insertion, deletion, inversion, replacement, substitution, or translocation of one or more contiguous or non-contiguous nucleobases in a nucleic acid molecule encoding a retron or a component of a retron, such as an ncRNA or a reverse transcriptase. In various aspects, the retron that becomes modified with the one or more genetic modifications (i.e., the "pre-modified" or "unmodified" retron or retron component) is a naturally occurring retron or retron component (e.g., naturally occurring ncRNA of Table A or RT) ability to facilitate homology-dependent recombination (or HDR) in a cell, thereby resulting in a relative increase in the concentrations or amounts of msDNA comprising a DNA donor template. In particular embodiments, the recombinant retrons are based on and/or derived from a naturally-occurring retron, such as any retron-related sequence provided by Table X (the introduction of the one or more genetic modifications into a set of 7257 previously unknown retrons discovered through computational methods described herein (e.g., see Examples). In other embodiments, the recombinant retrons are based on introducing the one or more genetic modifications into previously available retron sequences (e.g., the "Mestre et al., *Systematic Prediction of Genes Functionally Associated with Bacterial Retrons and Classification of The Encoded Tripartite Systems*, Nucleic Acids Research, Volume 48, Issue 22, 16 Dec. 2020, Pages 12632-12647" (incorporated herein by reference) to achieve recombinant retrons with the enhanced ability to produce increased concentrations or amounts of msDNA comprising a DNA donor template.

In another aspect, the present disclosure further provides nucleic acid molecules encoding the recombinant retrons and/or recombinant retron components (e.g., a recombinant ncRNA and/or a recombinant retron RT). In still another aspect, the present disclosure provides genome editing systems comprising recombinant retron components (e.g., recombinant ncRNA and/or recombinant RT), programmable nucleases (e.g., RNA-guided nucleases, such as CRISPR-Cas proteins, ZFPs, and TALENS), and guide RNAs (in the case where RNA-guide nucleases are used in said genome editing systems). In a further aspect, the disclosure provides nucleic acid molecules encoding the described genome editing systems and said components thereof, as well as polypeptides making up the components of said genome editing systems. In yet another aspect, the disclosure provides vectors for transferring and/or expressing said genome editing systems, e.g., under in vitro, ex vivo, and in vivo conditions. In still another aspect, the disclosure provides cell-delivery compositions and methods, including compositions for passive and/or active transport to cells (e.g., plasmids), delivery by virus-based recombinant vectors (e.g., AAV and/or lentivirus vectors), delivery by non-virus-based systems (e.g., liposomes and LNPs), and delivery by virus-like particles. Depending on the delivery system employed, the retron-based genome editing systems described herein may be delivered in the form of DNA (e.g., plasmids or DNA-based virus vectors), RNA (e.g., ncRNA and mRNA delivered by LNPs), a mixture of DNA and RNA, protein (e.g., virus-like particles), and ribonucleoprotein (RNP) complexes. Any suitable combinations of approaches for delivering the components of the herein disclosed retron-based genome editing systems may be employed. In one embodiment, each of the components of the retron-based genome editing system is delivered by an all-RNA system, e.g., the delivery of one or more RNA molecules (e.g., mRNA and/or ncRNA) by one or more LNPs, wherein the one or more RNA molecules form the ncRNA and guide RNA (as needed) and/or are translated into the polypeptide components (e.g., the RT and a programmable nuclease). In yet another aspect, the disclosure provides methods for genome editing by introducing a retron-based genome editing system described herein into a cell (e.g., under in vitro, in vivo, or ex vivo conditions) comprising a target edit site, thereby resulting in an edit at the target edit. In other aspects, the disclosure provides formulations comprising any of the aforementioned components for delivery to cells and/or tissues, including in vitro, in vivo, and ex vivo delivery, recombinant cells and/or tissues modified by the recombinant retron-based genome modification systems and methods described herein, and methods of modifying cells by conducting genome editing and related DNA donor-dependent methods, such as recombineering, or cell recording, using the herein disclosed retron-based genome modification systems. The disclosure also provides methods of making the recombinant retrons, retron-based genome modification systems, vectors, compositions and formulations described herein, as well as to pharmaceutical compositions and kits for modifying cells under in vitro, in vivo, and ex vivo conditions that comprise the herein disclosed genome editing and/or modification systems.

In an embodiment, this disclosure or the inventions herein provide a gene editing system comprising one or more delivery vehicles, wherein: the delivery vehicle(s) comprise RNA cargo; the RNA cargo comprises (a) at least one mRNA molecule encoding (i) a nucleic acid programmable nuclease and (ii) a retron reverse transcriptase, (b) an engineered retron ncRNA, and (c) guide RNA for the programmable nuclease; and each delivery vehicle contains (a)(i) and/or (a)(ii) and/or (b) and/or (c); whereby one delivery vehicle or more than one delivery vehicle delivers (a)(i), (a)(ii), (b), and (c).

In an embodiment, in the gene editing system, (a)(i) and (a)(ii) comprise a single mRNA molecule encoding the nucleic acid programmable nuclease and the retron reverse transcriptase.

In an embodiment, in the gene editing system, (a)(i) and (a)(ii) are encoded and expressed as a fusion protein.

In an embodiment, in the gene editing system (a)(i) and (a)(ii) are encoded and expressed as a fusion protein and the fusion protein comprises the C-terminal end of the nucleic acid programmable nuclease fused to the N-terminal end of the retron reverse transcriptase (nuclease:RT fusion); or the fusion protein comprises the N-terminal end of the nucleic acid programmable nuclease fused to the C-terminal end of the retron reverse transcriptase (RT:nuclease fusion).

In an embodiment, in the gene editing system, (a)(i) and (a)(ii) comprise a first mRNA molecule encoding the nucleic acid programmable nuclease and a second mRNA molecule encoding the retron reverse transcriptase.

In an embodiment, in the gene editing system, (c) is separate from (a)(i), (a)(ii) and (b) or is provided in trans.

In an embodiment, in the gene editing system, (b) the engineered retron ncRNA, and (c) the guide RNA are fused or are provided in cis.

In an embodiment, in the gene editing system, (b) the engineered retron ncRNA, and (c) the guide RNA are fused or are provided in cis and the guide RNA is fused to the 5' end of the retron ncRNA.

In an embodiment, in the gene editing system, (b) the engineered retron ncRNA, and (c) the guide RNA are fused or are provided in cis and the guide RNA is fused to the 3' end of the retron ncRNA.

In an embodiment, in the gene editing system, (b) the engineered retron ncRNA, and (c) the guide RNA are fused or are provided in cis and the engineered ncRNA comprises a first guide RNA fused to the 5' end of the retron ncRNA, and a second guide RNA fused to the 3' end of the retron ncRNA, and the first and second guide RNAs target different sequences. Thus, on a broader scale, in an embodiment, in the gene editing system, (c) guide RNA for the programmable nuclease, can comprise one or more guides that target the same or different target sequences. Such guide RNA(s) in an embodiment, can be single guide RNA(s) or sgRNA(s); for instance, when the nucleic acid programmable nuclease comprises a Cas9.

In an embodiment, in the gene editing system, the one or more delivery vehicles comprise a liposome or a lipid nanoparticle (LNP).

In an embodiment, in the gene editing system, (a) the at least one mRNA molecule encoding (i) the nucleic acid programmable nuclease and (ii) the retron reverse transcriptase, and (b) the engineered retron ncRNA, are in the same delivery vehicle.

In an embodiment, in the gene editing system, (a) the at least one mRNA molecule encoding (i) the nucleic acid programmable nuclease and (ii) the retron reverse transcriptase, and (b) the engineered retron ncRNA, are in separate delivery vehicles.

In an embodiment, in the gene editing system, the nucleic acid programmable nuclease and the retron reverse transcriptase are encoded on separate mRNA molecules and those separate mRNA molecules of (a)(i) and (a)(ii) are contained in the same delivery vehicle.

In an embodiment, in the gene editing system, the nucleic acid programmable nuclease and the retron reverse transcriptase are encoded on separate mRNA molecules and those separate mRNA molecules of (a)(i) and (a)(ii) are contained in different delivery vehicles.

In an embodiment, in the gene editing system, the engineered retron ncRNA includes a sequence of interest encoding a donor polynucleotide comprising an intended edit to be integrated at a target sequence in a cell, and wherein the donor polynucleotide is flanked by a 5' homology arm that hybridizes to a sequence 5' to the target sequence and a 3' homology arm that hybridizes to a sequence 3' to the target sequence. In an embodiment, the donor polynucleotide can be heterologous to the cell. In an embodiment, the donor polynucleotide can be endogenous to the cell; for instance, the cell can contain a sequence that is typical for those in a population having a disease state and the donor polynucleotide can be a sequence that is typical for those in the population not having a non-disease state (e.g., the donor can be for a genetic correction or repair of a cell to modify the cell from having a mutation or modification that gives rise to a disease state to having a sequence typical of not having the disease state). Such can be done in an animal cell, or a mammalian cell (e.g., a primate, a non-human primate, or a domesticated mammal such as a cat or dog or horse) or a human cell; for instance to correct, address, treat, mitigate a genetic condition in the animal, mammal, domesticated mammal, cat, dog, horse or human. Such can be done in plant cells to introduce mutations that give rise to favorable phenotypic characteristics such as disease resistance or other favorable plant trait(s).

In an embodiment, in the gene editing system, the nucleic acid programmable nuclease comprises a Cas9 nuclease, a TnpB nuclease, or a Cas12a nuclease.

In an embodiment, in the gene editing system, the engineered retron ncRNA comprises: A) a pre-msr sequence having a first complementary region of the retron ncRNA; B) an msr sequence including an msr stem-loop structure; C) an msd sequence including an msd stem-loop structure and a sequence of interest, wherein said msd sequence templates a single strand DNA product (RT-DNA) in the presence of the retron reverse transcriptase; and D) a post-msd sequence having a second complementary region, wherein the first and second complementary regions form an a1/a2 duplex region of the retron ncRNA, wherein the msr stem-loop structure, the msd stem-loop structure, or the a1/a2 duplex comprise a modification which result in increased editing efficiency in the presence of a nucleic acid programmable nuclease that associates with the one or more guide RNAs, and wherein optionally one or more of the guide RNAs of (c) are coupled to the pre-msr sequence, the post-msd sequence, or both the pre-msr sequence and the post-msd sequence. In such an embodiment where the engineered retron ncRNA comprises A), B), C) and D), wherein the sequence of interest can encode a donor polynucleotide comprising an intended edit to be integrated at a target sequence of a cell, wherein the donor polynucleotide is flanked by a 5' homology arm that hybridizes to a sequence 5' to the target sequence and a 3' homology arm that hybridizes to a sequence 3' to the target sequence. In such an embodiment where the engineered retron ncRNA comprises A), B), C) and D) (either with the sequence of interest encoding a donor polynucleotide or simply being a sequence of interest), the ncRNA has a nucleotide sequence of Table B, or a nucleotide sequence having at least 75%, 80%, 85%, 90%, 95%, 99%, or 100% sequence identity with a sequence from Table B. The donor polynucleotide can be heterologous to a cell. Alternatively, the donor polynucleotide can be endogenous to the cell. For instance, the cell can contain a sequence that is typical for those in a population having a disease state and the donor polynucleotide can be a sequence that is typical for those in the population not having a non-disease state (e.g., the donor can be for a genetic correction or repair of a cell to modify the cell from having a mutation or modification that gives rise to a disease state to having a sequence typical of not having the disease state).

In an embodiment of the gene editing system, the gene editing system can comprise any combination(s) of the foregoing embodiments of the gene editing system.

In an embodiment, this disclosure or the inventions herein provide a cell, such as an isolated cell comprising the gene editing system disclosed herein, such as in any of the foregoing paragraphs. In an embodiment the cell, e.g., isolated cell, can be a eukaryotic cell. In an embodiment the eukaryotic cell can be a plant cell or an animal cell or a mammalian cell, e.g., an isolated plant cell or an isolated animal cell or an isolated mammalian cell. In an embodiment, the mammalian cell, e.g., an isolated mammalian cell, can be a human cell. In an embodiment, the cell can be a prokaryotic cell, e.g., a bacterial cell. In such an embodiment where the cell is a bacterial cell, the donor polynucleotide can code for antibiotic susceptibility; and thus, the invention can involve a means for addressing antibiotic resistant bacteria by rendering such bacteria susceptible to antibiotics (and a subject to whom the gene editing system is administered can also then receive antibiotics to which the bacteria are rendered susceptible by the gene editing system).

In an embodiment, this disclosure or the inventions herein provide a composition comprising: a) the gene editing system disclosed herein, such as in any of the foregoing paragraphs; and b) a pharmaceutically or veterinarily acceptable carrier. In an embodiment, in the composition the delivery vehicle can comprise a lipid nanoparticle comprising: a) one or more ionizable lipids; b) one or more structural lipids; c) one or more PEGylated lipids; and d) one or more phospholipids. In an embodiment, in the composition the one or more ionizable lipids comprises an ionizable lipid set forth in Table 2.

In an embodiment, this disclosure or the inventions herein provide uses of the gene editing system embodiments and/or the compositions disclosed herein, such as in any of the foregoing paragraphs; for instance, use in modifying a cell or genetically modifying a cell, e.g., a eukaryotic or a prokaryotic cell and/or an animal cell and/or a mammalian and/or a human cell and/or a bacterial cell and/or a plant cell, in vivo, in vitro or ex vivo (e.g., any cell discussed herein wherein the cell comprises an isolated cell). In an embodiment this disclosure or the inventions herein provide uses of the gene editing system embodiments and/or the compositions disclosed herein, such as in any of the foregoing paragraphs; for instance, use in treating or addressing a genetic condition of a subject, In an embodiment, this disclosure or the inventions herein provide methods of genetically modifying a cell comprising: contacting a gene editing system as herein discussed, such as in any of the foregoing paragraphs, or a composition as herein discussed, such as in any of the foregoing paragraphs (which comprises a gene editing system as herein discussed, such as in any of the foregoing paragraphs), advantageously a gene editing system that includes a sequence of interest encoding a donor polynucleotide comprising an intended edit to be integrated at a target sequence in a cell, said method comprising contacting the composition or the gene editing system with the cell, thereby delivering the RNA cargo to the cell, wherein: the nucleic acid programmable nuclease forms a complex with the guide RNA, wherein said guide RNA directs the complex to the target sequence; the nucleic acid programmable nuclease creates a double-stranded break in in the target sequence; the retron reverse transcriptase and engineered retron ncRNA create RT DNA that comprises the donor polynucleotide; and the donor polynucleotide becomes integrated at the target sequence; whereby editing the cell is genetically modified. In an embodiment, the cell can be a eukaryotic or a prokaryotic cell or an animal cell or a mammalian cell or a human cell or a bacterial cell or a plant cell.

Additional exemplary and non-limiting aspects and embodiments of the disclosure are summarized as follows in the form of numbered paragraphs.

1. An engineered nucleic acid construct comprising:
   a) a first polynucleotide encoding a non-coding RNA (ncRNA), said first polynucleotide comprising:
      1) an msr locus encoding the msr RNA portion of a multi-copy single-stranded DNA (msDNA); and
      2) an msd locus encoding the msd RNA portion of the msDNA; and
   b) one or more heterologous nucleic acids inserted at or within a location selected from: the msd locus, upstream of the msr locus, upstream of the msd locus, and downstream of the msd locus,
   wherein the ncRNA comprises:
      (I) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity with an ncRNA listed in Table B; and/or
      (II) an ncRNA having a conserved structure of any one of the ncRNA structures of FIGS. 2-27 (SEQ ID NO:19191-19216); and
   wherein the ncRNA optionally excludes any ncRNA associated in nature with any one of the retron reverse transcriptases of Table X.

2. The engineered nucleic acid construct of paragraph 1, further comprising a second polynucleotide encoding a reverse transcriptase (RT), or a portion thereof, wherein the encoded RT or portion thereof is capable of synthesizing a DNA copy of at least a portion of the msd locus encoding the msDNA.

3. The engineered nucleic acid construct of paragraph 2, wherein the second polynucleotide comprises:
   III) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A; and/or
   IV) encodes a consensus amino acid sequence of Table C, or encodes an amino acid sequence having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an amino acid sequence listed in Table C; and/or
   wherein the second polynucleotide encodes:
   V) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or
   VI) a polypeptide comprising a polypeptide consensus sequence listed in Table C, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an amino acid sequence listed in Table C; and/or
   wherein the second polynucleotide optionally does not encode an amino acid sequence listed in Table X.

4. An engineered nucleic acid construct comprising:
   a) a first polynucleotide encoding a non-coding RNA (ncRNA), said first polynucleotide comprising:
      1) an msr locus encoding the msr RNA portion of a multi-copy single-stranded DNA (msDNA); and
      2) an msd locus encoding the msd RNA portion of the msDNA;
   b) one or more heterologous nucleic acids inserted at or within a location selected from: the msd locus, upstream of the msr locus, upstream of the msd locus, and downstream of the msd locus; and
   c) a second polynucleotide encoding a reverse transcriptase (RT), or a portion thereof, wherein the encoded RT or portion thereof is capable of synthesizing a DNA copy of at least a portion of the msd locus encoding the msDNA, and,
   wherein the non-coding RNA (ncRNA) of the first polynucleotide optionally has a conserved structure of any one of the ncRNA structures of FIGS. 2-27 (SEQ ID NO:19191-19216);
   wherein the second polynucleotide comprises:
   I) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A; and/or wherein the second polynucleotide encodes:
II) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or
IV) a polypeptide comprising a polypeptide consensus sequence listed in Table C, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table C; and
wherein the second polynucleotide optionally does not encode an amino acid sequence of Table X.

4a. An engineered nucleic acid construct, comprising:
1) an msr locus (that encodes the msr RNA portion of an msDNA);
2) an msd locus encoding the msd RNA portion of the msDNA;
3) a sequence encoding a retron reverse transcriptase (RT), wherein said msd RNA is capable of being reverse transcribed to form the msDNA by the retron reverse transcriptase (RT); and,
4) a heterologous nucleic acid inserted at or within the msd locus, upstream of the msr locus, upstream or downstream of the msd locus;
wherein the engineered nucleic acid construct optionally has (a) a secondary structure of a wild-type ncRNA of any one of FIGS. 2-27 (SEQ ID NO:19191-19216) or
b) a variant of a), having:
i) up to 1, 2, or 3 (e.g., up to 1) nucleotide changes per 10 red lettered-nucleotides;
ii) up to 4, 5, or 6 (e.g., up to 1 or 2) nucleotide changes per 10 black lettered-nucleotides; and/or
iii) up to 7, 8, or 9 (e.g., up to 3 or 4) nucleotide changes per 10 grey lettered-nucleotides; and/or
optionally further comprising:
i) 7, 8, 9, or 10 (e.g., 9 or 10) nucleotides present per 10 red-circled nucleotides;
ii) 6, 7, 8, 9, or 10 (e.g., 8, 9 or 10) nucleotides present per 10 black-circled nucleotides;
iii) 4, 5, 6, 7, 8, 9, or 10 (e.g., 6, 7, 8, 9 or 10) nucleotides present per 10 grey-circled nucleotides; and/or
iv) 2, 3, 4, 5, 6, 7, 8, 9, or 10 (e.g., 4, 5, 6, 7, 8, 9, or 10) nucleotides present per 10 white-circled nucleotides.

5. The engineered nucleic acid construct of any one of paragraphs 1 to 4a, comprising one or more sequence modifications (e.g., an insertion, deletion, and/or substitution of one or more nucleotide(s)) in the msr locus and/or the msd locus that:
a) modulates (e.g., enhances) reverse transcription, processivity, accuracy/fidelity, and/or production of the msDNA (e.g., in the mammalian cell);
b) modulates (e.g., reduces) immunogenicity of ncRNA encoded by the engineered retron (e.g., the msr locus and/or the msd locus) in a host (e.g., a host comprising the mammalian cell);
c) modulates (e.g., inhibits, either permanently or transiently) a function of the msDNA; and/or
d) modulates (e.g., improves) efficiency of targeted genome editing/engineering.

6. The engineered nucleic acid construct of any one of paragraphs 1 to 4, wherein said engineered nucleic acid construct has a secondary structure of a wild-type retron encoding a wild-type retron ncRNA encompassed by:
a) any one of the structures as depicted in FIGS. 2-27 (SEQ ID NO:19191-19216), or
b) a variant of a), having:
i) up to 1, 2, or 3 (e.g., up to 1) nucleotide changes per 10 red lettered-nucleotides;
ii) up to 4, 5, or 6 (e.g., up to 1 or 2) nucleotide changes per 10 black lettered-nucleotides; and/or
iii) up to 7, 8, or 9 (e.g., up to 3 or 4) nucleotide changes per 10 grey lettered-nucleotides; and/or
optionally further comprising:
i) 7, 8, 9, or 10 (e.g., 9 or 10) nucleotides present per 10 red-circled nucleotides;
ii) 6, 7, 8, 9, or 10 (e.g., 8, 9 or 10) nucleotides present per 10 black-circled nucleotides;
iii) 4, 5, 6, 7, 8, 9, or 10 (e.g., 6, 7, 8, 9 or 10) nucleotides present per 10 grey-circled nucleotides; and/or
iv) 2, 3, 4, 5, 6, 7, 8, 9, or 10 (e.g., 4, 5, 6, 7, 8, 9, or 10) nucleotides present per 10 white-circled nucleotides.

7. The engineered nucleic acid construct of any one of paragraphs 1-6, wherein the nucleic acid construct is engineered by introducing the one or more sequence modifications into a wild-type retron encoding a wild-type ncRNA listed in Table B.

8. The engineered nucleic acid construct of any one of paragraphs 1-7, wherein the one or more sequence modifications in the ncRNA comprises one or more of:
(i) a modified (e.g., mutated, reduced, or eliminated) bulge in a1, a2, or both a1 and a2;
(ii) an extension or shortening of a1, a2, or both a1 and a2;
(iii) an extension or shortening of a spacer sequence between hairpin loops (e.g., S1, S2, S3, and/or S4);
(iv) an additional or modified (e.g., mutated or eliminated) bulge in hairpin loops (e.g., L2 and/or L3 (e.g., by removing unpaired bases in the bulge, or by replacing unpaired bases with an equivalent number of base pairs));
(v) a modified (e.g., extended or shortened) length of hairpin loops (e.g., L1, L2, L3, and/or L4);
(vi) an alternative L1 and/or L2 having complement, reverse, or reverse complement sequences;
(vii) a modified (e.g., increased) number of unpaired bases at the tip of hairpin loops (e.g., L1, L2, L3, and/or L4);
(viii) a modified (e.g., increased or decreased) GC content in hairpin loops (e.g., L1, L2, L3, and/or L4);
(ix) an insertion of the heterologous nucleic acid in spacer sequences between hairpin loops (e.g., S1, S2, S3 and/or S4), or at the tip of hairpin loops (e.g., L1, L2, L3, and/or L4);

(x) a deletion of one or more hairpin loops (e.g., L1, L2, L3 and/or L4); (xi) an addition of a new loop in a spacer sequence between hairpin loops (e.g., S1, S2, S3, and/or S4);

(xii) circularization of the ncRNA with the 5' end and the 3' end of the ncRNA being connected either directly, or via a spacer sequence;

(xiii) a repositioned branching guanosine capable of initiating reverse transcription priming;

(xiv) a staggered end sequence that reduces immunogenicity of the retron ncRNA, created by, e.g., adding or removing the 5' a1 nucleotides and/or the 3' a2 nucleotides; and/or, (xv) an antisense sequence complementary to a CRISPR/Cas guide RNA (gRNA) sequence encoded by the heterologous nucleic acid, wherein the antisense sequence hybridizes to and inhibits said gRNA in the encoded retron ncRNA, and wherein said antisense sequence is removed upon reverse transcription of the msDNA.

9. The engineered nucleic acid construct of any one of paragraphs 1-8, wherein the one or more heterologous nucleic acid sequences comprise:
a) a heterologous nucleic acid (such as the coding sequence for an RNA aptamer or a ribozyme) inserted into the msr locus or the msd locus (such as in an S region (e.g., S1, S2, S3 and/or S4), or the tip of an L region (e.g., L1, L2, L3 and/or L4), or upstream or downstream of either the msr locus or the msd locus; or
b) a first heterologous nucleic acid inserted into the msd locus, and a second heterologous nucleic acid inserted either upstream of the msr locus or downstream of the msd locus, wherein the second heterologous nucleic acid encodes a guide RNA.

10. The engineered nucleic acid construct of any one of paragraphs 1-9, wherein said heterologous nucleic acid encodes:
(a) a protein or peptide of interest, or wherein said heterologous nucleic acid comprises;
(b) a DNA donor template sequence;
(c) a functional DNA element selected from a promoter, an enhancer, a protein binding sequence, a methylation site, a homology region for assisting gene editing, and the like; or (d) a coding sequence for a functional RNA element selected from a guide RNA and a ncRNA.

11. The engineered nucleic acid construct of paragraph 10, wherein said protein or peptide of interest comprises a therapeutic protein useful in treating a disease.

12. The engineered nucleic acid construct of paragraph 10, wherein said DNA donor template sequence corrects/repairs/removes a mutation at the target genome site.

13. The engineered nucleic acid construct of any one of paragraphs 1-12, further comprising or encoding a sequence-specific nuclease (such as a CRISPR/Cas effector enzyme, a ZFN, a TALEN, a meganuclease, TnpB, IscB, or a restriction endonuclease (RE)), and/or a DNA-repair modulating biomolecule.

13b. The engineered nucleic acid construct of paragraphs 1-13 wherein the engineered nucleic acid is an all-RNA component system.

13c. The engineered nucleic acid construct of paragraphs 1-13 wherein the engineered nucleic acid is an all-DNA molecule system.

14. The engineered nucleic acid construct of paragraph 13, wherein the sequence-specific nuclease is fused to the RT, optionally via a flexible linker (e.g., a flexible linker comprising Gly and Ser rich sequences such as G4S repeats (SEQ ID NO:19143) or GS repeats) or by a generally disordered protein sequence (such as unstructured hydrophilic, biodegradable protein polymer, e.g., an XTEN peptide polymer).

15. The engineered nucleic acid construct of paragraph 13 or 14, wherein the nuclease is a CRISPR/Cas effector enzyme that forms a complex with a guide RNA (gRNA) recognizing a target sequence, wherein the gRNA is linked to the ncRNA and/or the msDNA, either directly or through a linker/spacer polynucleotide.

16. The engineered nucleic acid construct of paragraph 13, wherein the DNA-repair modulating biomolecule is a regulatory protein that modulates (e.g., enhances) HDR, and the regulatory protein is fused to the RT or to the sequence-specific nuclease, optionally via a flexible linker (e.g., the flexible linker comprising Gly and Ser rich sequences such as G4S(SEQ ID NO:19143) repeats or GS repeats) or by a generally disordered protein sequence (such as unstructured hydrophilic, biodegradable protein polymer, e.g., an XTEN peptide polymer).

17. A vector system comprising one or more vectors comprising the engineered nucleic acid construct of any one of paragraphs 1-16, wherein the vector system is optionally all-RNA.

18. The vector system of paragraph 17, wherein the msr locus, the msd locus, and the polynucleotide encoding the RT are comprised within the same vector.

19. The vector system of paragraph 17 or 18, wherein the same vector further comprises a promoter operably linked to the msr locus and/or the msd locus.

20. The vector system of paragraph 19, wherein the promoter is further operably linked to the polynucleotide encoding the RT.

21. A vector system comprising one or more vectors, comprising the engineered nucleic acid construct of paragraph 1 or 2, wherein the vector system further comprises a second polynucleotide encoding a reverse transcriptase (RT), or a portion thereof, wherein the encoded RT is capable of synthesizing a DNA copy of at least a portion of the msd locus encoding the msDNA, and wherein the msr locus, the msd locus, and the second polynucleotide encoding the RT are provided by at least two different vectors.

22. The vector system of paragraph 21, wherein:
a) the second polynucleotide comprises:
i) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A; and/or
b) the second polynucleotide encodes:
i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or ii) a polypeptide listed in Table C, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table C; and wherein the second polynucleotide optionally does not encode a polypeptide listed in Table X.

23. The vector system of paragraph 21 or 22, wherein the polynucleotide encoding the RT is provided in trans with respect to the msr gene and/or the msd gene.

24. The vector system of any one of paragraphs 17-23, wherein the one or more vectors comprise a viral vector.

25. The vector system of paragraph 24, wherein the viral vector is a retroviral vector, a lentiviral vector, an adenoviral vector, an adeno-associated viral vector, a vaccinia viral vector, a poxviral vector, or a herpes simplex viral vector.

26. The vector system of any one of paragraphs 17-23, wherein the one or more vectors comprise a non-viral vector.

27. The vector system of paragraph 26, wherein the non-viral vector comprises a plasmid.

28. The vector system of paragraph 26, wherein the non-viral vector comprises a liposome, a lipid nanoparticle (LNP), a cationic polymer, a vesicle, or a gold nanoparticle.

29. The vector system of any one of paragraphs 17-28, comprising a vector encoding a sequence-specific nuclease.

30. The vector system of paragraph 29, wherein the sequence-specific nuclease comprises an RNA-guided sequence-specific nuclease (e.g., a CRISPR/Cas effector enzyme, an engineered RNA-guided FokI-nuclease (e.g., dCas-FokI), an RNA-guided DNA endonuclease, TnpB, IscB, or a transposon-associated nuclease), or a non-RNA-guided sequence-specific nuclease (e.g., a meganuclease, a zinc finger nuclease (ZFN), a TALE nuclease (TALEN), or a restriction endonuclease (RE)).

31. The vector system of paragraph 30, wherein the Cas effector enzyme is a Class 1, Type I, II, or III Cas; a Class 2, Type II Cas (e.g., Cas9); or a Class 2, Type V Cas (e.g., Cpf1).

32. The vector system of paragraph 30, wherein:
1) the RNA-guided sequence-specific nuclease comprises the CRISPR/Cas effector enzyme, the engineered RNA-guided FokI-nuclease (e.g., dCas-FokI), the RNA-guided DNA endonuclease, TnpB, IscB, IsrB, or the transposon-associated nuclease; or,
2) non-RNA-guided sequence-specific nuclease comprises the meganuclease, the zinc finger nuclease (ZFN), the TALE nuclease (TALEN), or the restriction endonuclease (RE).

33. The vector system of any one of paragraphs 17-32, further comprising a vector encoding a homologous recombination enhancer protein.

34. An RNA molecule encoded by the engineered nucleic acid construct of any one of paragraphs 1-16.

35. An engineered nucleic acid-enzyme construct comprising:
a) a non-coding RNA (ncRNA) comprising:
i) an msr locus encoding the msr RNA portion of a multi-copy single-stranded DNA (msDNA); and
ii) an msd locus encoding the msd RNA portion of the msDNA;
b) a heterologous nucleic acid inserted at or within a location selected from: the msd locus, upstream of the msr locus, upstream of the msd locus, and downstream of the msd locus; and
c) a sequence encoding a reverse transcriptase (RT), or a domain thereof comprising:
i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or
ii) a polypeptide listed in Table C, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table C; and
wherein, the RT optionally does not comprise a polypeptide listed in Table X.

36. An engineered nucleic acid-enzyme construct comprising:
a) a non-coding RNA (ncRNA) comprising:
i) an msr locus encoding the msr RNA portion of a multi-copy single-stranded DNA (msDNA); and
ii) an msd locus encoding the msd RNA portion of the msDNA;
wherein the ncRNA comprises:
i) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B; and/or
ii) an ncRNA having a conserved structure of any one of the ncRNA structures of FIGS. 2-27 (SEQ ID NO:19191-19216); and
wherein the ncRNA optionally excludes any ncRNA associated in nature with any one of the retron reverse transcriptases of Table X;
b) a heterologous nucleic acid inserted at or within a location selected from: the msd locus; upstream of the msr locus; upstream of the msd locus; and downstream of the msd locus; and c) a reverse transcriptase (RT), or a portion thereof, wherein the RT is capable of synthesizing a DNA copy of at least a portion of the msd locus encoding the msDNA.

37. An engineered nucleic acid-enzyme construct comprising:
    a) a non-coding RNA (ncRNA) comprising:
        i) an msr locus encoding the msr RNA portion of a multi-copy single-stranded DNA (msDNA); and
        ii) an msd locus encoding the msd RNA portion of the msDNA;
    wherein, the ncRNA comprises:
        i) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B; and/or
        ii) an ncRNA having a conserved structure of any one of the ncRNA structures of FIGS. 2-27 (SEQ ID NO:19191-19216); and
    wherein the ncRNA optionally excludes any ncRNA associated in nature with any one of the retron reverse transcriptases of Table X;
    b) a heterologous nucleic acid inserted at or within a location selected from: the msd locus, upstream of the msr locus, upstream of the msd locus, and downstream of the msd locus; and
    c) a reverse transcriptase (RT) or a domain thereof:
    wherein the RT comprises:
        i) an RT listed in Table A, or an RT having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an RT listed in Table A; and/or
        ii) a consensus sequence listed in Table C, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an amino acid sequence listed in Table C; and
    wherein the RT does not optionally comprise an RT listed in Table X.
38. An isolated host cell comprising the engineered nucleic acid construct of any one of paragraphs 1-16, the vector system of any of paragraphs 17-33, the RNA molecule of paragraph 34, or the engineered nucleic acid-enzyme construct of any one of paragraphs 35-37.
39. The isolated host cell of paragraph 38, wherein the host cell is a prokaryotic, archeon, or eukaryotic host cell.
40. The isolated host cell of paragraph 38, wherein the eukaryotic host cell is a mammalian host cell.
41. The isolated host cell of paragraph 39, wherein the eukaryotic host cell is a non-human host cell.
42. The isolated host cell of paragraph 40, wherein the mammalian host cell is a human host cell.
43. The isolated host cell of any one of paragraphs 38-42, wherein the host cell is an artificial cell or genetically modified cell.
44. A pharmaceutical composition comprising:
    a) the engineered nucleic acid construct of any one of paragraphs 1-16, ncRNA encoded by the engineered nucleic acid construct of any one of paragraphs 1-16, the vector system of any one of paragraphs 17-33, the RNA molecule of paragraph 34, the engineered nucleic acid-enzyme construct of any one of paragraphs 35-37, and/or the isolated host cell of any one of paragraphs 38-43; and
    b) a pharmaceutically acceptable carrier.
45. A pharmaceutical composition comprising:
    a) a lipid nanoparticle (LNP); and
    b) the engineered nucleic acid construct of any one of paragraphs 1-16, ncRNA encoded by the engineered nucleic acid construct of any one of paragraphs 1-16, the vector system of any one of paragraphs 17-33, the RNA molecule of paragraph 34, and/or the engineered nucleic acid-enzyme construct of any one of paragraphs 35-37.
46. The pharmaceutical composition of paragraph 45, wherein the LNP encapsulates the engineered nucleic acid construct, ncRNA, vector system, RNA molecule, and/or engineered nucleic acid-enzyme construct.
47. The pharmaceutical composition of paragraph 45 or 46, wherein the lipid nanoparticle comprises:
    a) one or more ionizable lipids;
    b) one or more structural lipids;
    c) one or more PEGylated lipids; and
    d) one or more phospholipids.
48. The pharmaceutical composition of paragraph 47, wherein the one or more ionizable lipids is selected from the group consisting of those disclosed in Table 2.
49. The pharmaceutical composition of paragraph 47 or 48, wherein the one or more structural lipids are selected from the group consisting of cholesterol, fecosterol, beta sitosterol, sitosterol, ergosterol, campesterol, stigmasterol, brassicasterol, tomatidine, tomatine, ursolic acid, alpha-tocopherol, prednisolone, dexamethasone, prednisone, and hydrocortisone.
50. The pharmaceutical composition of any one of paragraphs 47-49, wherein the one or more PEGylated lipids are selected from the group consisting of PEG-c-DOMG, PEG-DMG, PEG-DLPE, PEG-DMPE, PEG-DPPC, and PEG-DSPE.
51. The pharmaceutical composition of any one of paragraphs 47-50, wherein the one or more phospholipids are selected from the group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3- phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), and sphingomyelin.
52. The pharmaceutical composition of any one of paragraphs 47-51, wherein the lipid nanoparticle comprises about 48.5 mol % ionizable lipid, about 10 mol % phospholipid, about 40 mol % structural lipid, and about 1.5 mol % of PEG lipid.
53. The pharmaceutical composition of any one of paragraphs 47-52, wherein the lipid nanoparticle comprises about 48.5 mol % ionizable lipid, about 10 mol % phospholipid, about 39 mol % structural lipid, and about 2.5 mol % of PEG lipid.
54. The pharmaceutical composition of any one of paragraphs 47-53, wherein the LNP further comprises a targeting moiety operably connected to the LNP.
55. The pharmaceutical composition of any one of paragraphs 47-54, wherein the LNP further comprises one or more additional components selected from the group consisting of DDAB, EPC, 14PA, 18BMP, DODAP, DOTAP, and C12-200.
56. The pharmaceutical composition of paragraph 45, wherein the lipid nanoparticle comprises at least one cationic lipid selected from the group consisting of: a lipid in Table 2, a lipid having a structure of Formula (I), a lipid having a structure of Formula (II), a lipid having a structure of Formula (III), a lipid having a structure of Formula (IV), a lipid having a structure of Formula (V), a lipid having a structure of Formula (VI), and combinations thereof.
57. A kit comprising the engineered nucleic acid construct of any one of paragraphs 1-16, ncRNA encoded by the engineered nucleic acid construct of any one of paragraphs 1-16, the vector system of any one of paragraphs 17-33, the RNA molecule of paragraph 34, the engineered nucleic acid-enzyme construct of any one of paragraphs 35-37, the host cell of any one of paragraphs 38-43, or the pharmaceutical composition of any one of paragraphs 44-56, and instructions for genetically modifying a cell with said engineered nucleic acid construct, ncRNA, vector system, host cell, or pharmaceutical composition.
58. A method of modifying a target DNA sequence in a host (e.g., mammalian) cell, the method comprising introducing into the mammalian cell the engineered nucleic acid construct of any one of paragraphs 1-16, ncRNA encoded by the engineered nucleic acid construct of any one of paragraphs 1-16, the vector system of any one of paragraphs 17-33, the RNA molecule of paragraph 34, the engineered nucleic acid-enzyme construct of any one of paragraphs 35-37, or the pharmaceutical composition of any one of paragraphs 44-56, to allow production of the msDNA in the host (e.g., mammalian) cell, wherein the heterologous nucleic acid in the msDNA is integrated into the genome of the host (e.g., mammalian) cell at the target DNA sequence by homology-dependent recombination.
59. The method of paragraph 58, wherein the modifying comprises introducing an insertion, deletion and/or substitution into the target DNA sequence.
60. A method of treating a disease or condition in a subject in need thereof, the method comprising administering a therapeutically effective amount of the engineered nucleic acid construct of any one of paragraphs 1-16, ncRNA encoded by the engineered nucleic acid construct of any one of paragraphs 1-16, the vector system of any one of paragraphs 17-33, the RNA molecule of paragraph 34, the engineered nucleic acid-enzyme construct of any one of paragraphs 35-37, the host cell of any one of paragraphs 38-43, or the pharmaceutical composition of any one of paragraphs 44-56 to the subject, thereby treating the disease or condition in the subject.
61. A method of treating a disease or condition in a subject in need thereof, the method comprising administering a therapeutically effective amount of the host cell of any one of paragraphs 38-43 to the subject, thereby treating the disease or condition in the subject.
62. The method of paragraph 61, wherein the host cell is autologous to the subject.
63. The method of paragraph 61, wherein the host cell is allogeneic to the subject.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein.

FIG. 1C is a schematic depicting a recombinant retron-based genome editing system described herein. In the case of genome editing involving an RNA-guided nuclease, the components of such a system may include (a) a guide RNA provided in cis (e.g., fused to the recombinant retron msDNA) and/or in trans (e.g., separately expressed in a cell), (b) a recombinant ncRNA (including at least a sequence encoding an HDR donor template and optionally a guide RNA fused ot the ncRNA), (c) a reverse transcriptase, and (d) a programmable nuclease. These components are provided to a cell in the form of DNA and/or RNA and/or protein by a delivery means (e.g., LNPs, liposomes, virus-based delivery, or passive/active transport). Once inside the cell, the recombinant msDNA is formed. The msDNA and the programmable nuclease translocate to the nuclease to conduct gene editing at a target DNA site, thereby producing an edited DNA target.

FIG. 2 (SEQ ID NO:19191) is a schematic representation of a consensus secondary structure of a retron ncRNA msr/msd of Type IA/IIA1 retron produced by computational structural alignment of ncRNA sequences from Table B as described in Example 3.

Figure 1A:
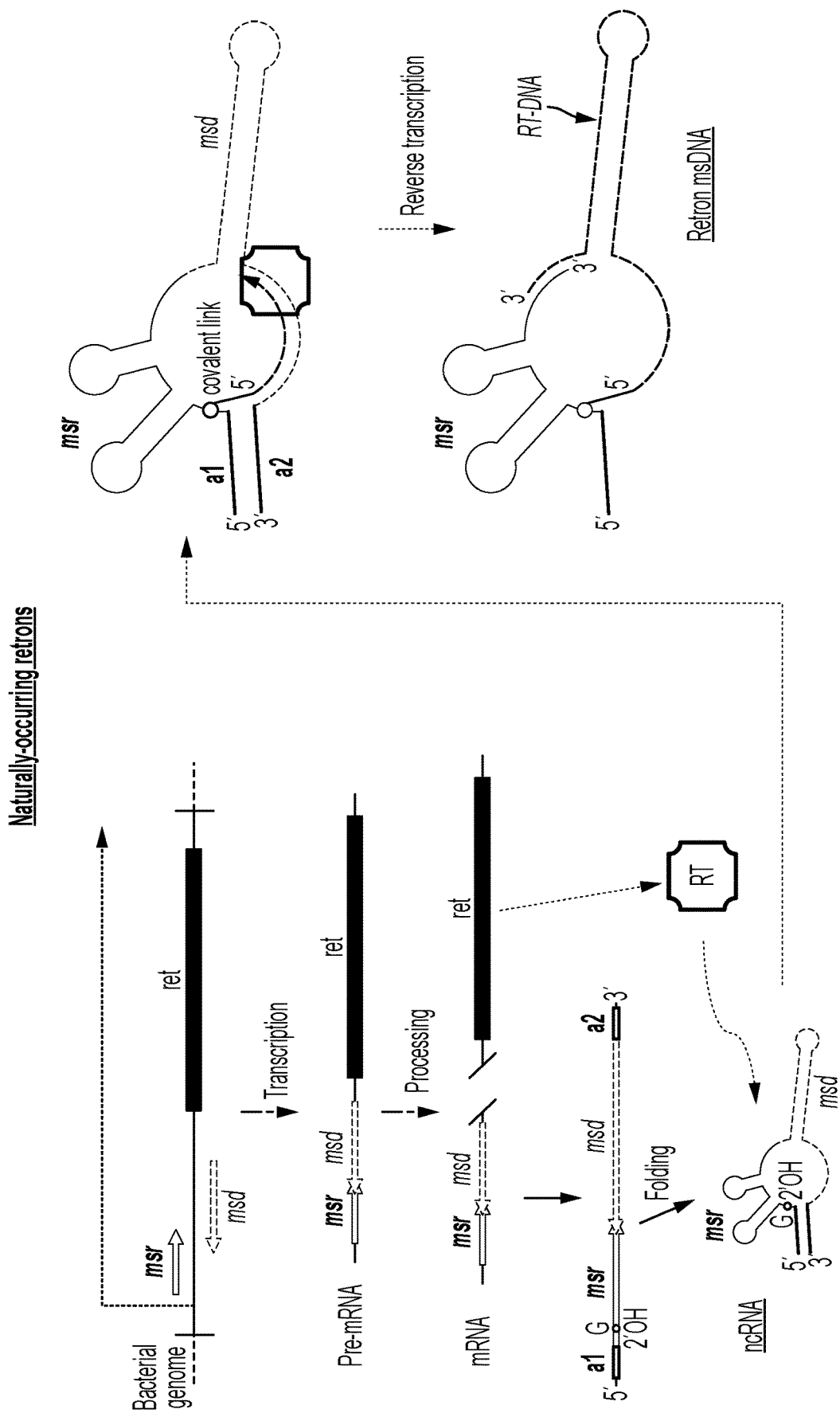
FIG. 1A is a schematic that depicts naturally occurring retrons from genomic DNA stage through production of the msDNA chimeric microsatellite molecule. Retrons are encoded in the bacterial genome and comprise a non-coding RNA (ncRNA) portion and a portion encoding a specialized reverse transcriptase (RT). The ncRNA and the RT initially are transcribed from the retron DNA as a single polycistronic message. The initial transcript is processed resulting in the removal or separation of the transcript encoding the retron RT. The remaining transcript is the ncRNA, which undergoes folding to form a secondary structure having several characteristic stem-loops and a duplex formed between the 5' and 3' regions of the ncRNA (i.e., the a1/a2 duplex). The folded ncRNA is recognized by the accompanying RT which is separately translated and provided in trans. The translated RT typically recognizes certain secondary structures in the ncRNA, and binds the RNA template downstream from the msd region. The RT initiates reverse transcription of the RNA towards its 5' end, starting from the 2'-end of a conserved guanosine (G) residue found immediately after a double-stranded RNA structure (the a1/a2 region) within the ncRNA. A portion (i.e., the msd region) of the ncRNA serves as a template for reverse transcription, and reverse transcription terminates before reaching the msr locus. During reverse transcription, cellular RNase H degrades the segment of the ncRNA that serves as template, but not other parts of the ncRNA. The result of the reverse transcription, the msDNA (lower right of schematic), remains covalently attached to the RNA template via the 2'-5' phosphodiester bond, and base-pairs with the RNA template using the 3' end of the msDNA.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

FIG. 3 (SEQ ID NO: 19192) is a schematic representation of a consensus secondary structure of a retron ncRNA msr/msd of Type IB1 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

FIG. 4 (SEQ ID NO: 19193) is a schematic representation of a consensus secondary structure of a retron ncRNA msr/msd of Type IB2 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

FIG. 5 (SEQ ID NO: 19194) is a schematic representation of a consensus secondary structure of a retron ncRNA msr/msd of Type IC retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

FIG. 6 (SEQ ID NO: 19195) is a schematic representation of a consensus secondary structure of a retron ncRNA msr/msd of Type IIA other retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-7 5% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

FIG. 7 (SEQ ID NO: 19196) is a schematic representation of a consensus secondary structure of a retron ncRNA msr/msd of Type IIA2 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 8:
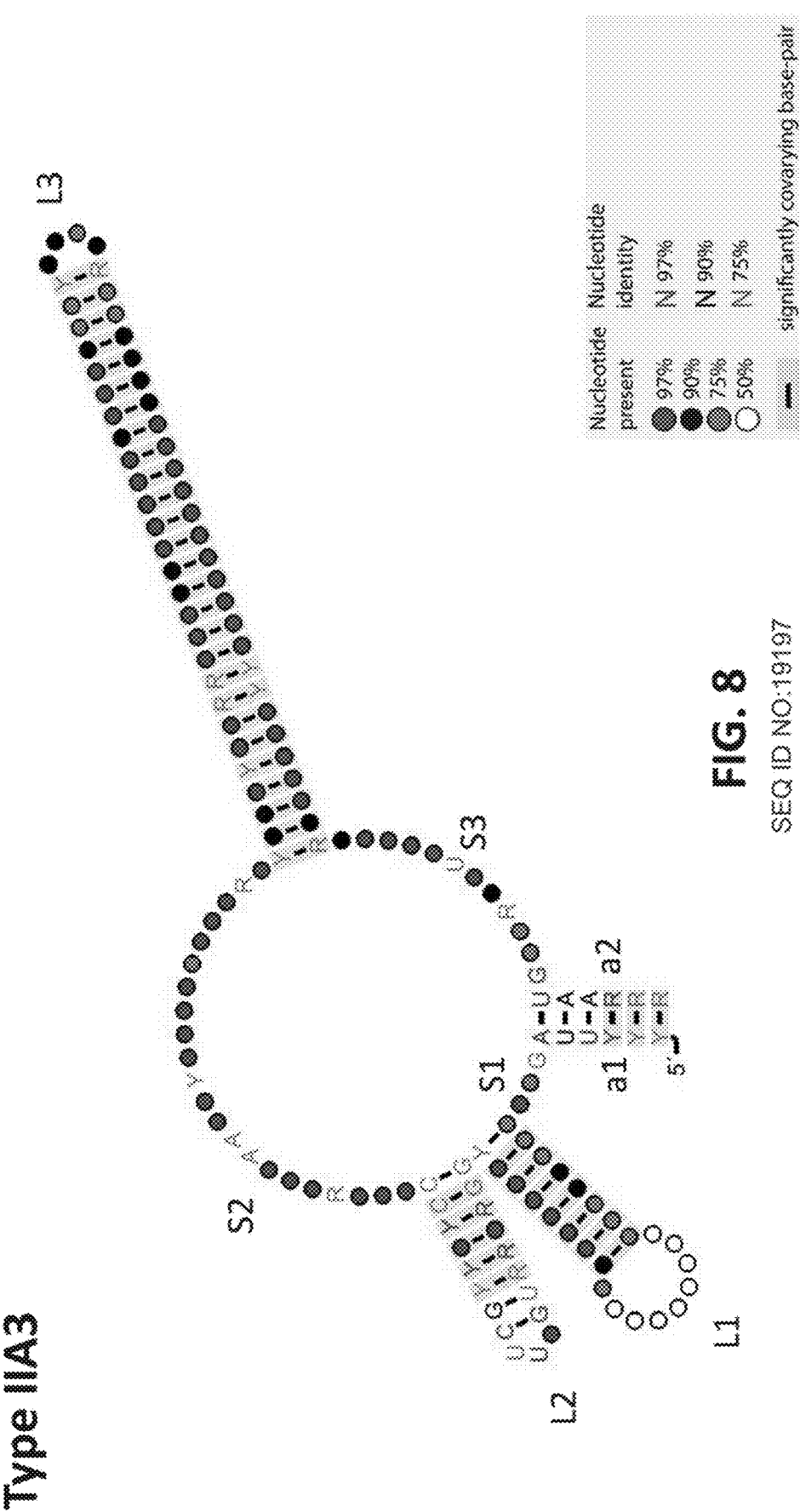

FIG. 8 (SEQ ID NO: 19197) is a schematic representation of a consensus secondary structure of a retron ncRNA msr/msd of Type IIA3 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 9:
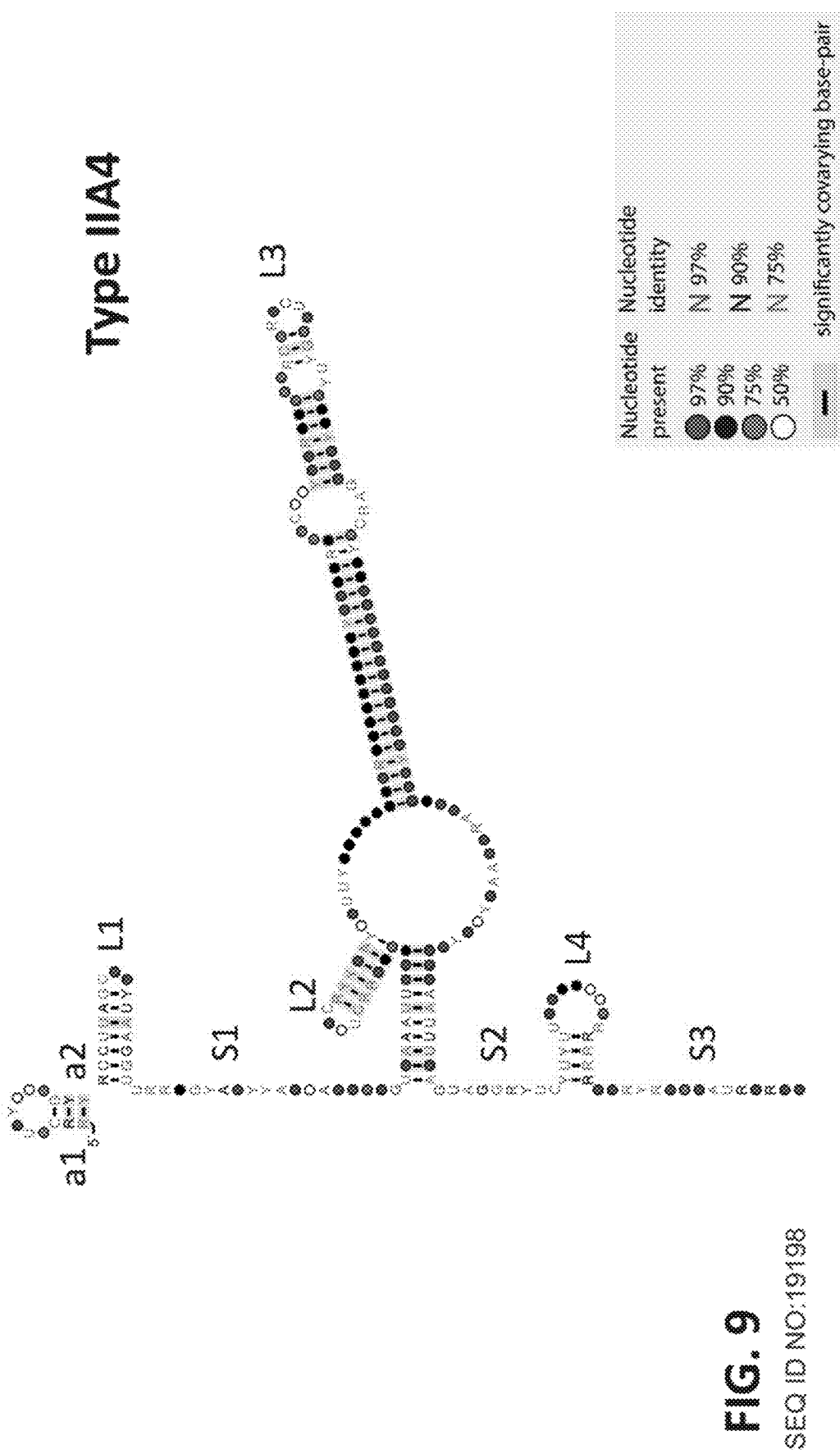

FIG. 9 (SEQ ID NO: 19198) is a schematic representation of a consensus secondary structure of a retron ncRNA msr/msd of Type IIA4 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 10:
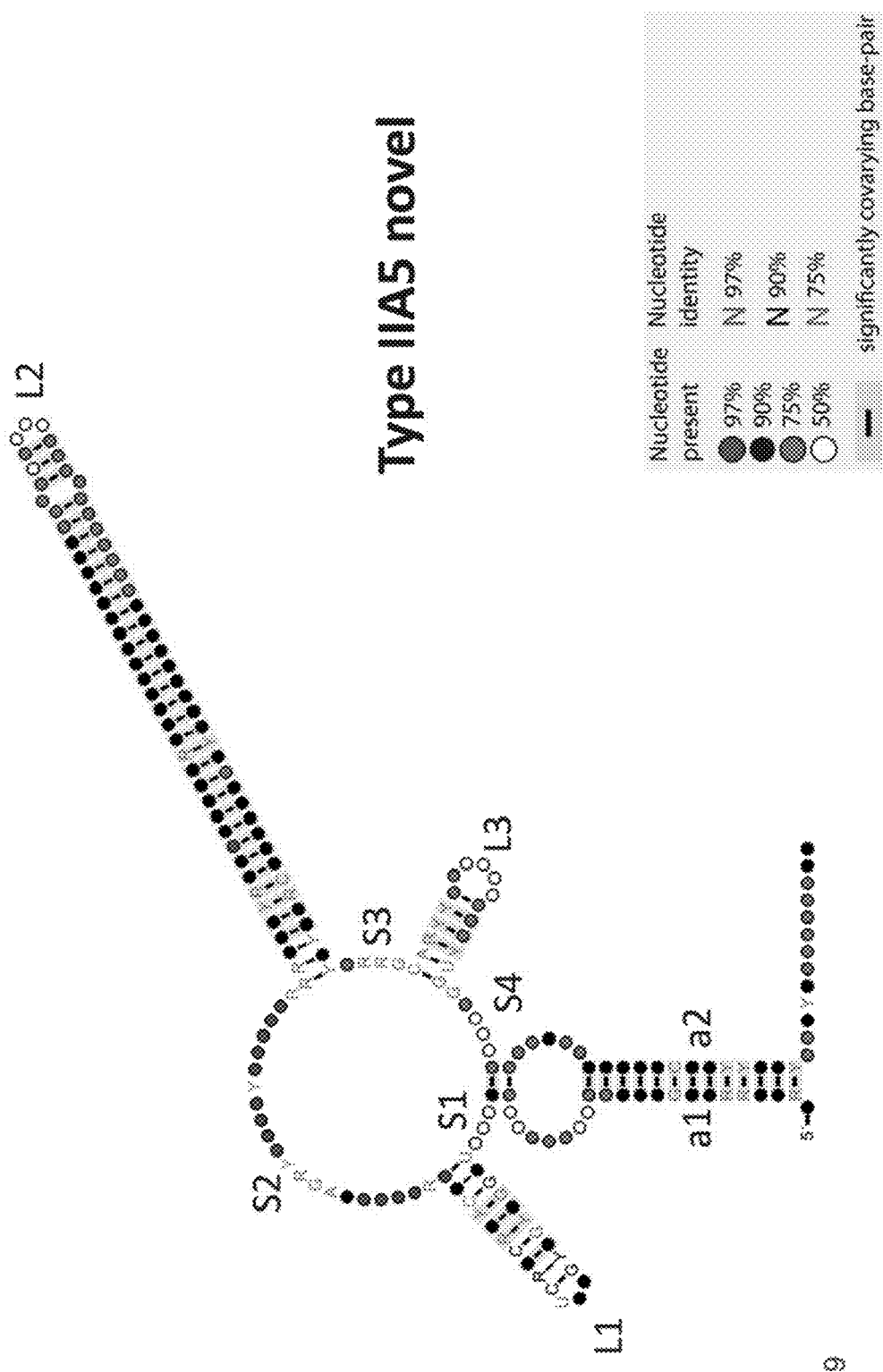

FIG. 10 (SEQ ID NO: 19199) is a schematic representation of a consensus secondary structure of a retron ncRNA msr/msd of Type IIA5 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 11:
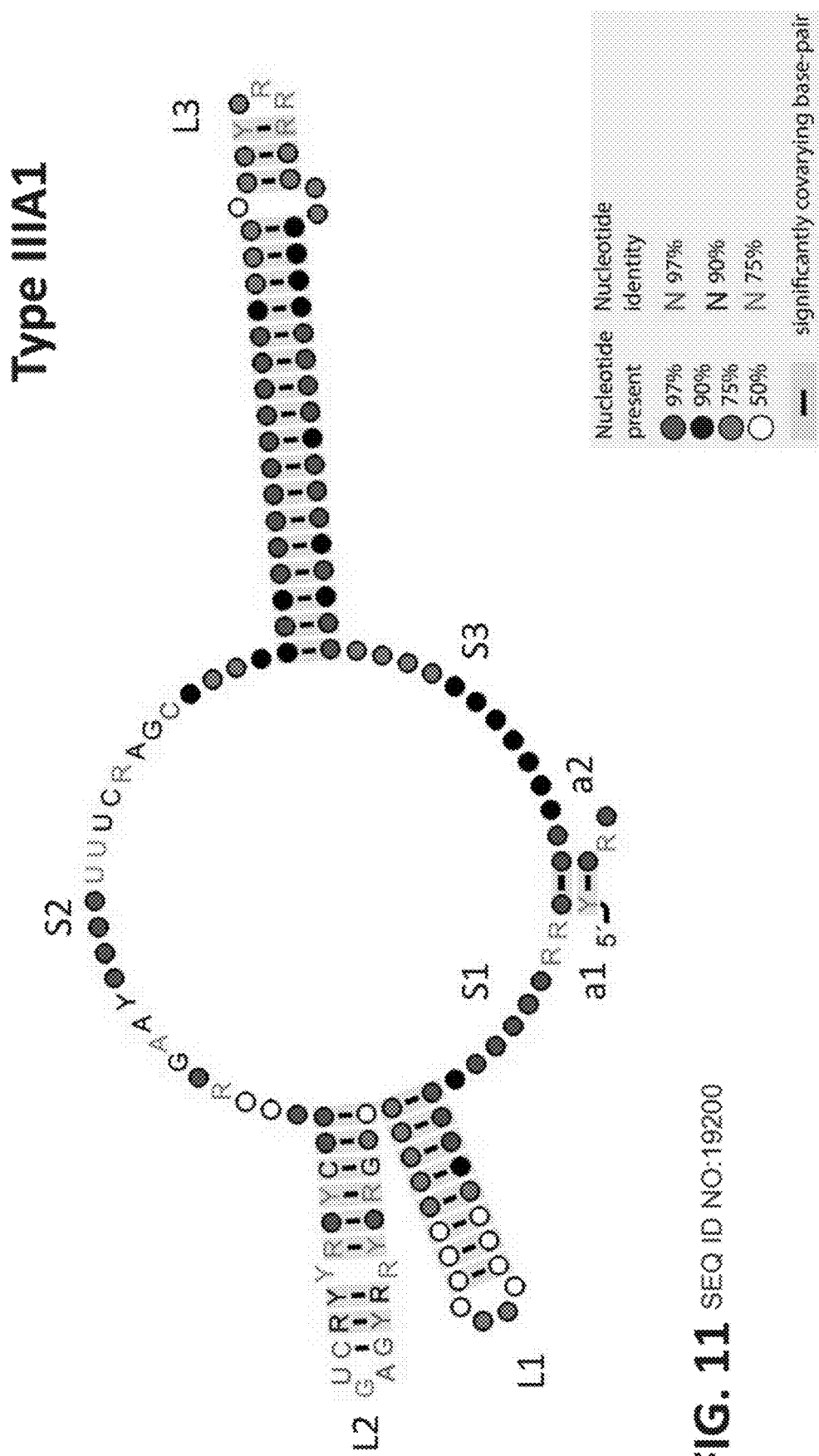

FIG. 11 (SEQ ID NO: 19200) is a schematic representation of a consensus secondary structure of a retron ncRNA msr/msd of Type IIIA1 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 12:
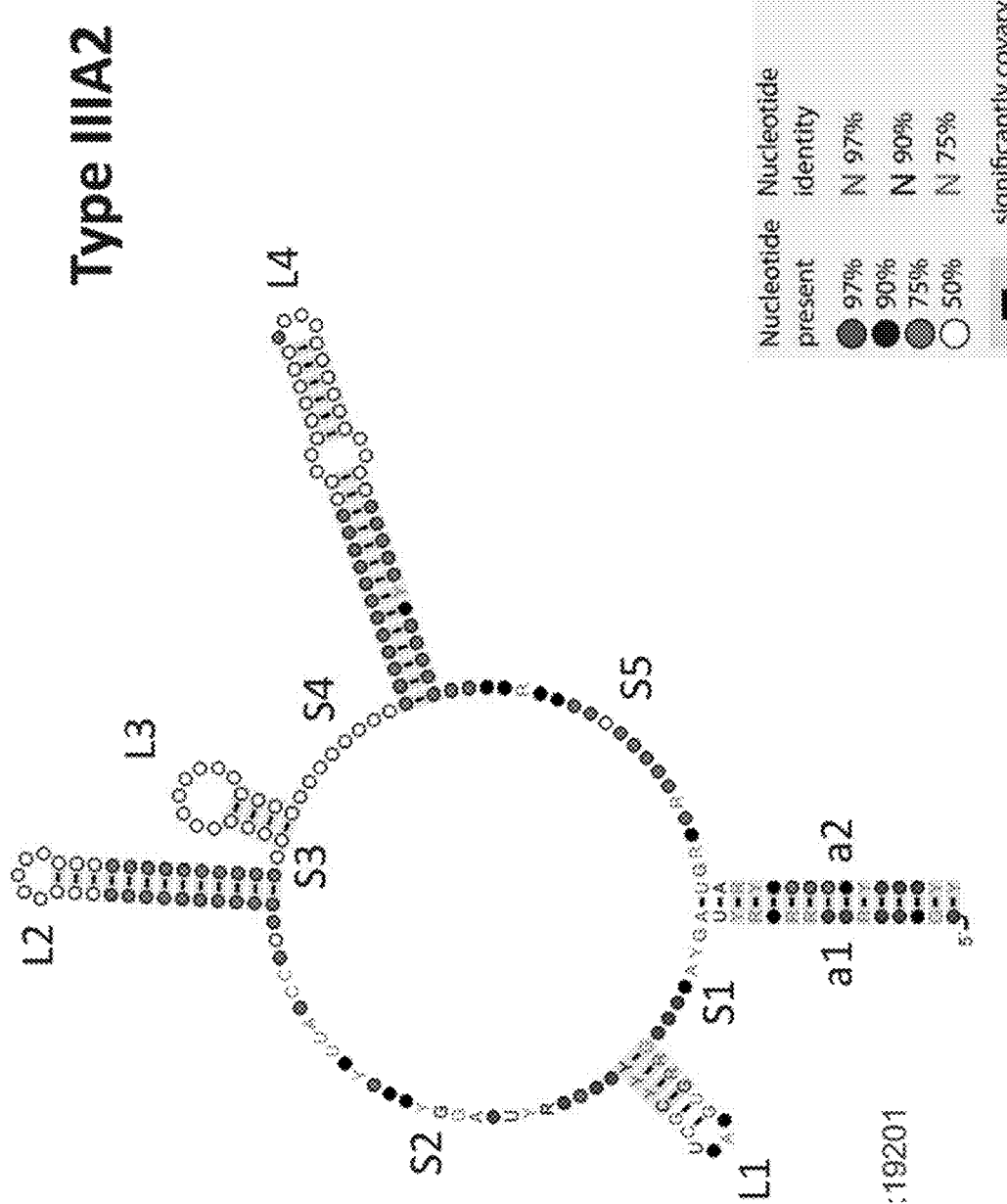

FIG. 12 (SEQ ID NO: 19201) is a schematic representation of a consensus secondary structure of a retron ncRNA msr/msd of Type IIIA2 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 13:
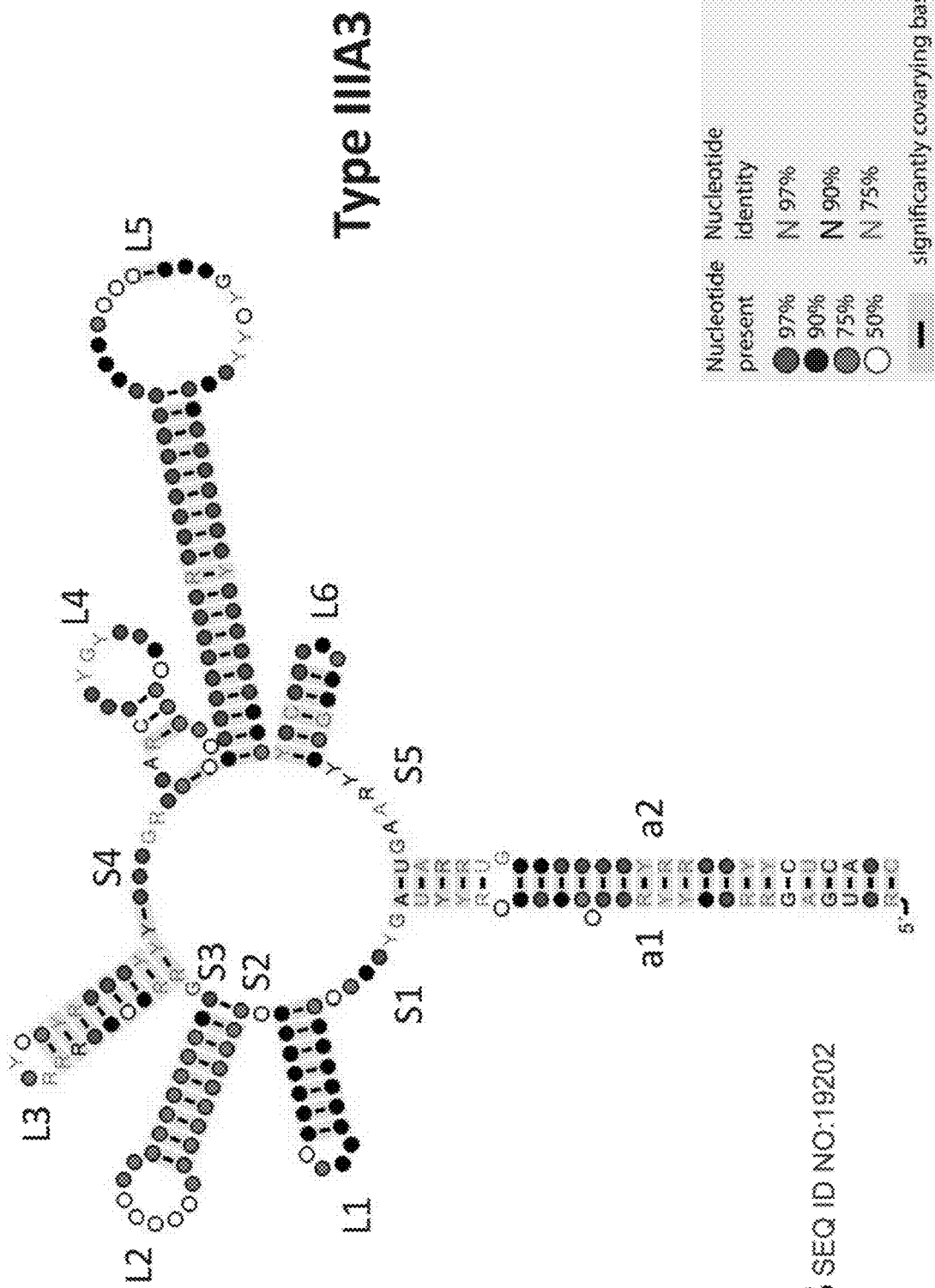

FIG. 13 (SEQ ID NO: 19202) is a schematic representation of a consensus secondary structure of a retron ncRNA msr/msd of IIIA3 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 14:
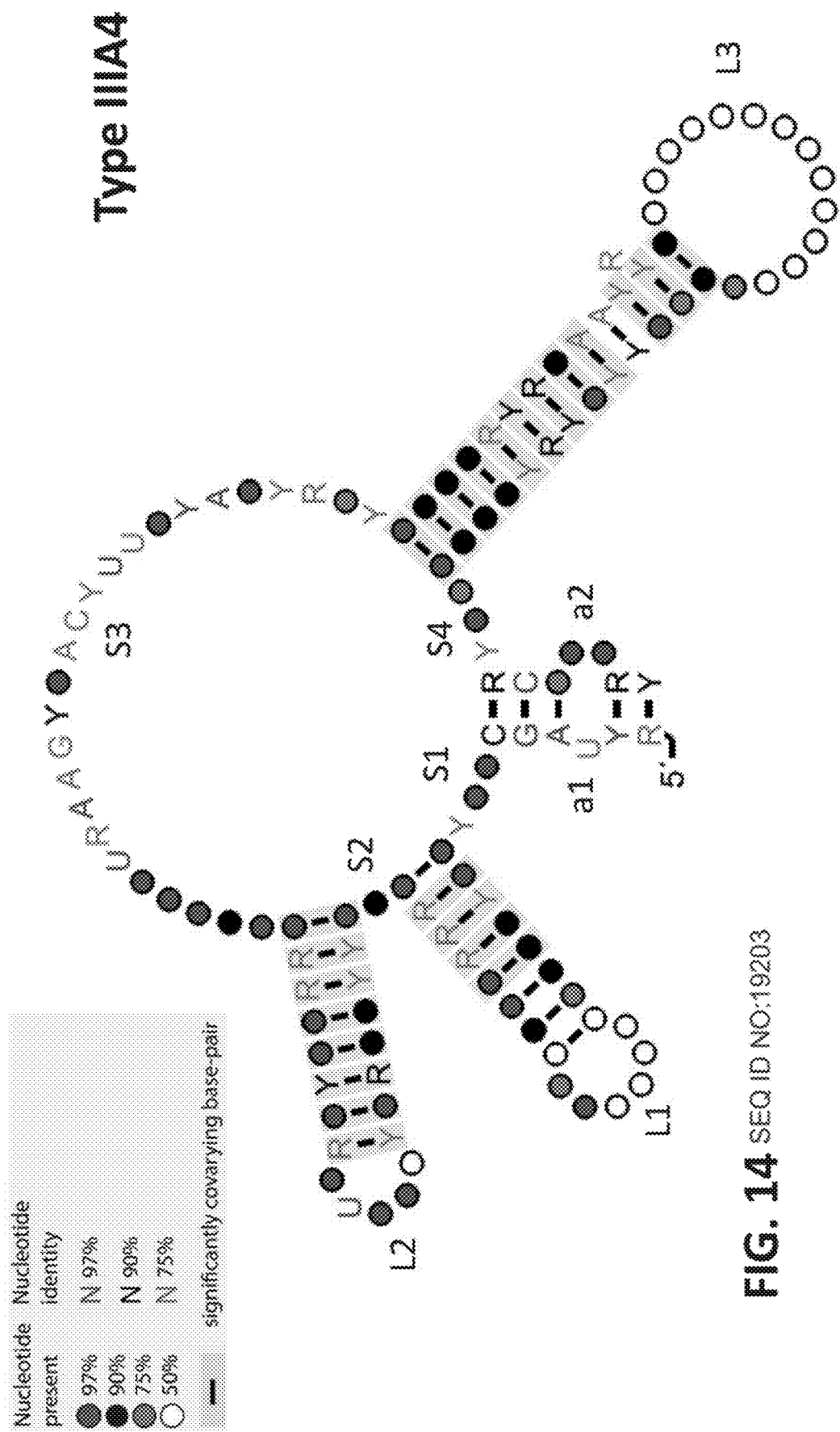

FIG. 14 (SEQ ID NO: 19203) is a schematic representation of a consensus secondary structure of a retron ncRNA msr/msd of Type IIIA4 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 15:
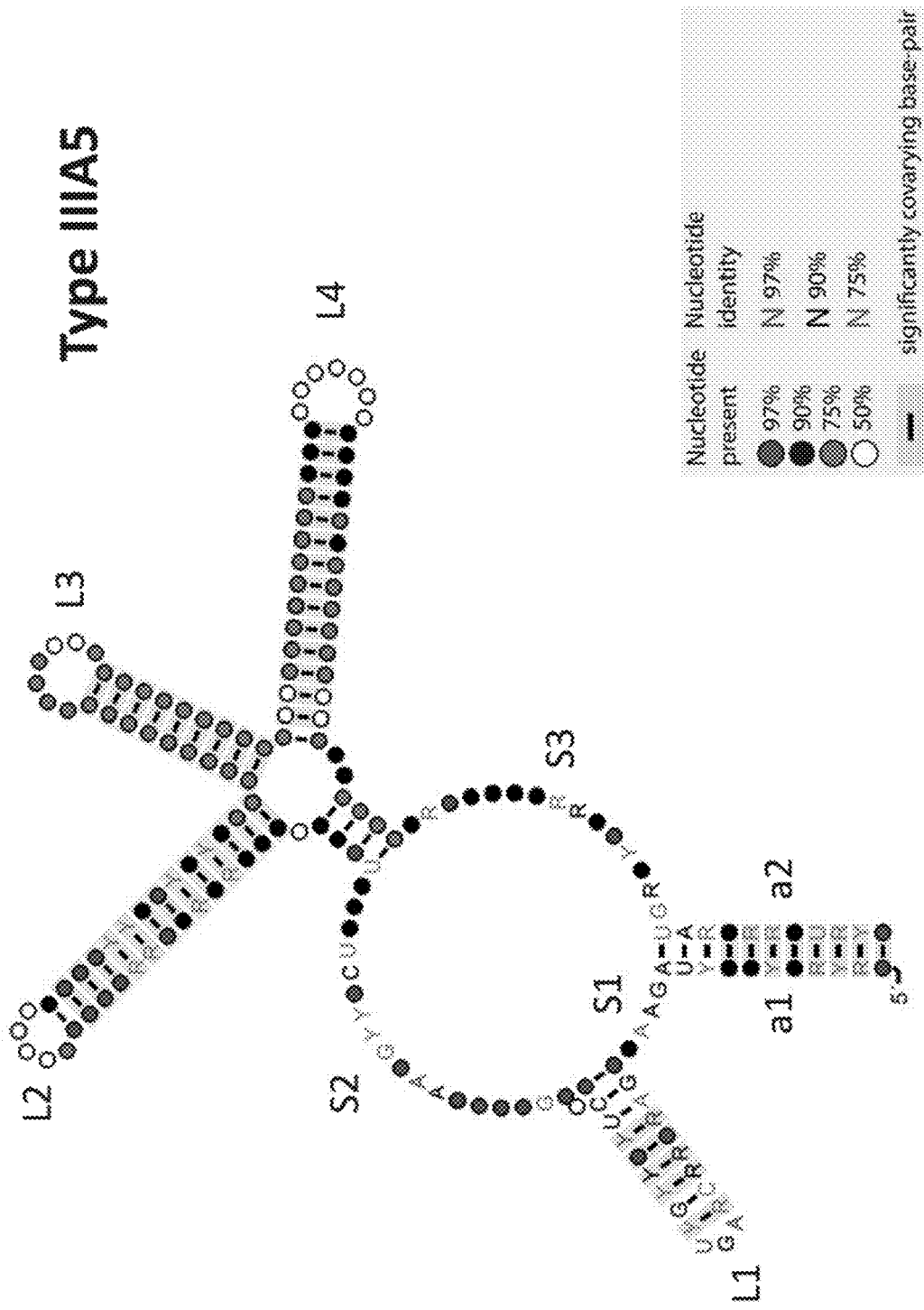

FIG. 15 (SEQ ID NO: 19204) is a schematic representation of a consensus secondary structure of a retron ncRNA msr/msd of Type IIIA5 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 16:
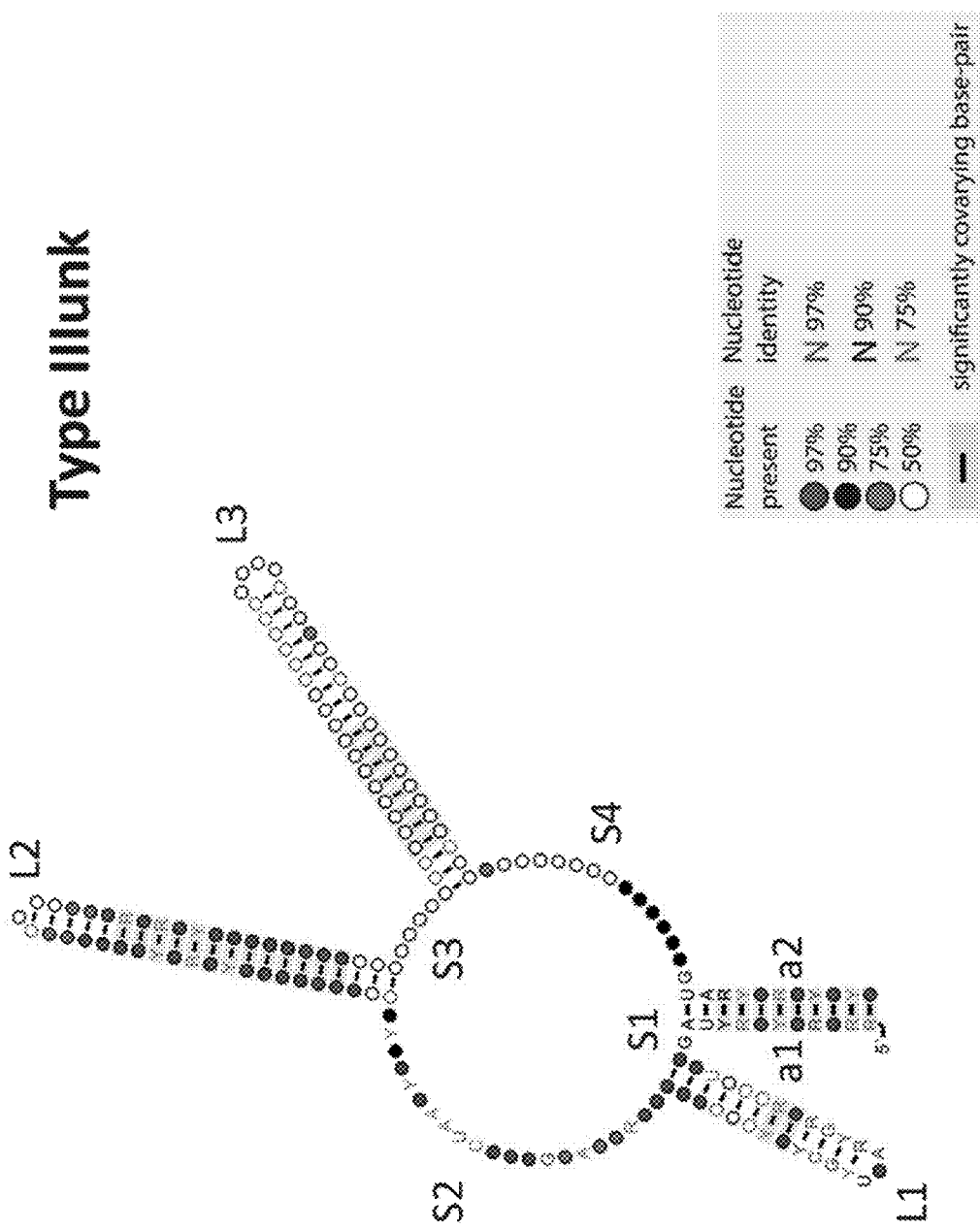

FIG. 16 (SEQ ID NO: 19205) is a schematic representation of a consensus secondary structure of a retron ncRNA msr/msd of Type IIIunk retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 17:
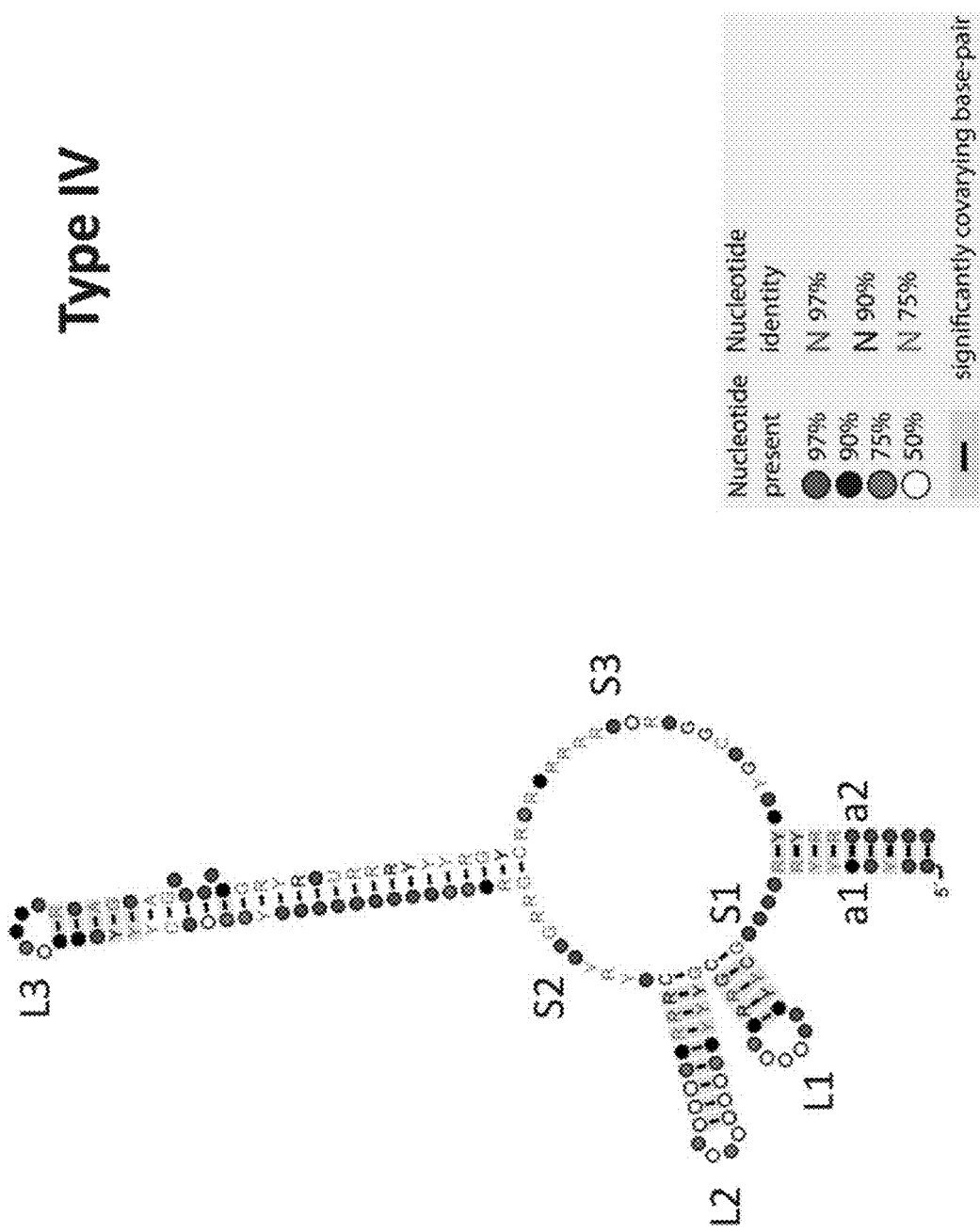

FIG. 17 (SEQ ID NO: 19206) is a schematic representation of a consensus secondary structure of a retron ncRNA msr/msd of Type IV retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 18:
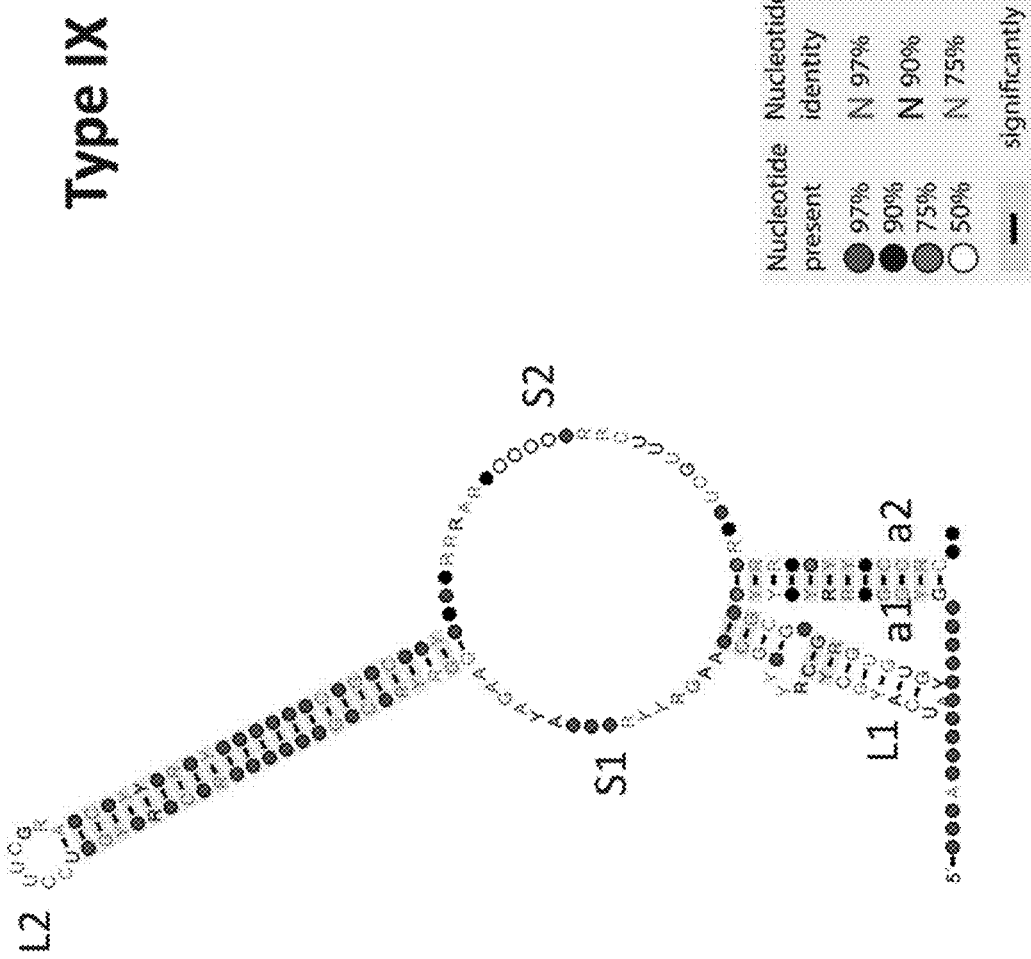

FIG. 18 (SEQ ID NO: 19207) is a schematic representation of a consensus secondary structure of a retron ncRNA msr/msd of Type IX retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 19:
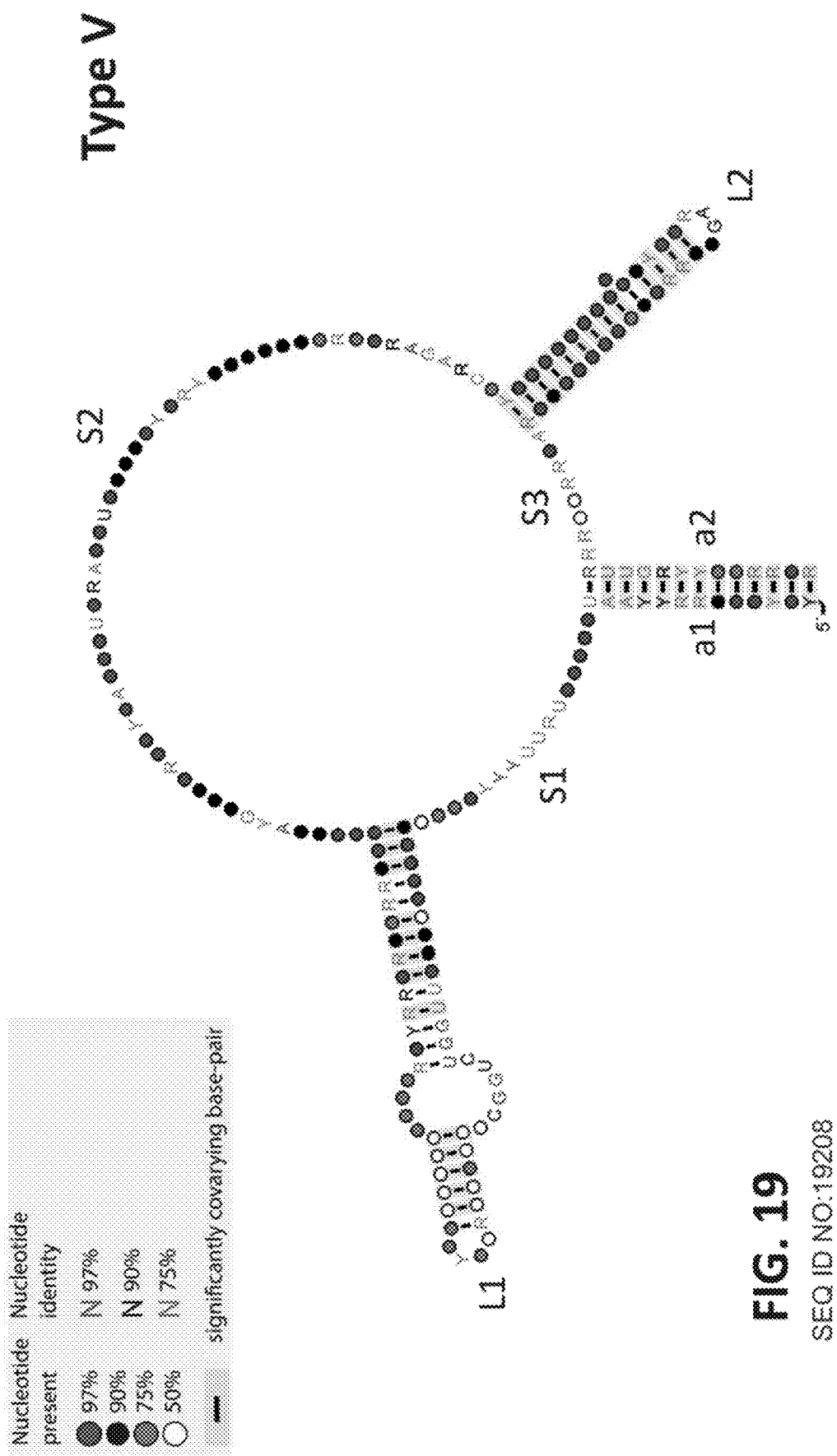

FIG. 19 (SEQ ID NO: 19208) is a schematic representation of a consensus secondary structure of a retron ncRNA msr/msd of Type V retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 20:
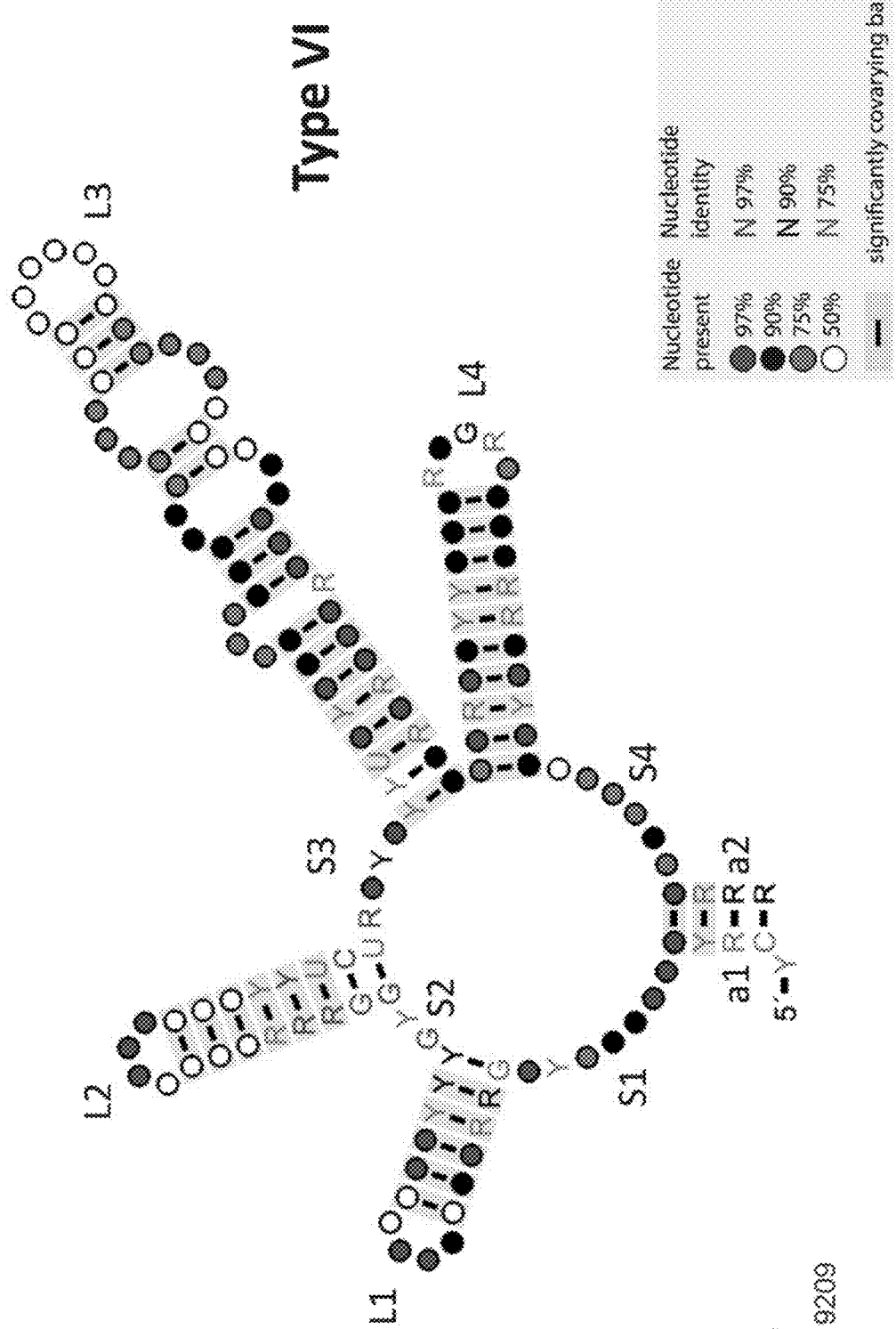

FIG. 20 (SEQ ID NO: 19209) is a schematic representation of a consensus secondary structure of a retron ncRNA msr/msd of Type VI retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 21:
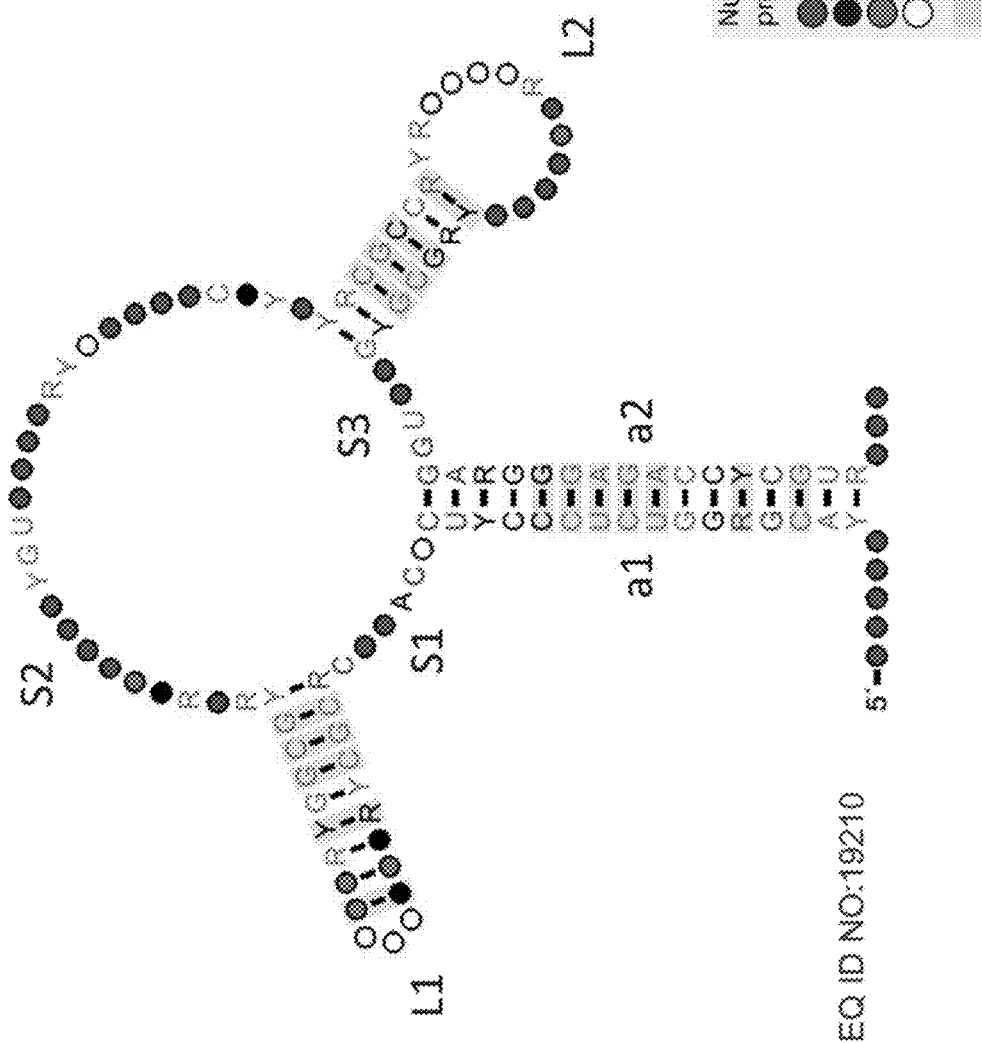

FIG. 21 (SEQ ID NO: 19210) is a schematic representation of a consensus secondary structure of a retron ncRNA msr/msd of Type XI Group 1 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 22:
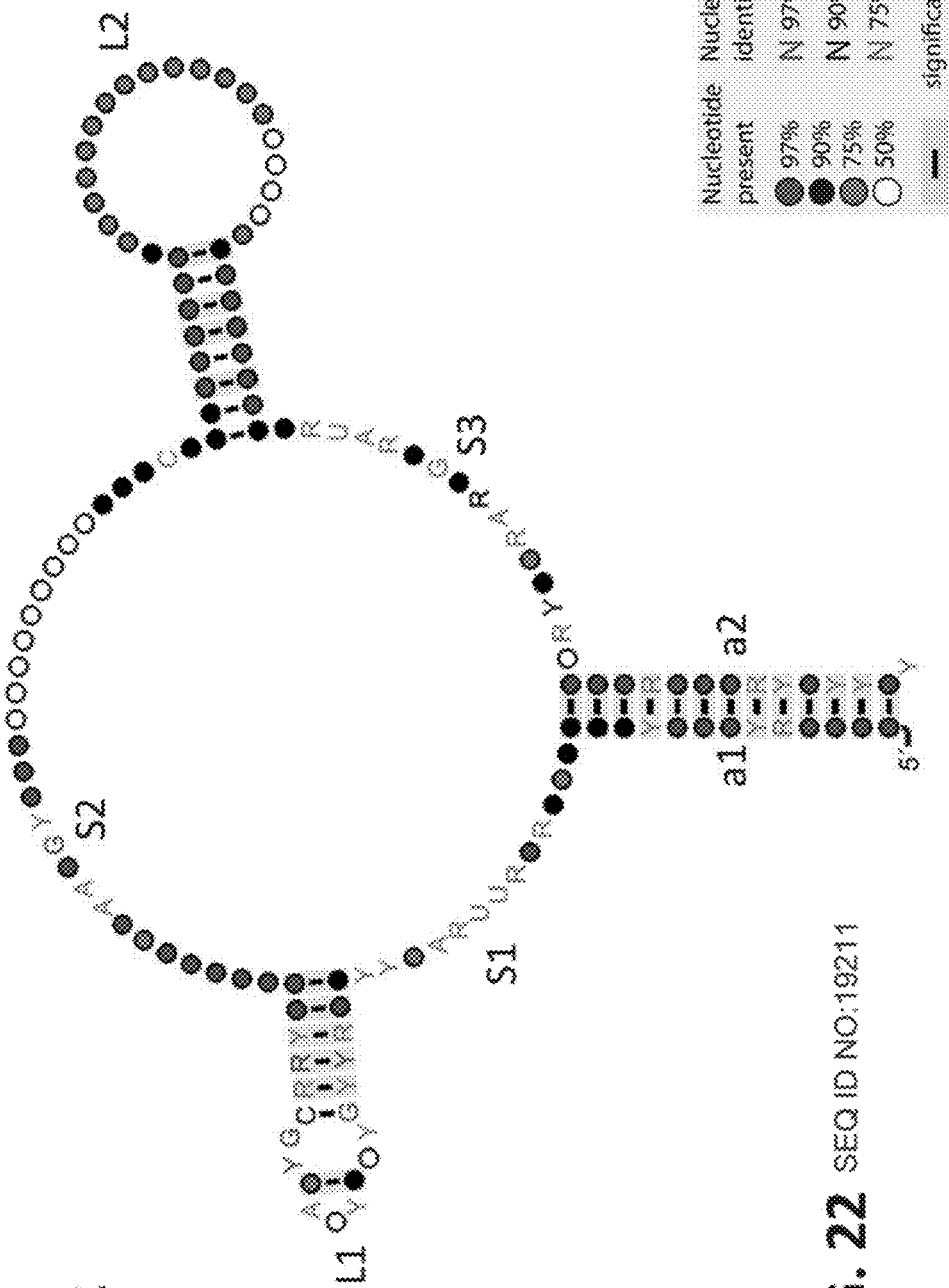

FIG. 22 (SEQ ID NO: 19211) is a schematic representation of a consensus secondary structure of a retron ncRNA msr/msd of Type XI Group 2 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 23:
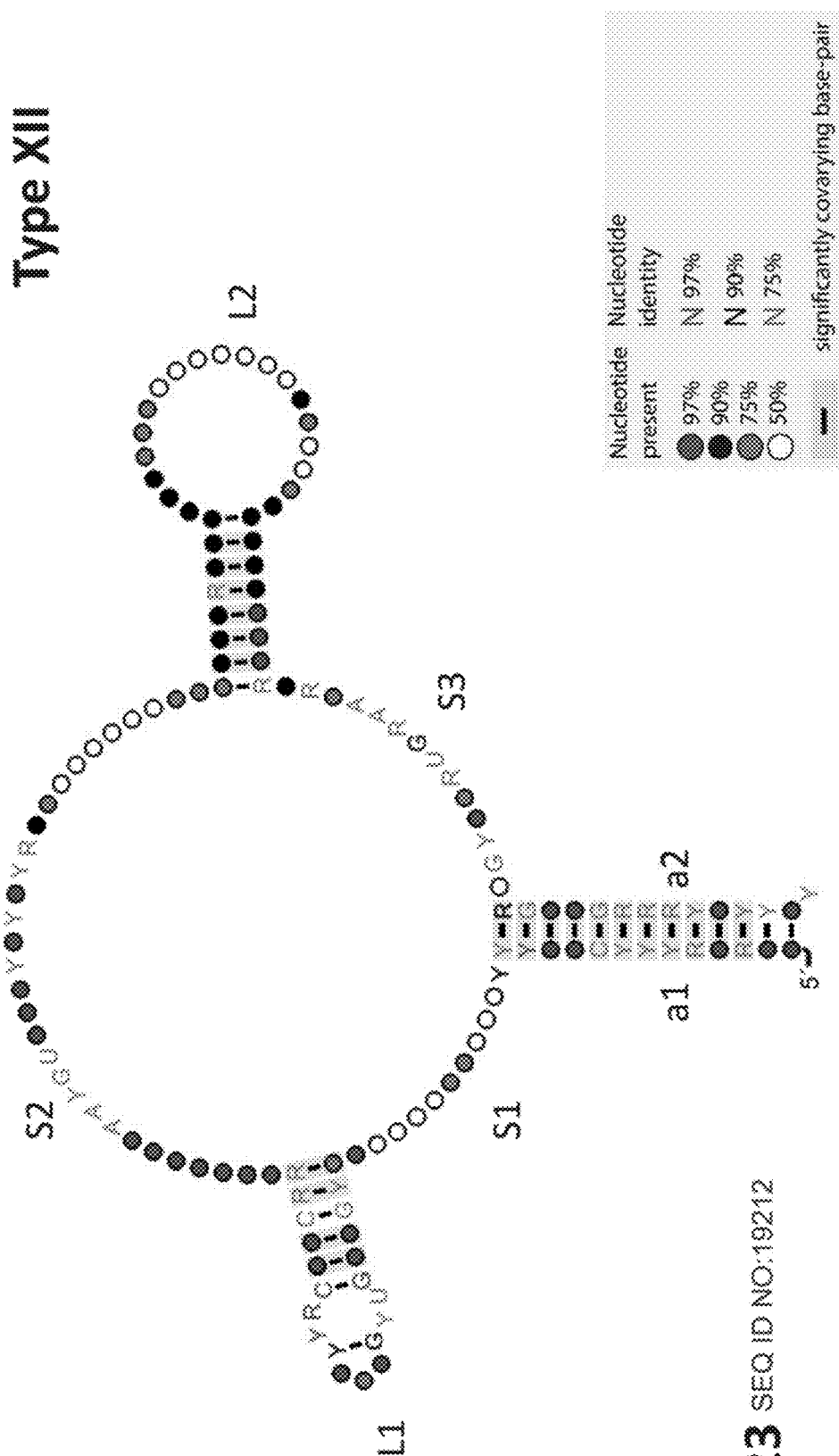

FIG. 23 (SEQ ID NO: 19212) is a schematic representation of a consensus secondary structure of a retron ncRNA msr/msd of Type XII retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 24:
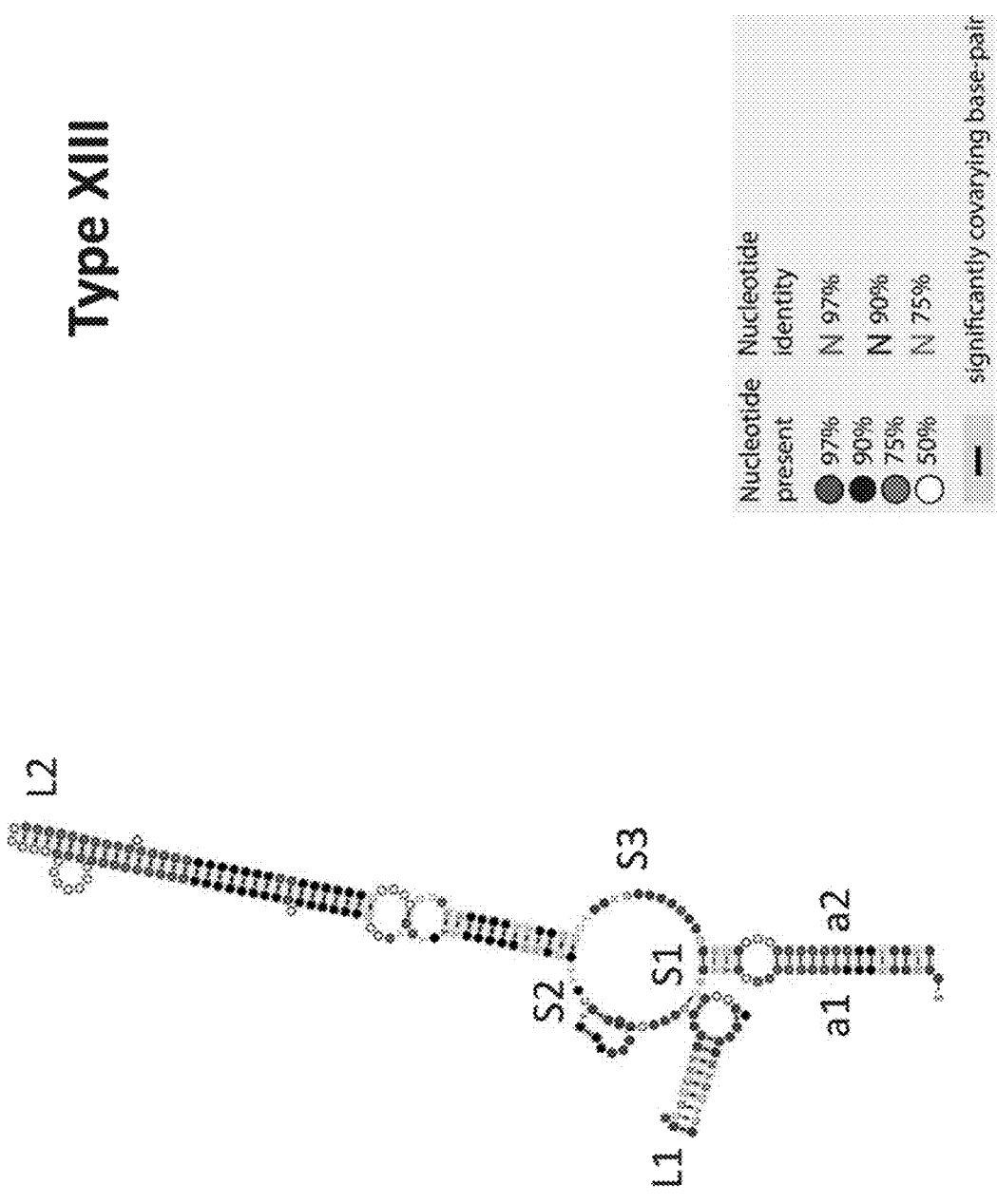

FIG. 24 (SEQ ID NO: 19213) is a schematic representation of a consensus secondary structure of a retron ncRNA msr/msd of Type XIII retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 25:
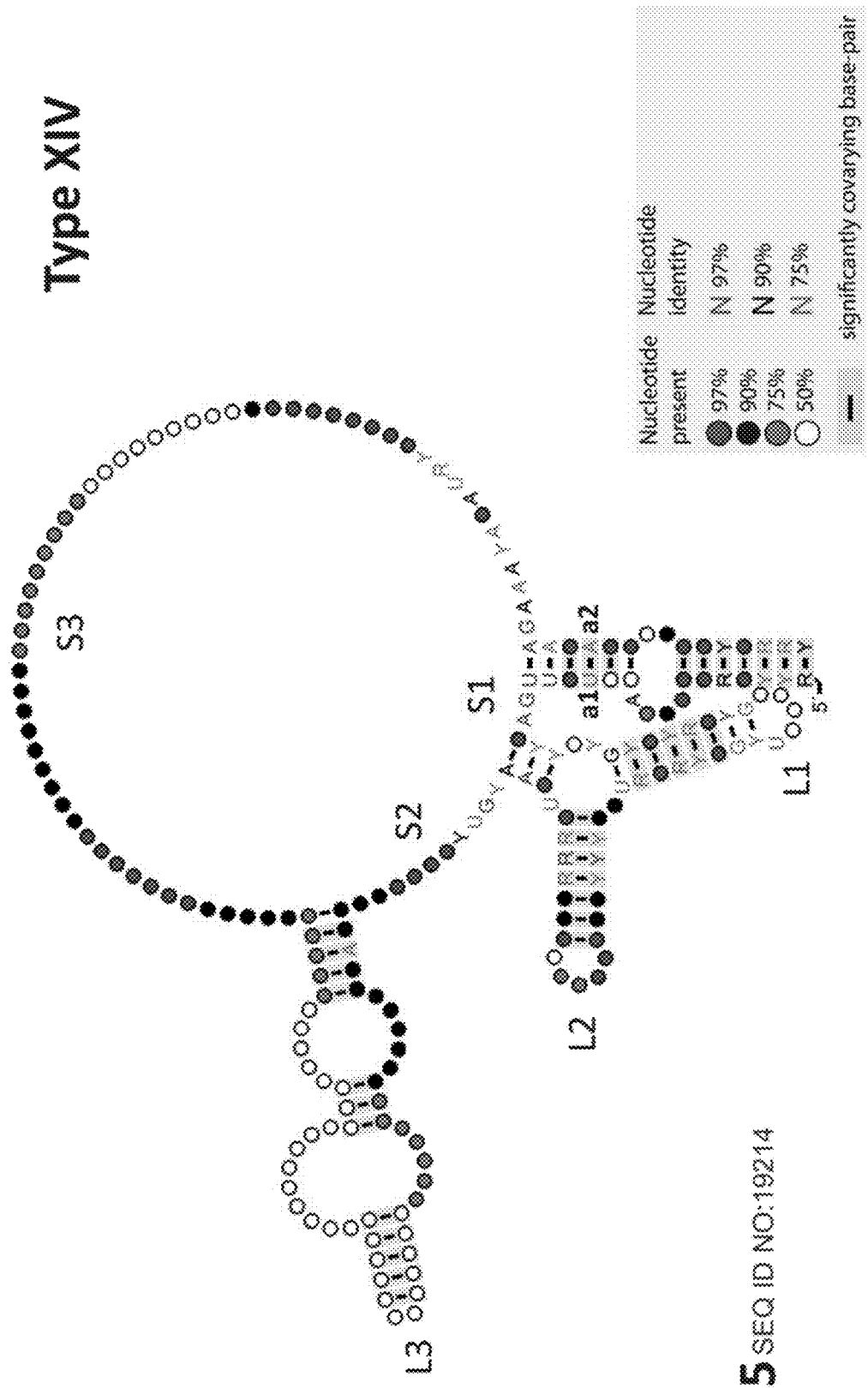

FIG. 25 (SEQ ID NO: 19214) is a schematic representation of a consensus secondary structure of a retron ncRNA msr/msd of Type XIV retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-7 5% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 26:
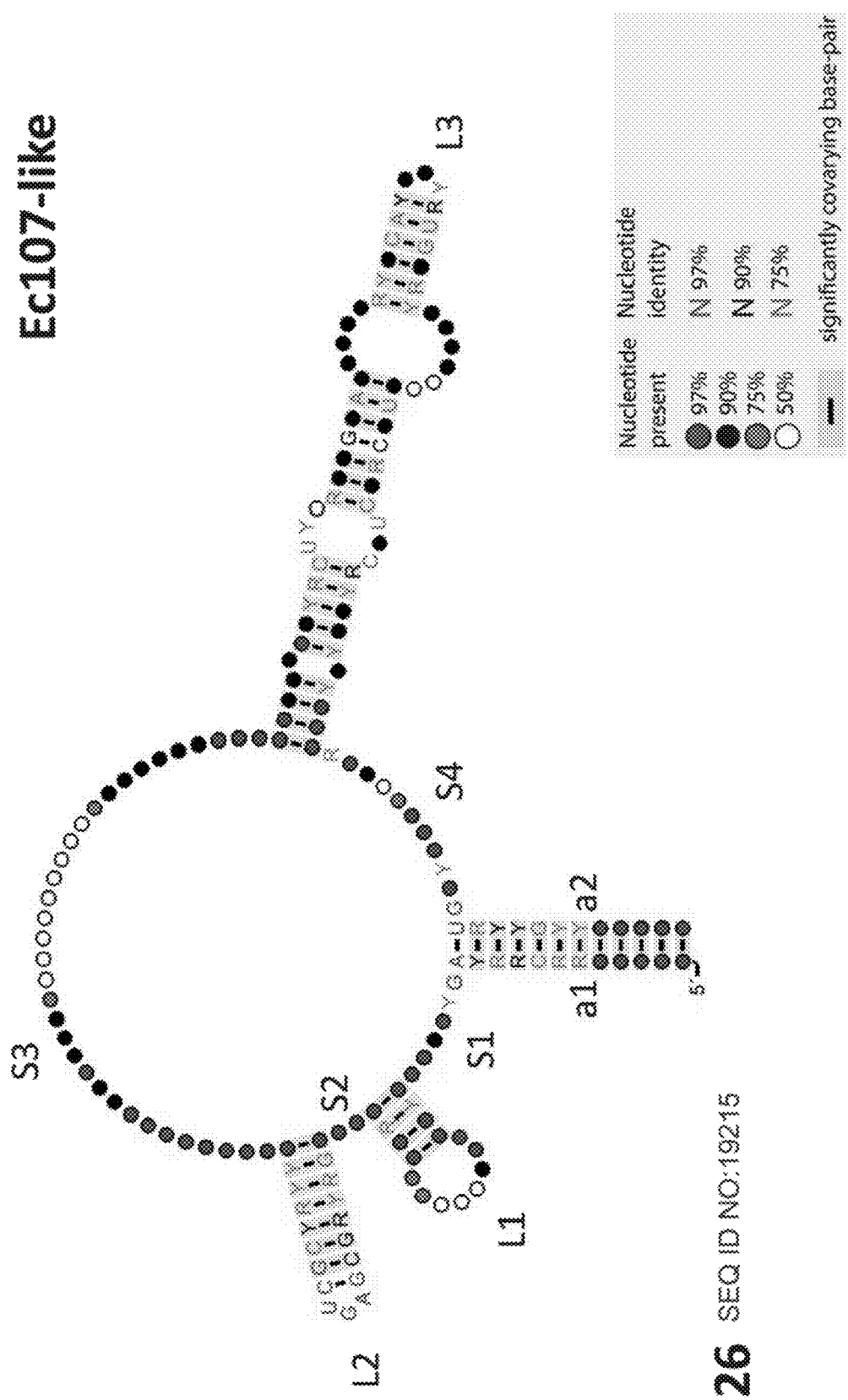

FIG. 26 (SEQ ID NO: 19215) is a schematic representation of a consensus secondary structure of a retron ncRNA msr/msd of Ec107 retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 7 5-9 0% of the cases, and white represents the presence of a base in 50-7 5% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 27:
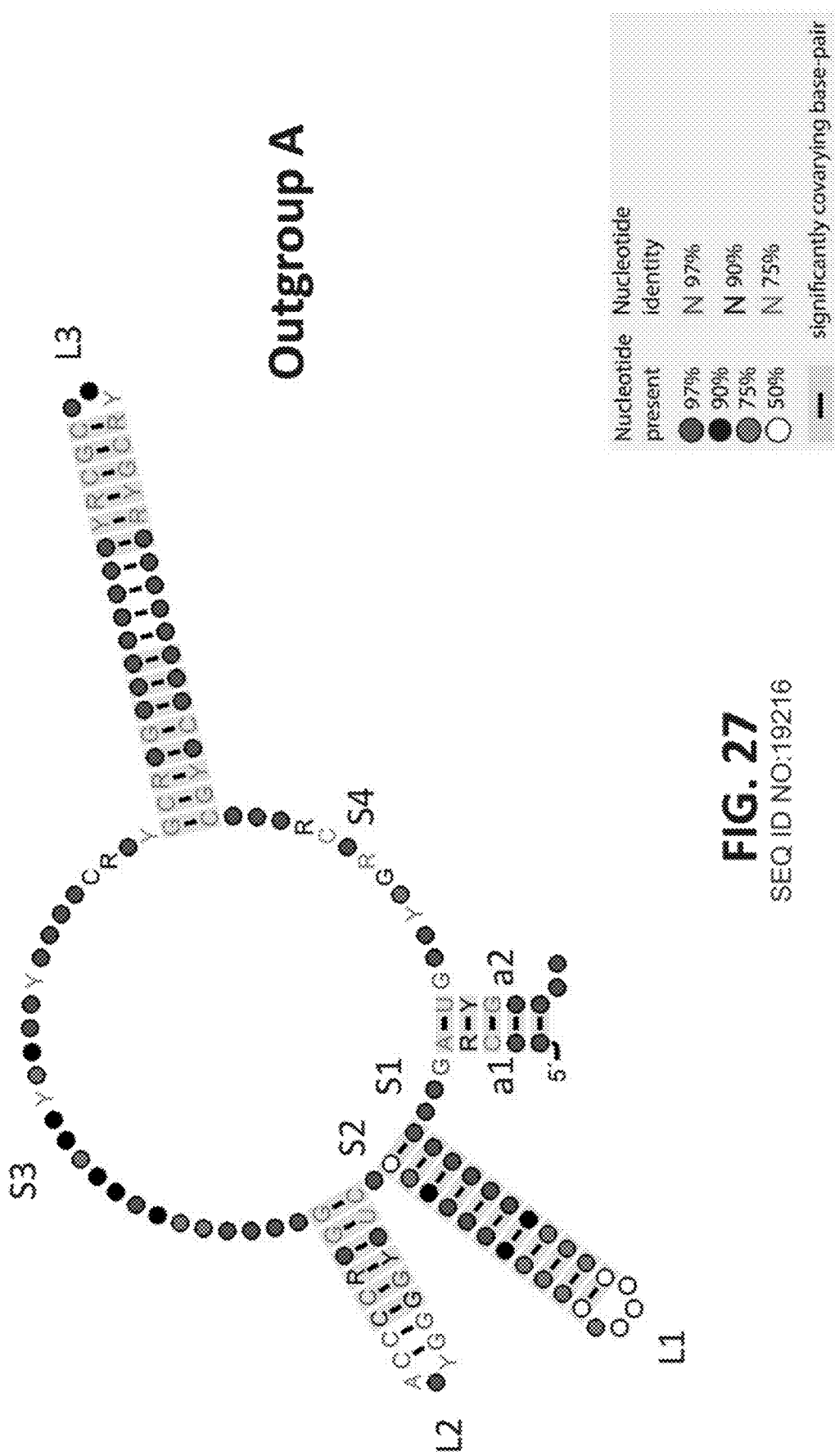

FIG. 27 (SEQ ID NO: 19216) is a schematic representation of a consensus secondary structure of a retron ncRNA msr/msd of Outgroup A retrons produced by computational structural alignment of ncRNA sequences from Table B as described in Example 3.

The colored dots represents the probability a base is at that location (e.g., red circle represents the presence of a base in 97% of the cases, black represents the presence of a base in 90-97% of the cases, grey represents the presence of a base in 75-90% of the cases, and white represents the presence of a base in 50-75% of the cases), as opposed to a gap (no base), whereas the colored letters represent bases that are conserved to different degrees (e.g., with red representing 97%+ conserved, black being 90%+ conserved, and grey at least 75% conserved). Each highlighted base-pair represents a significantly covarying basepair.

Figure 28:
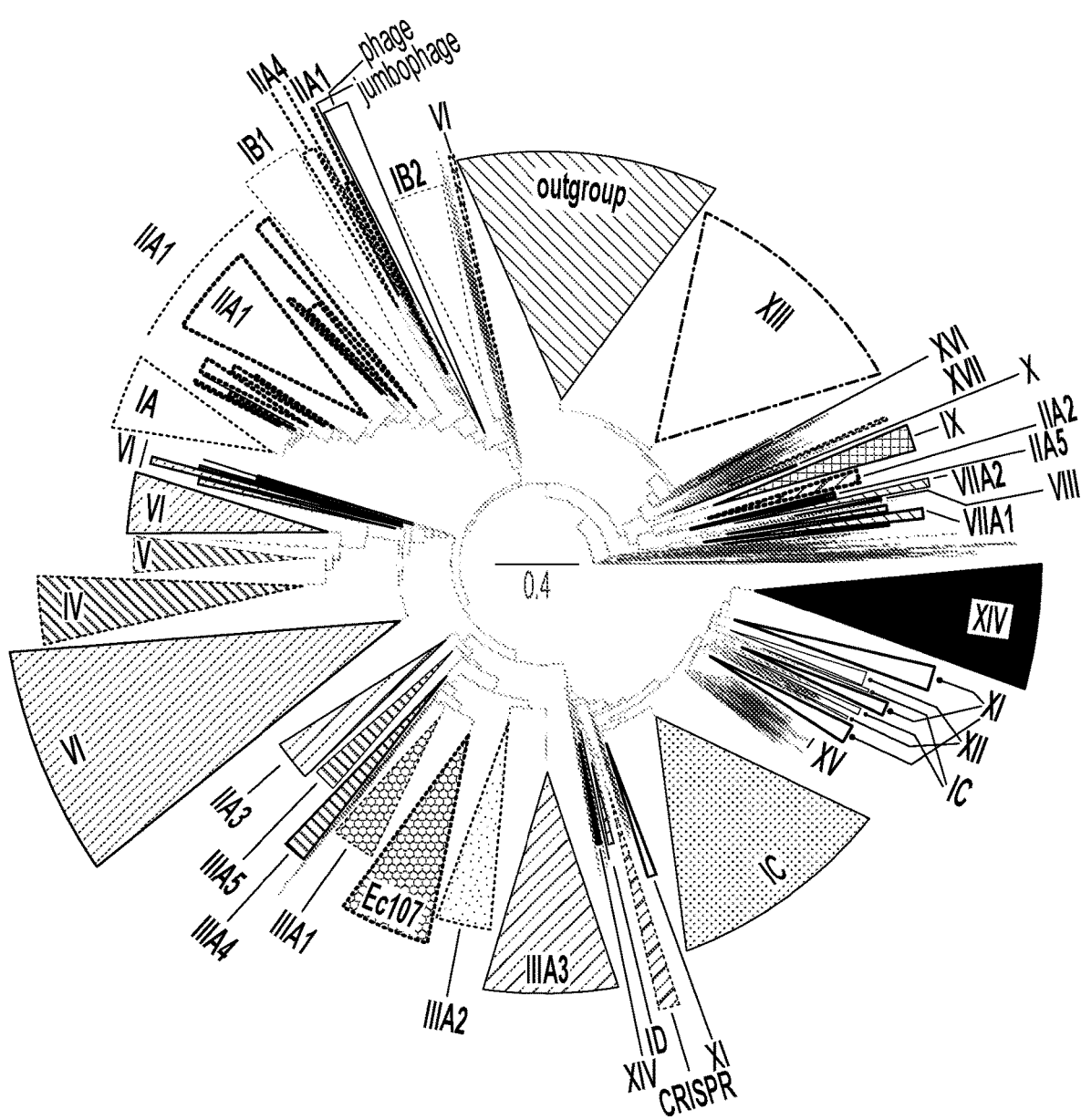

FIG. 28 is a phylogenetic tree of RT sequences constructed in accordance with Example 3.

Figure 29:
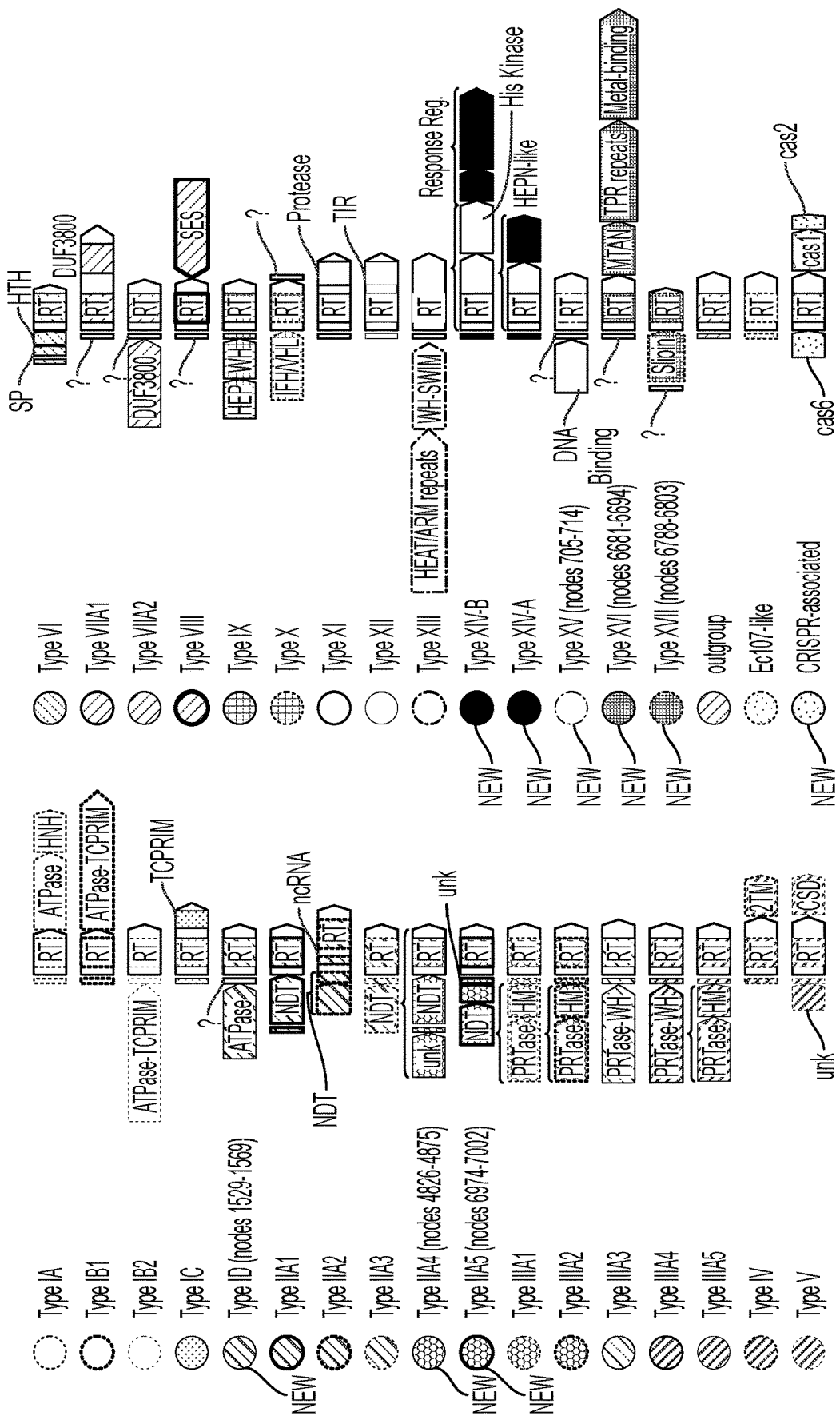

FIG. 29 is a structural representation of the retron loci associated with each retron type in FIG. 28.

FIG. 30 shows the position of certain retrons (EcoI, Eco3, Eco5, AcoI, RTX003_2042, RTX003_6083v1, and RTX003_6943) within the phylogenetic retron tree of FIG. 28.

Figure 31A:
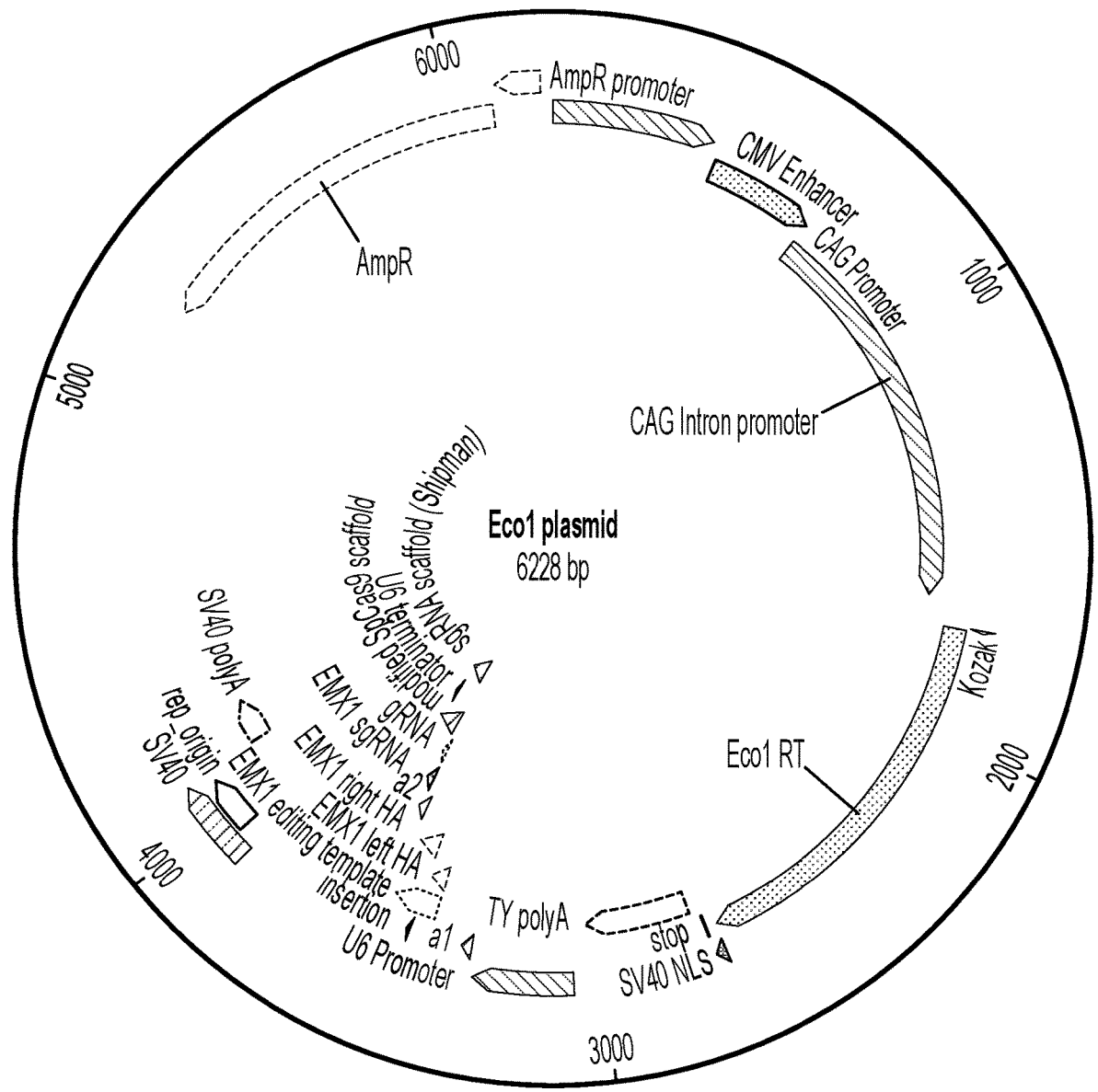

FIG. 31A is a plasmid map of an exemplary retron (EcoI) tested in the Examples herein.

Figure 31B:
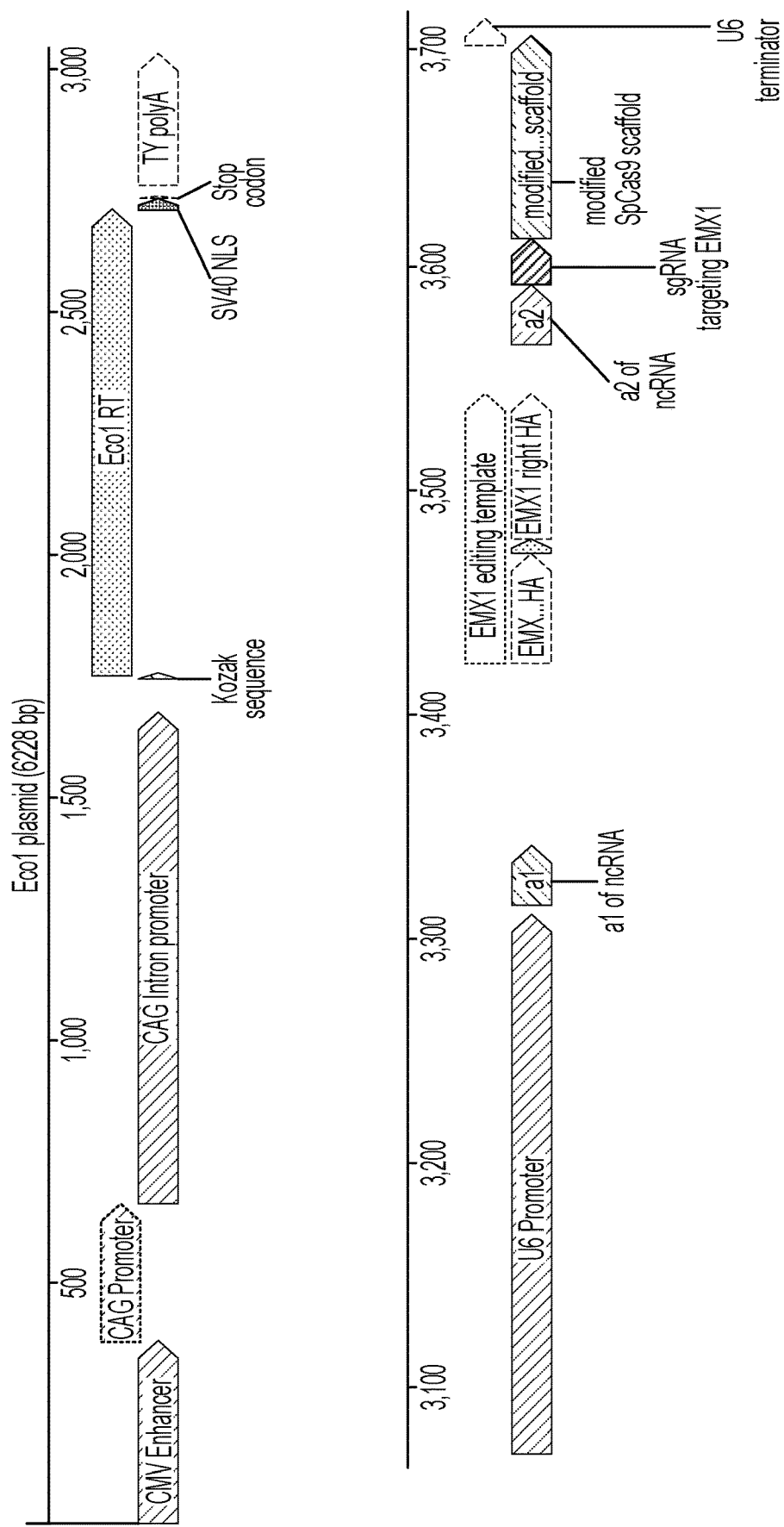

FIG. 31B is a linear representation in 5' to 3' direction of the plasmid map of FIG. 31A.

Figure 31C:
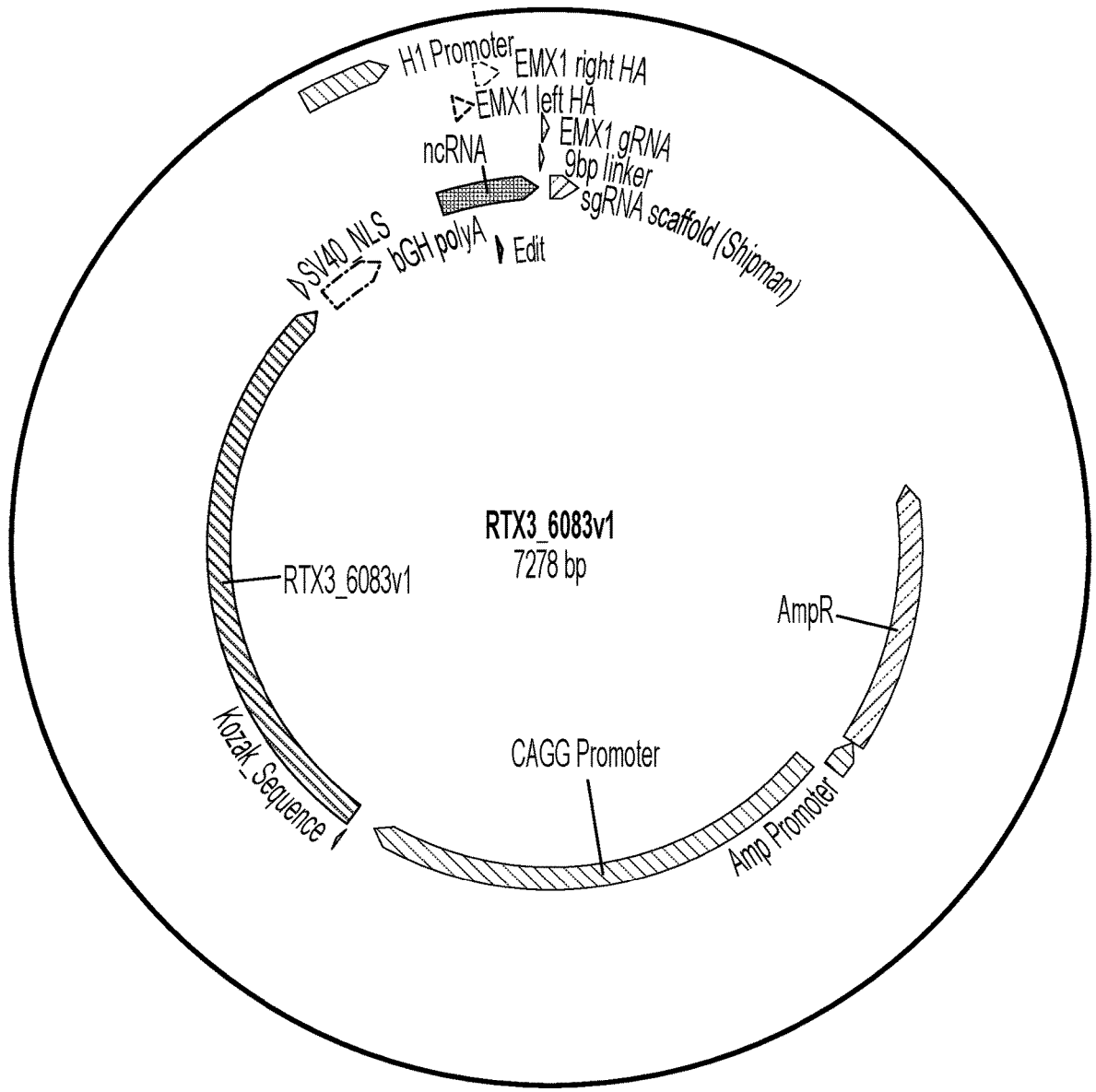

FIG. 31C is a plasmid map of an exemplary retron (RTX3_6083v1) tested in the Examples herein.

Figure 31D:
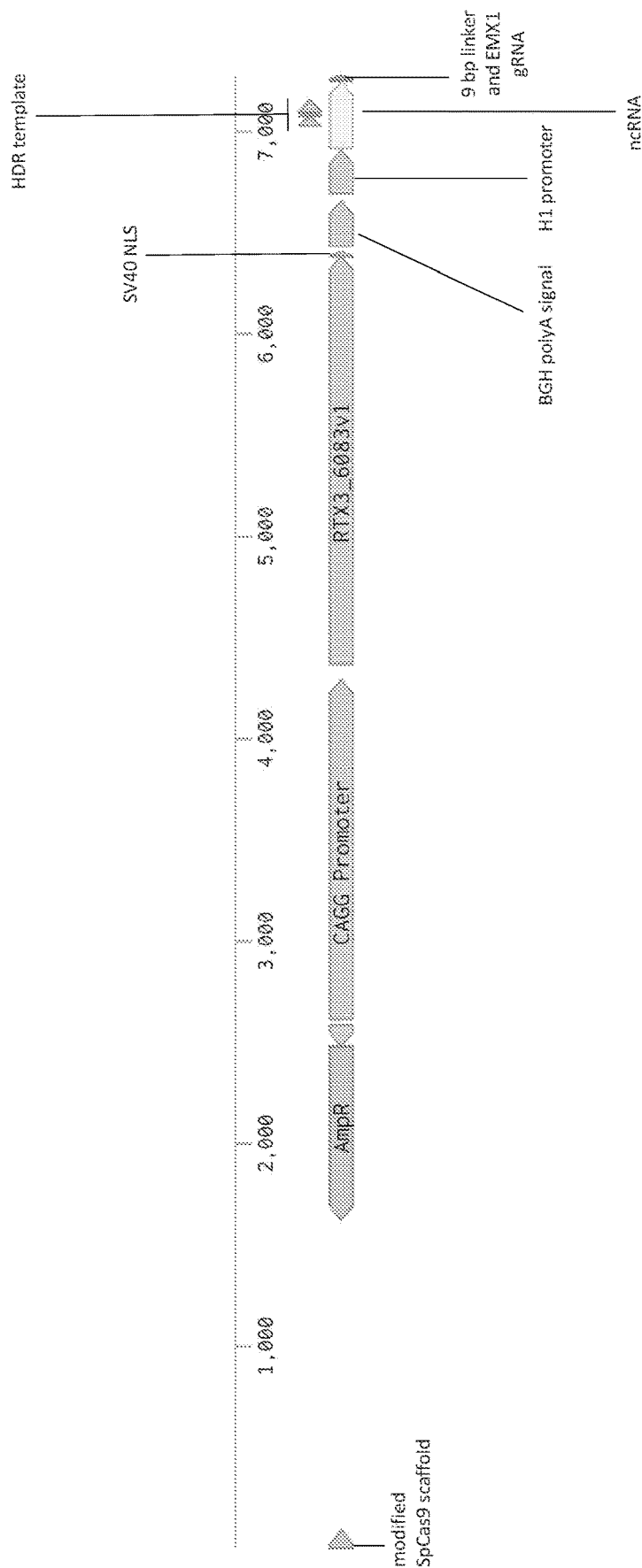

FIG. 31D is a linear representation in 5' to 3' direction of the plasmid map of FIG. 31C.

Figure 32:
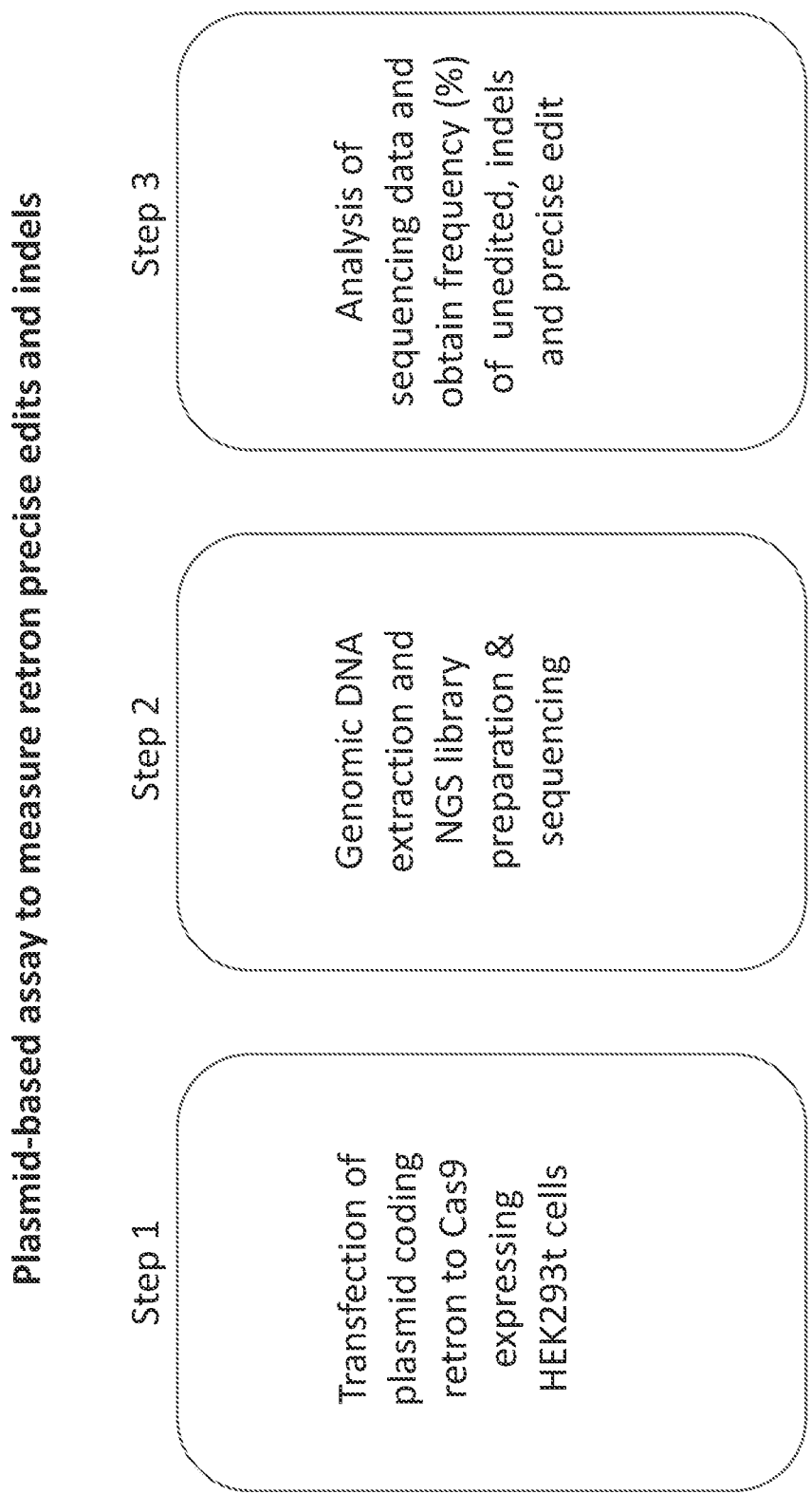

FIG. 32 is a representation of a plasmid-based assay used to measure retron precise edits and indels as performed in the Examples. In Step 1, a plasmid (e.g., that of FIG. 31A or FIG. 31C) is transfected into human cells (e.g., HEK293t cells) which are engineered to express Cas9. Editing is allowed to occur for 72 hours at 37° C. In Step 2, the genomic DNA is extracted from the cells and used to prepare a next-generation sequencing (NGS) library for sequencing. The library is sequenced over the target site (e.g., EMX1) of editing to generate sequence reads. In Step 3, the sequencing reads are analyzed to obtain a frequency of sequence reads containing the desired edit (percentage of precision editing) and a frequence of indels at the desired edit site (percentage of indels).

Figure 33:
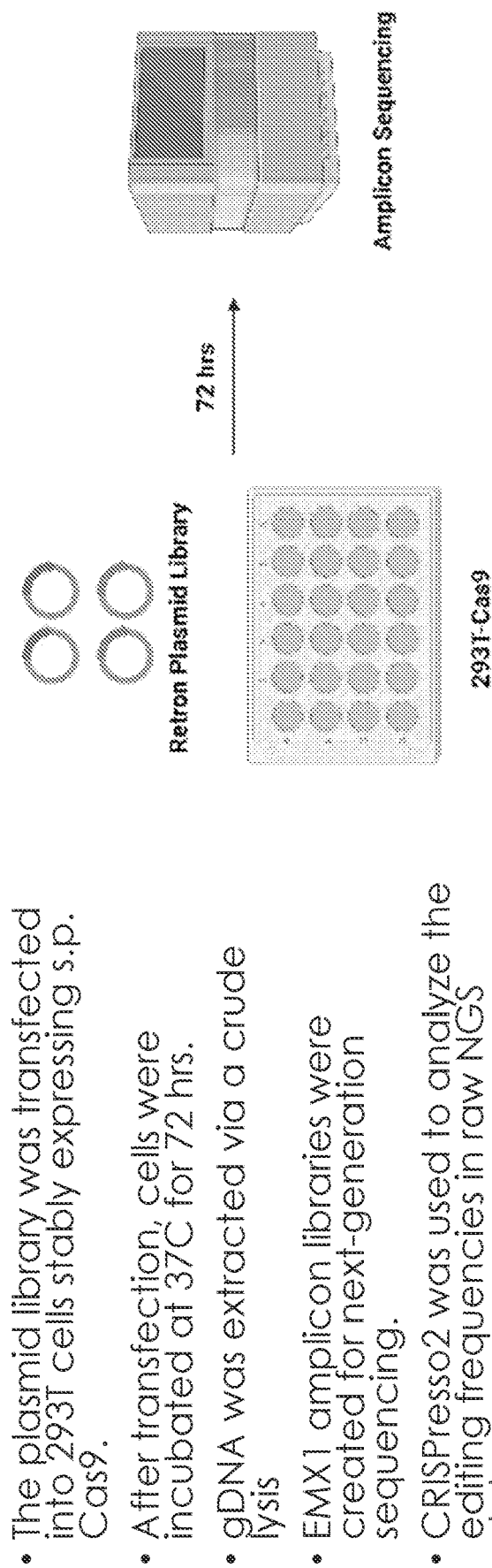

FIG. 33 is an equivalent representation of FIG. 32.

Figure 34:
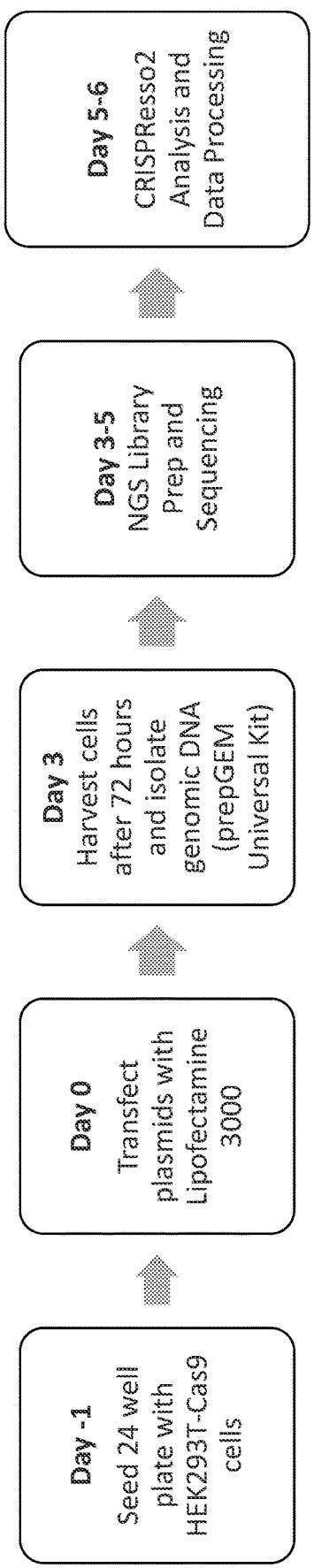

FIG. 34 is a representation of a methodology for transfecting HEK293T cells. Cells were seeded in 24 well plate one day prior to transfection. Appropriate amount of plasmid and transfection reagent (e.g., Lipofectamine 3000) were mixed and transferred to cells. After 72 hours incubation, genomic DNA was extracted and the target edit region was amplified into sequencing libraries. Sequencing data was analyzed by CRISPResso2 and percentage of precise edit and indels were calculated.

Figure 35:
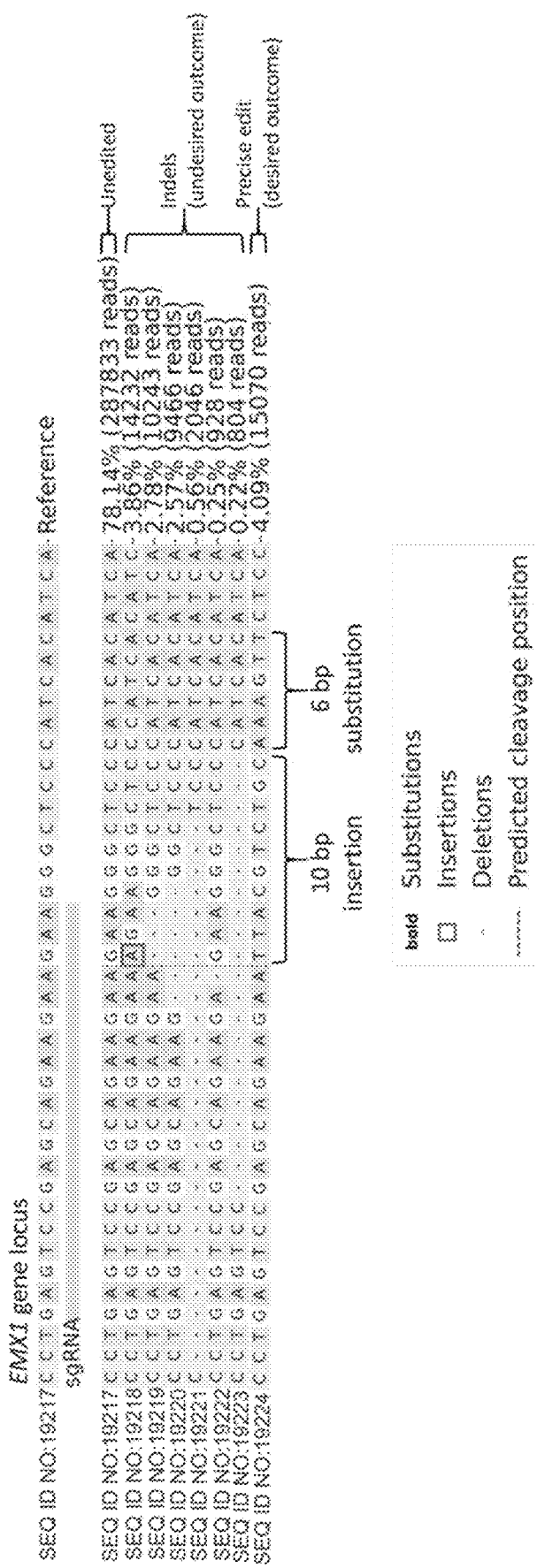

FIG. 35 (SEQ ID NO: 19217-19224) is an example of reference sequence and desired editing outcome for Eco3 retron at he EMX1 genomic site. Analysis of editing outcomes is performed using CRISPResso2 pipeline. In this example, the editing template inserts a 10 bp insertion into the EMX1 gene (TTACGTCTGC) (SEQ ID NO:19144) along with a 6 bp substitution to mutate the PAM sequence (GAAGGG>AAAGTT).

Figure 36:
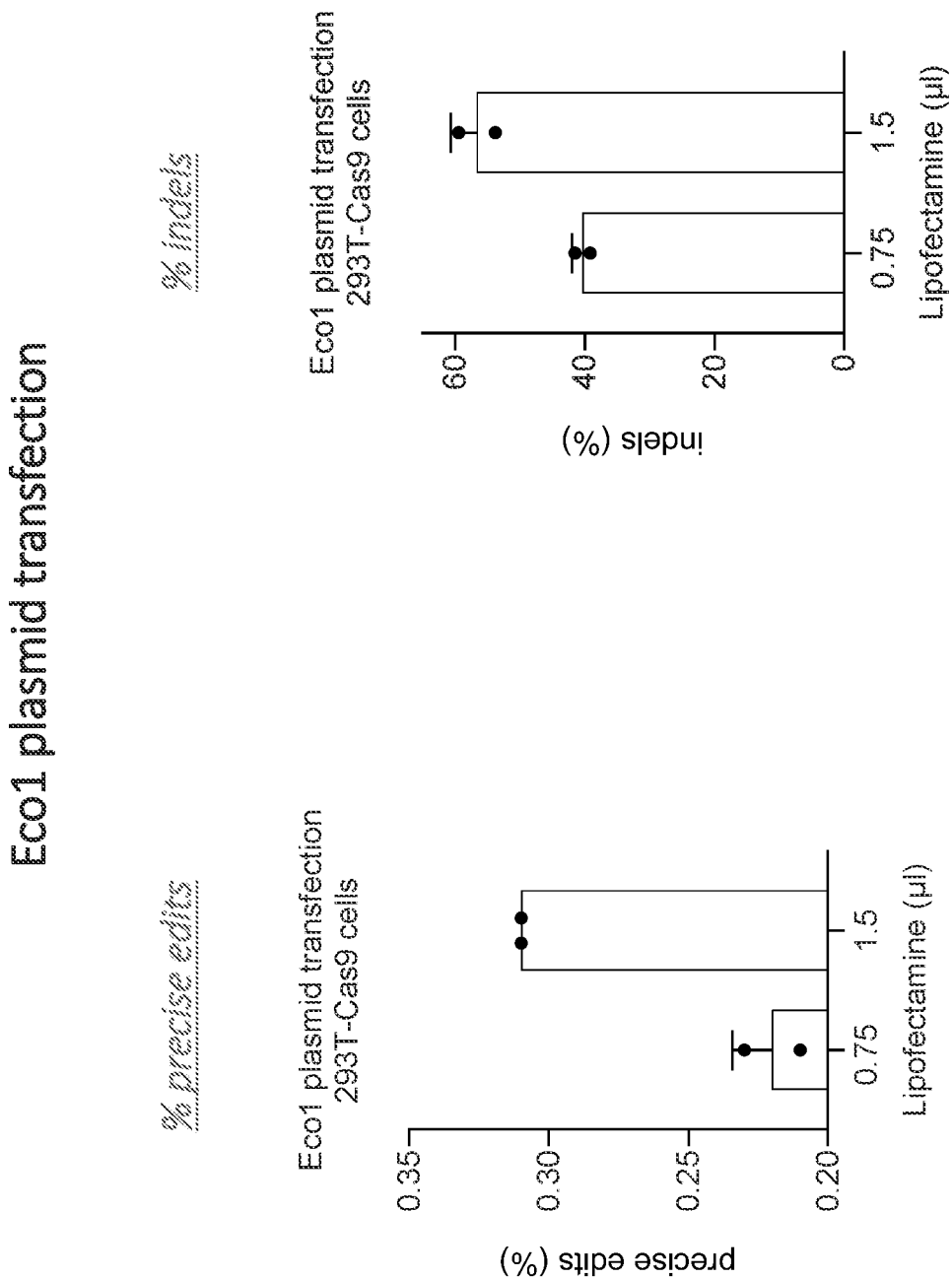

FIG. 36 shows the results of plasmid-based assay (e.g., according to FIG. 33) demonstrating up to about 0.3% precise edits and as low as 40% indels with Eco1 retron in Cas9 expressing HEK293T cells. The plasmid that encodes Eco1 RT and Eco1 ncRNA-sgRNA fusion targeting EMX1 was transfected via lipofection using two different amounts of Lipofectamine.

FIG. 37 shows the results of plasmid-based assay (e.g., according to FIG. 33) demonstrating up to about 0.1% precise edits and as low as 3% indels with AcoI. Aco1 retron has not been experimentally validated to produce msDNA. Precise editing activity observed in this experiment strongly support that Aco1 retron is capable of generating msDNA inside human cells.

Figure 38:
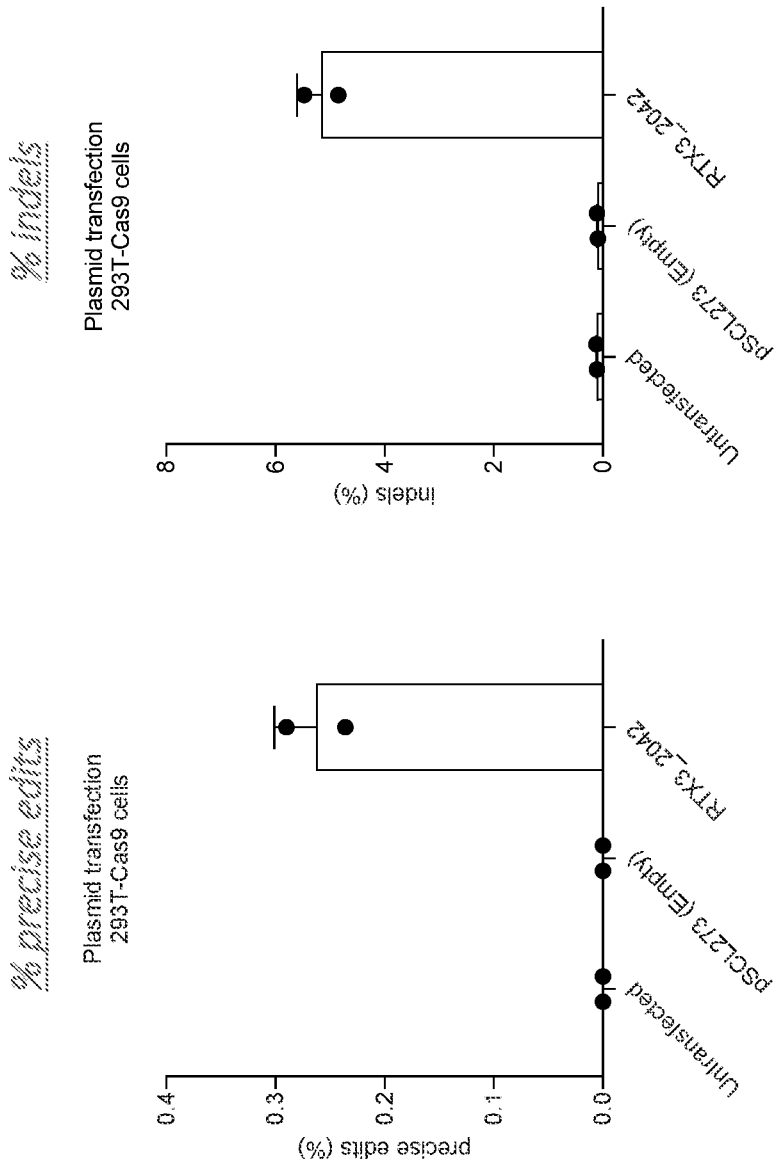

FIG. 38 shows the results of plasmid-based assay (e.g., according to FIG. 33) demonstrating up to about 0.3% precise edits and as low as 5% indels with RTX003_2042. This retron can achieve a comparable precise editing to Eco1 but with significantly lower indels (10-fold). RTX003_2042 is a novel retron and precise editing activity observed in this experiment strongly support that RTX003_2042 retron could generate msDNA inside human cells.

Figure 39A:
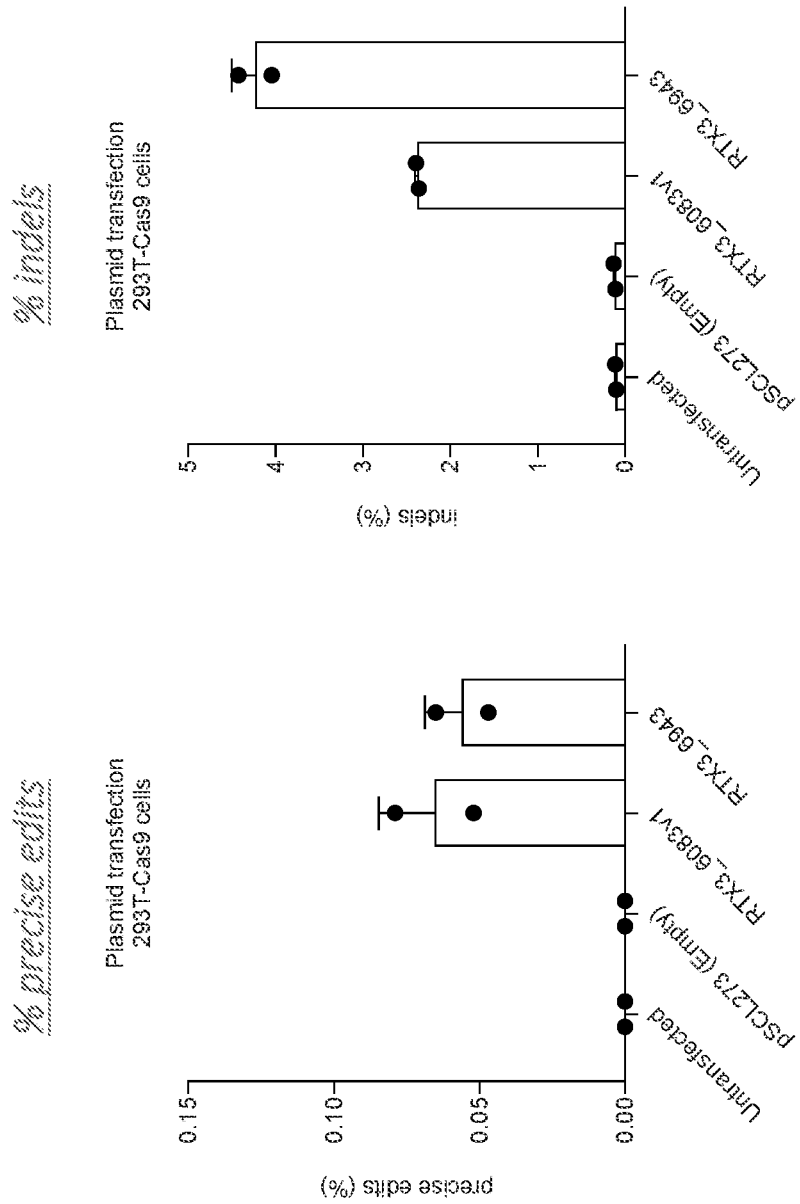

FIG. 39A shows the results of plasmid-based assay demonstrating up to about 0.05~0.08% precise edits and as low as 2.5~4% indels with RTX003_6083v1 and 6943. Both are novel retrons and precise editing activity observed in this experiment strongly support that RTX003_6083v1 and 6943 retron could generate msDNA inside human cells.

Figure 39B:
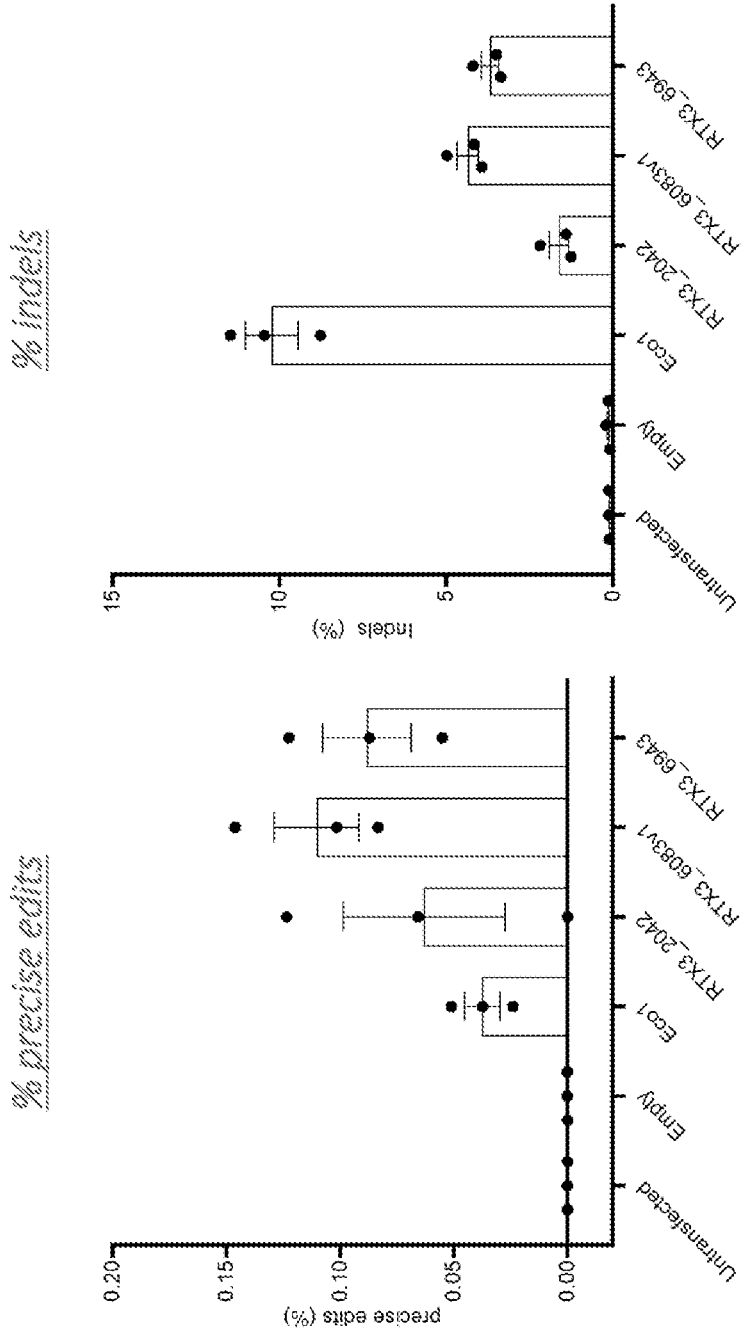

FIG. 39B shows follow up experiments using the same assay of FIG. 39A indicated that RTX3_6083v1 and RTX3_6943 generated 3-4 fold more precise edits than Eco1 while indels generated from these two retrons were 2-3 fold lower. RTX3_2042 showed precise editing at similar frequencies to Eco1 but had more variability than other samples.

Figure 39C:
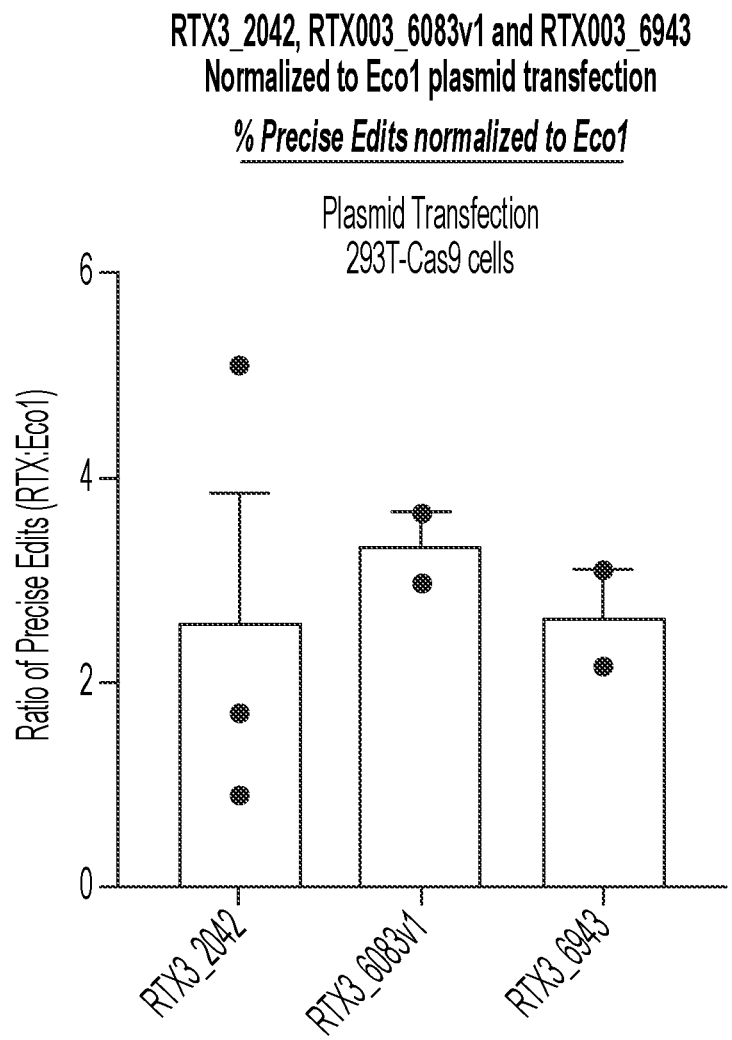

FIG. 39C shows follow up experiments using the same assay of FIG. 39A indicated that RTX3_6083v1 and RTX3_6943 generated 3-4 fold more precise edits than Eco1 while indels generated from these two retrons were 2-3 fold lower. RTX3_2042 showed precise editing at similar frequencies to Eco1 but had more variability than other samples.

Figure 40:
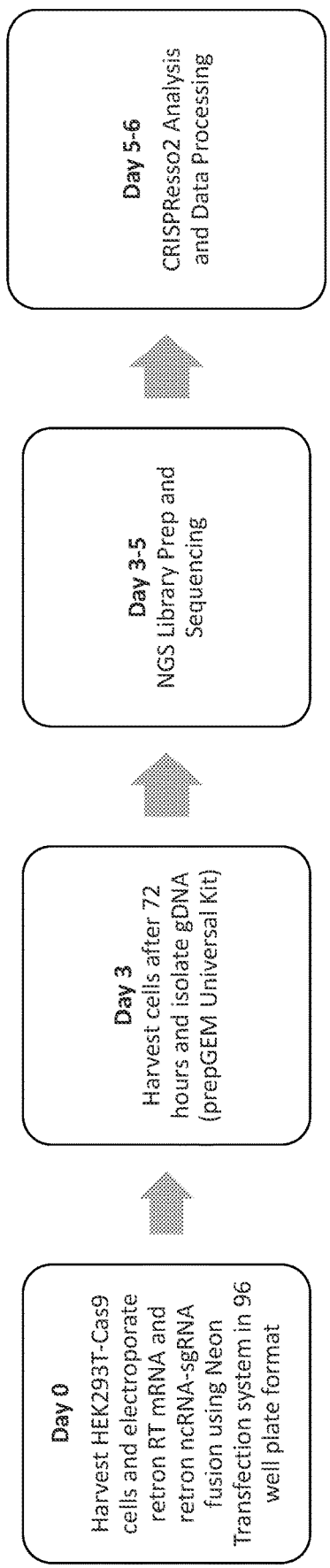

FIG. 40 is a representation of an two-RNA editing assay used in the Examples to measure the relative editing efficiency of exemplary retrons using electroporation-based delivery of two RNA components into HEK293T cells. Appropriate amount of RT mRNA and ncRNA-sgRNA fusion were mixed and electroporated to cells. After 72 hours incubation, genomic DNA was extracted and the targeting region was amplified into sequencing libraries. Sequencing data was analyzed by CRISPResso2 and precise edit and indels were calculated.

Figure 41:
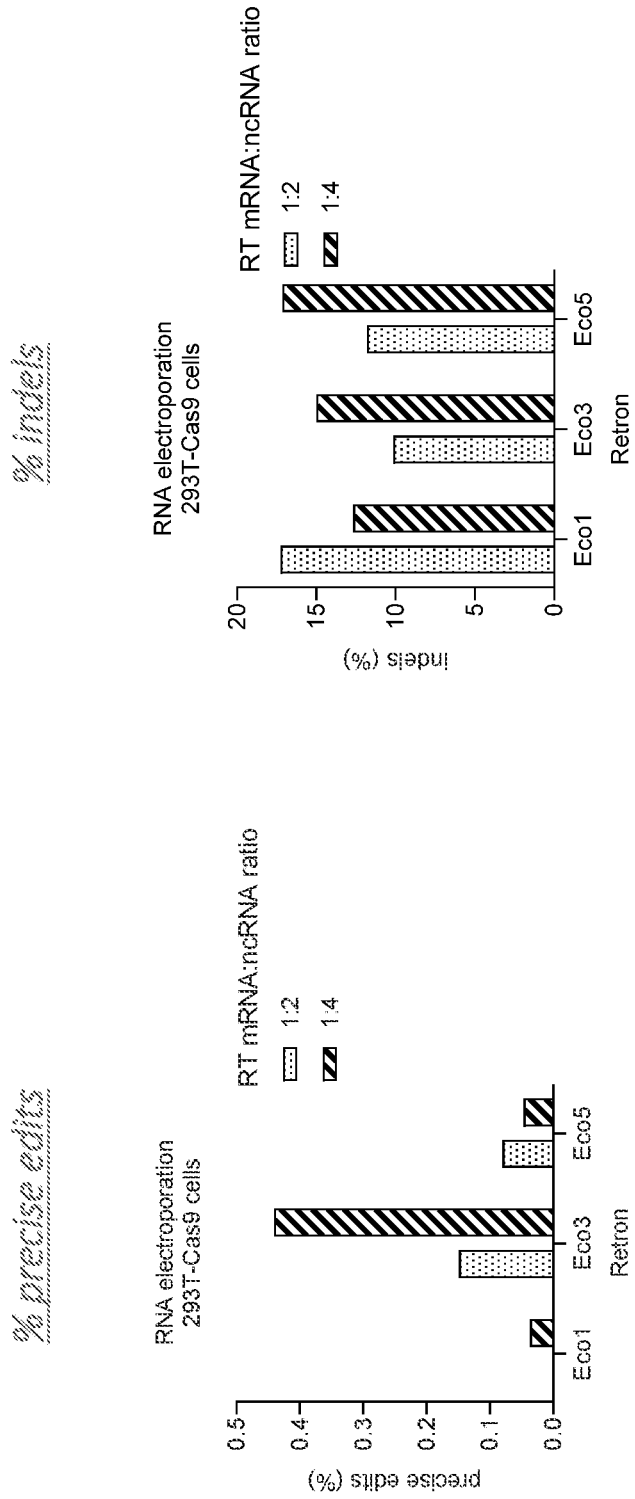

FIG. 41 shows the results of two-RNA system (RT mRNA+ncRNA-sgRNA fusion) delivered to Cas9 expressing HEK293T cells by electroporation. Eco1, Eco3 and Eco5 retrons were tested. Results showed precise edits (left graph) up to 0.4% for Eco3 and as low as 10% indels (right graph) for Eco3. Precise edits mediated by Eco3 increased with augmenting amount of ncRNA-sgRNA fusion from 1:2 to 1:4 ratio between RT mRNA and ncRNA-sgRNA fusion.

Figure 42:
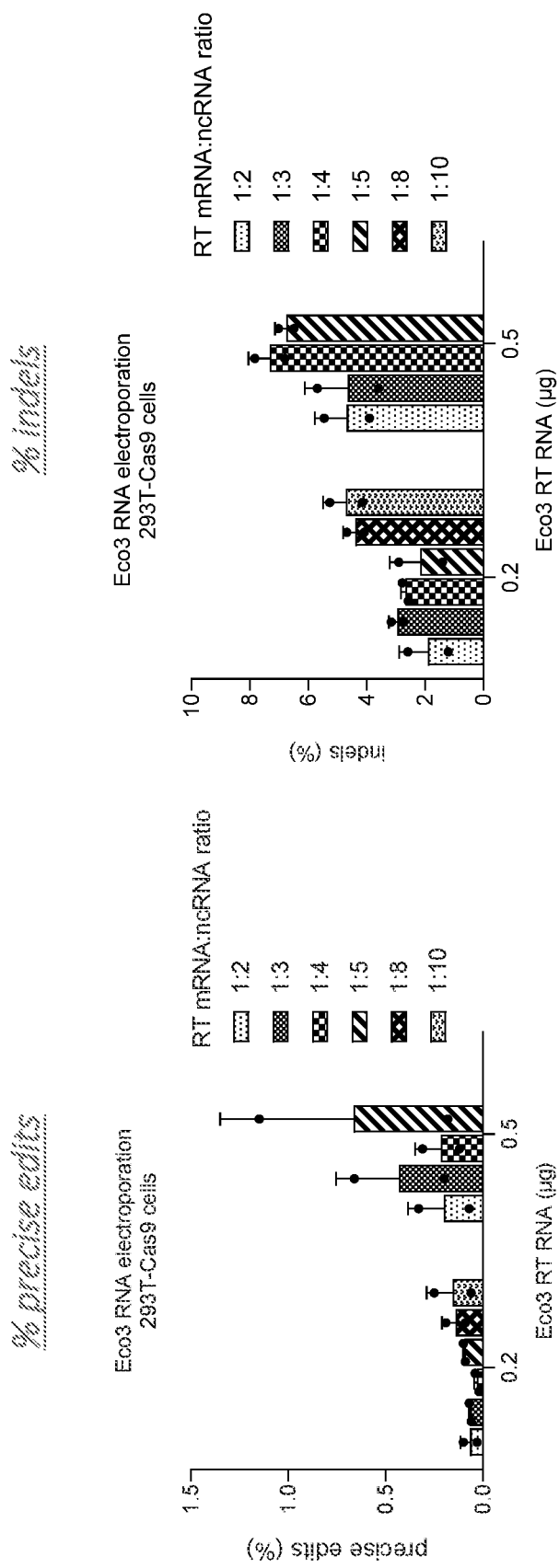

FIG. 42 shows the results of titration of two-component Eco3 RNA system (RT mRNA+ncRNA-sgRNA fusion) delivered to Cas9 expressing 293T cells by electroporation. The RT mRNA and the ncRNA were mixed at ratios of 1:2, 1:3, 1:4, 1:5, 1:8, 1:10, respectively, and delivered at two different amounts of RT mRNA (0.2 or 0.5 μg). On left, data showed that Eco3 at 0.5 μg produced highest percentage of precise edits at a 1:3 and 1:5 ratio of RT mRNA to ncRNA. On right, data further showed that a more equivalent ratio of RT mRNA to ncRNA resulted in a trend of lower percentage of indels.

Figure 43:
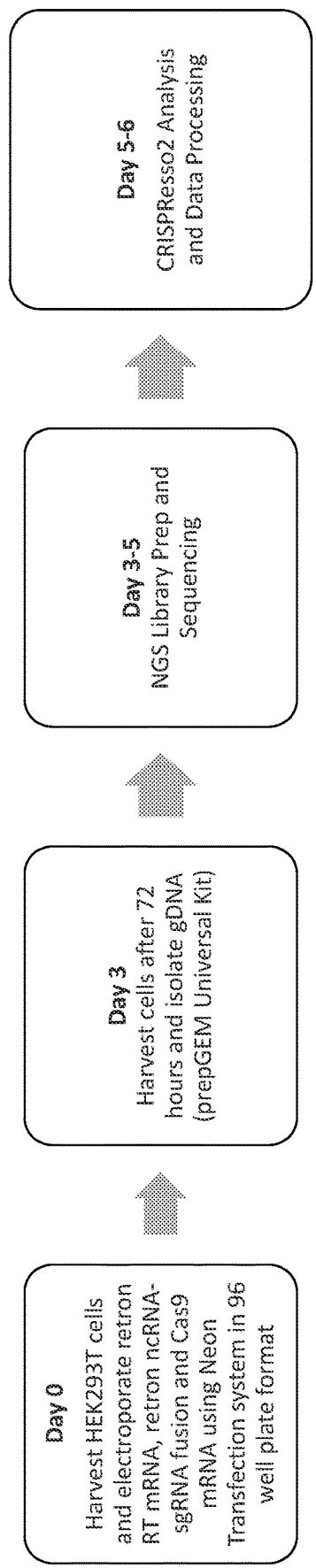

FIG. 43 is a representation of a three-RNA retron editing system which involves delivery by electroporation of three RNA components (RT mRNA, retron ncRNA-sgRNA fusion, and Cas9 mRNA) into HEK293T cells. Appropriate amount of RT mRNA, ncRNA-sgRNA fusion, and Cas9 mRNA were mixed and electroporated to cells. After 72 hours incubation, genomic DNA was extracted and targeting region was amplified into sequencing libraries. Sequencing data was analyzed by CRISPResso2 and precise edit and indels were calculated.

Figure 44:
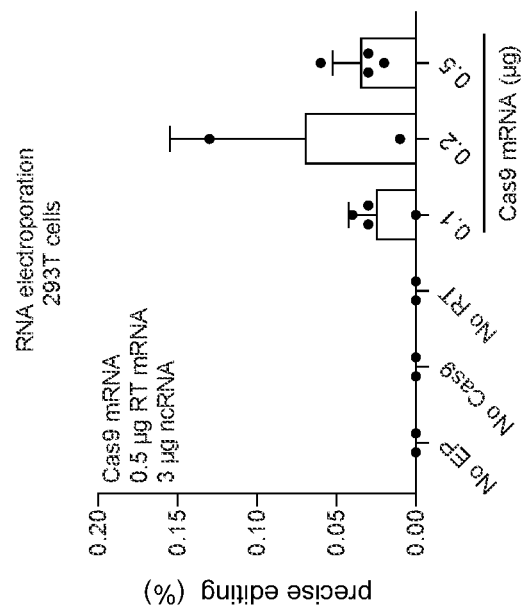

FIG. 44 shows the results of Cas9 mRNA titration of three-component Eco3 RNA system (RT mRNA+ncRNA-sgRNA fusion+Cas9 mRNA) delivered to 293T cells by electroporation. The RT mRNA and the ncRNA-sgRNA fusion were mixed at given amounts on the graph and the amount Cas9 mRNA was titrated. At 0.2 µg of Cas9 mRNA, up to 0.1% of precise editing was observed. While the editing efficiency is an order of magnitude lower than two RNA system, the editing occurred by specific action of Cas9 and retron, since absence of either abrogated the editing.

Figure 45:
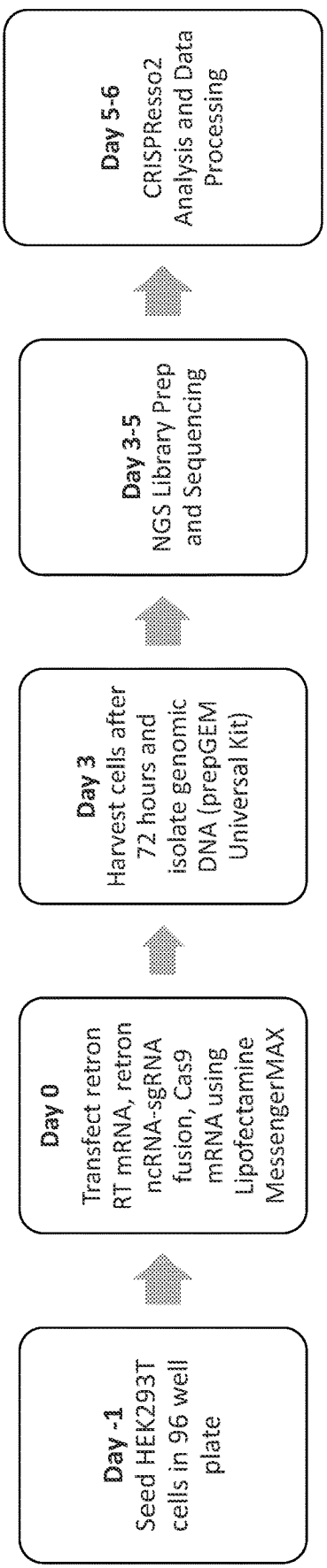

FIG. 45 depicts a process of lipofection using three RNA system in HEK293T cells. Cells were seeded in 96 well plate one day prior to transfection. Appropriate amount of RT mRNA, ncRNA-sgRNA fusion, Cas9 mRNA and Lipofectamine reagent were mixed and transferred to cells. After 72 hours incubation, genomic DNA was extracted and targeting region was amplified into sequencing libraries. Sequencing data was analyzed by CRISPResso2 and precise edit and indels were calculated.

Figure 46:
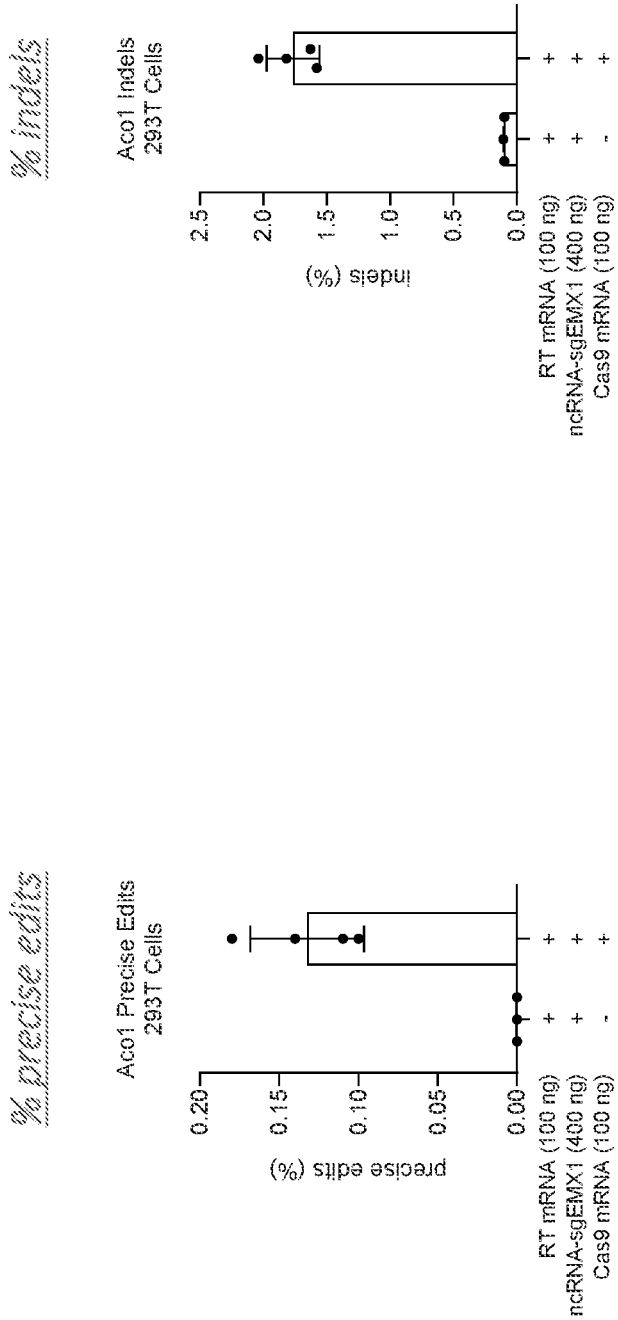

FIG. 46 shows the results of three-component Aco1 RNA system (RT mRNA+ncRNA+Cas9 mRNA) delivered to HEK293T cells by lipofection. The RT mRNA, the ncRNA and the Cas9 mRNA were mixed at amounts indicated in the graph and transfected to HEK293T cells. 56 bp insertion and 6 bp deletion at EMX1 locus was scored as precise edits and ~0.1% of cell population has undergone precise editing on the left graph. The editing was dependent on Cas9 nuclease since its absence abrogated the editing. The frequency of indels was about 1.5% on the right graph.

Figure 47:
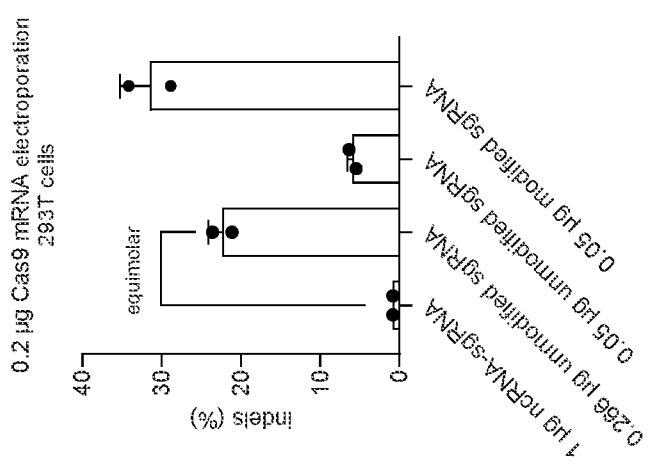

FIG. 47 shows the results of minimal Cas9 nuclease activity when sgRNA is fused to ncRNA of Eco3 retron. Cas9 activity was evaluated by frequency of indels. 1 µg of ncRNA-sgRNA fusion shows 20-fold lower activity than equimolar separated sgRNA alone. In parallel, activity of chemical modified vs unmodified sgRNA was compared and the former shows 6-fold higher activity than the latter at the condition described in the graph.

Figure 48:
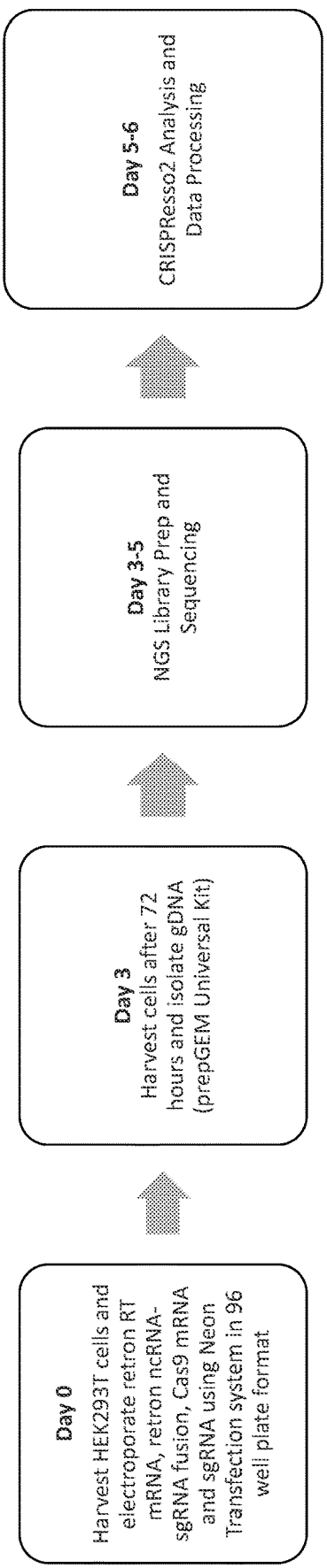

FIG. 48 is a representation of the all-RNA editing assay used in the Examples to measure the relative editing efficiency of the sample retrons in an all-RNA format, modified with a step of in trans guide RNA spike-in. Electroporation using three RNA system+sgRNA trans spike-in in HEK293T cells. Appropriate amount of RT mRNA, ncRNA-sgRNA fusion, Cas9 mRNA, and sgRNA were mixed and electroporated to cells. After 72 hours incubation, genomic DNA was extracted and targeting region was amplified into sequencing libraries. Sequencing data was analyzed by CRISPResso2 and precise edit and indels were calculated.

Figure 49:
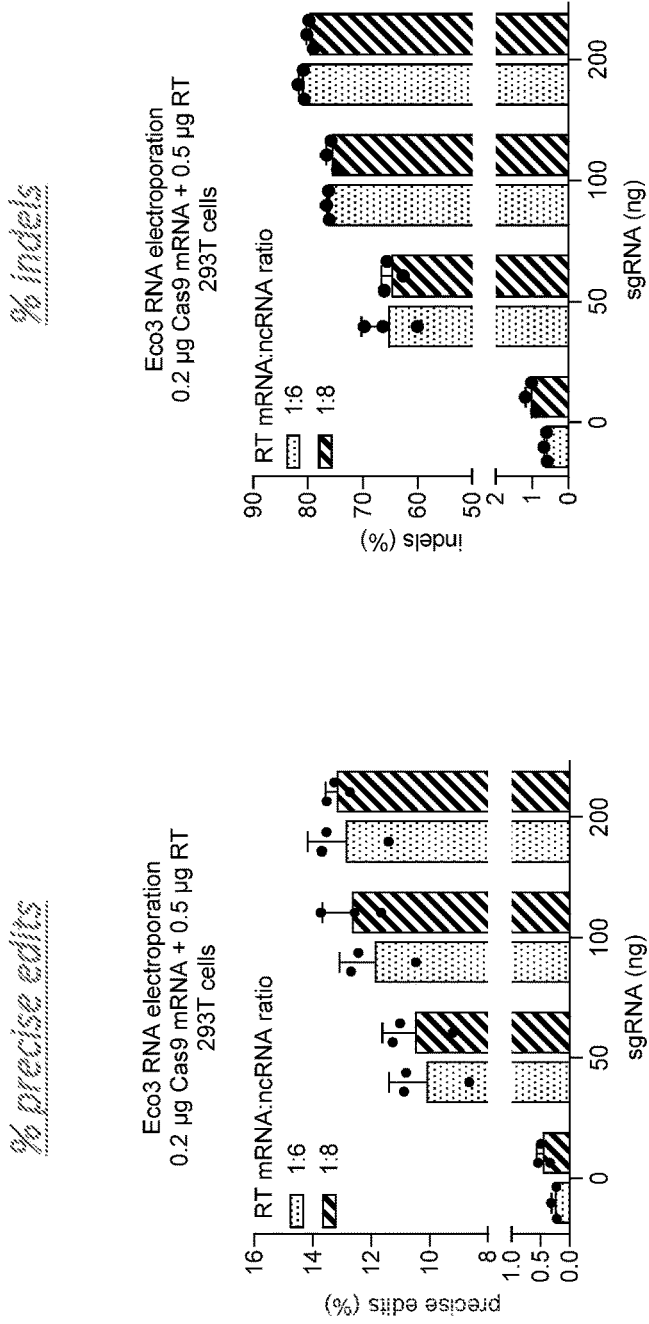

FIG. 49 shows the results of guide RNA spike-in in all RNA system (RT mRNA+ncRNA-sgRNA fusion+Cas9 mRNA+sgRNA) delivered to HEK293T cells by electroporation. At given amount of Cas9 and RT mRNA on the graph, the amount of guide RNA spike-in is titrated at 50, 100 and 200 ng. The titration was done at two different ratios of RT mRNA:ncRNA-sgRNA fusion=1:6 or 1:8. The guide RNA spike-in in all RNA system increased precise editing up to ~50 fold. The increasing amount of guide RNA gradually increased precise editing and 1:8 of RT mRNA:ncRNA-sgRNA fusion performed slightly better than 1:6, reaching 13% of precise editing. On the right graph, frequency of indels is shown for respective conditions.

Figure 50:
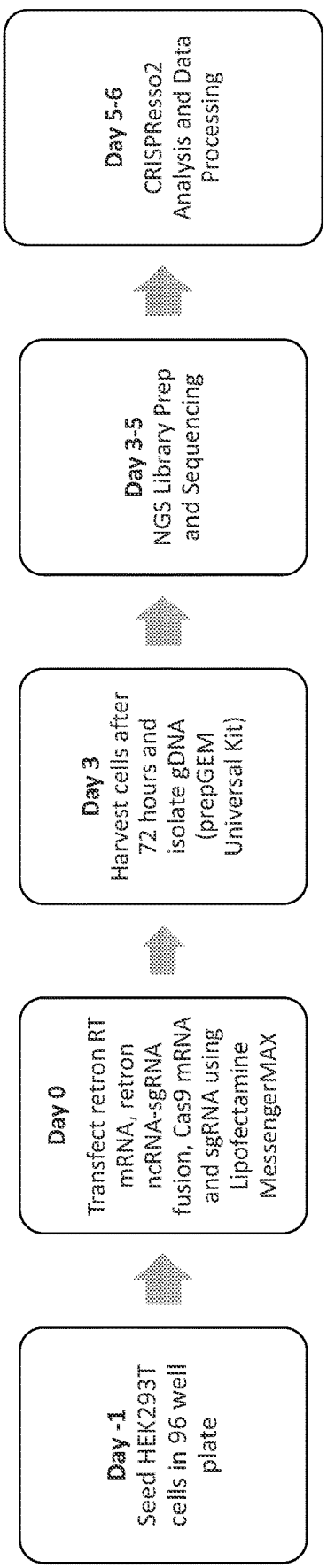

FIG. 50 represents a lipofection process using three RNA system+gRNA trans spike-in in HEK293T cells. Cells were seeded in 96 well plate one day prior to transfection. Appropriate amount of RT mRNA, ncRNA-sgRNA fusion, Cas9 mRNA, sgRNA and Lipofectamine reagent were mixed and transferred to cells. After 72 hours incubation, genomic DNA was extracted and targeting region was amplified into sequencing libraries. Sequencing data was analyzed by CRISPResso2 and precise edit and indels were calculated.

Figure 51:
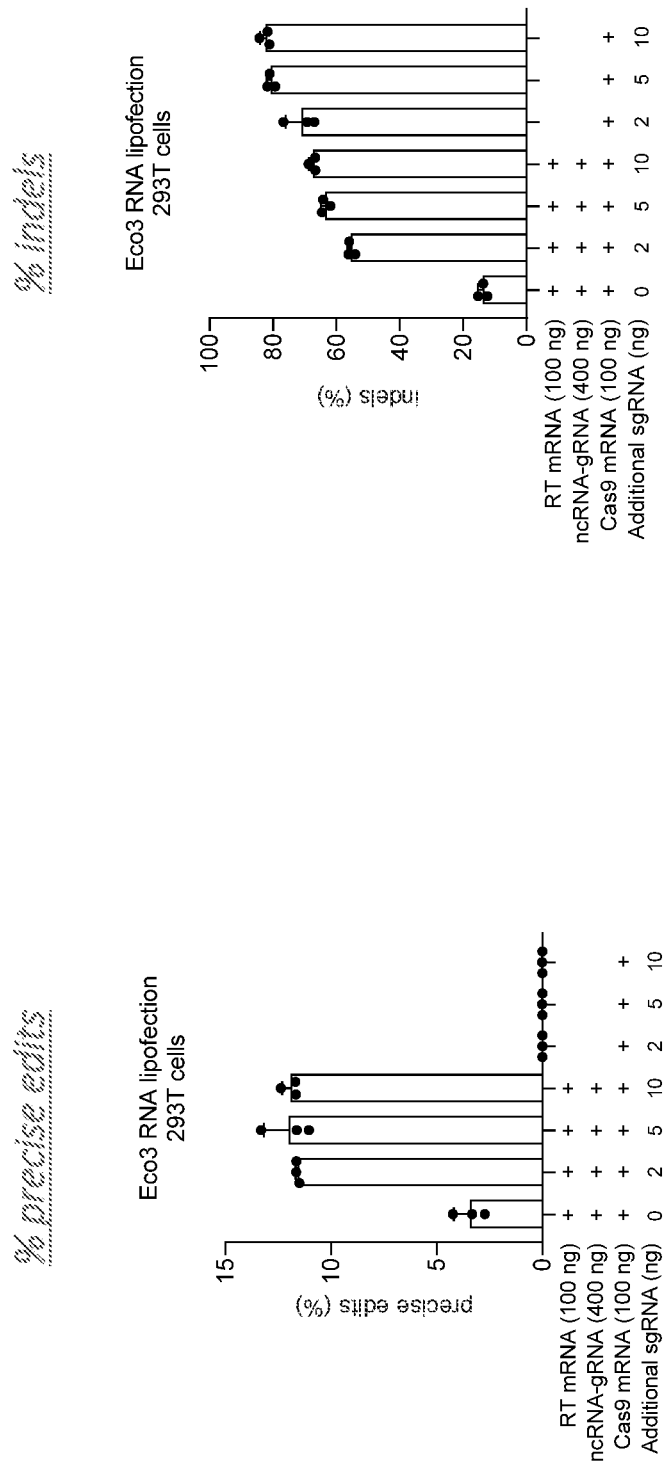

FIG. 51 shows the results of guide RNA spike-in (i.e., delivering a separate molecule bolus of guide RNA which in all RNA system (RT mRNA+ncRNA-sgRNA fusion+Cas9 mRNA+sgRNA) delivered to HEK293T cells by lipofection. At given amount of RT mRNA, ncRNA-sgRNA fusion, and Cas9 mRNA on the graph, the amount of guide RNA spike-in is titrated at 2, 5 and 10 ng. The guide RNA spike-in in all RNA system increased precise editing up to 3.5 fold, 12% of efficiency. The increasing amount of guide RNA at this range did not further increase precise editing. The precise editing is completely dependent on the presence of Retron machinery. On the right graph, frequency of indels is shown for respective conditions.

Figure 52:
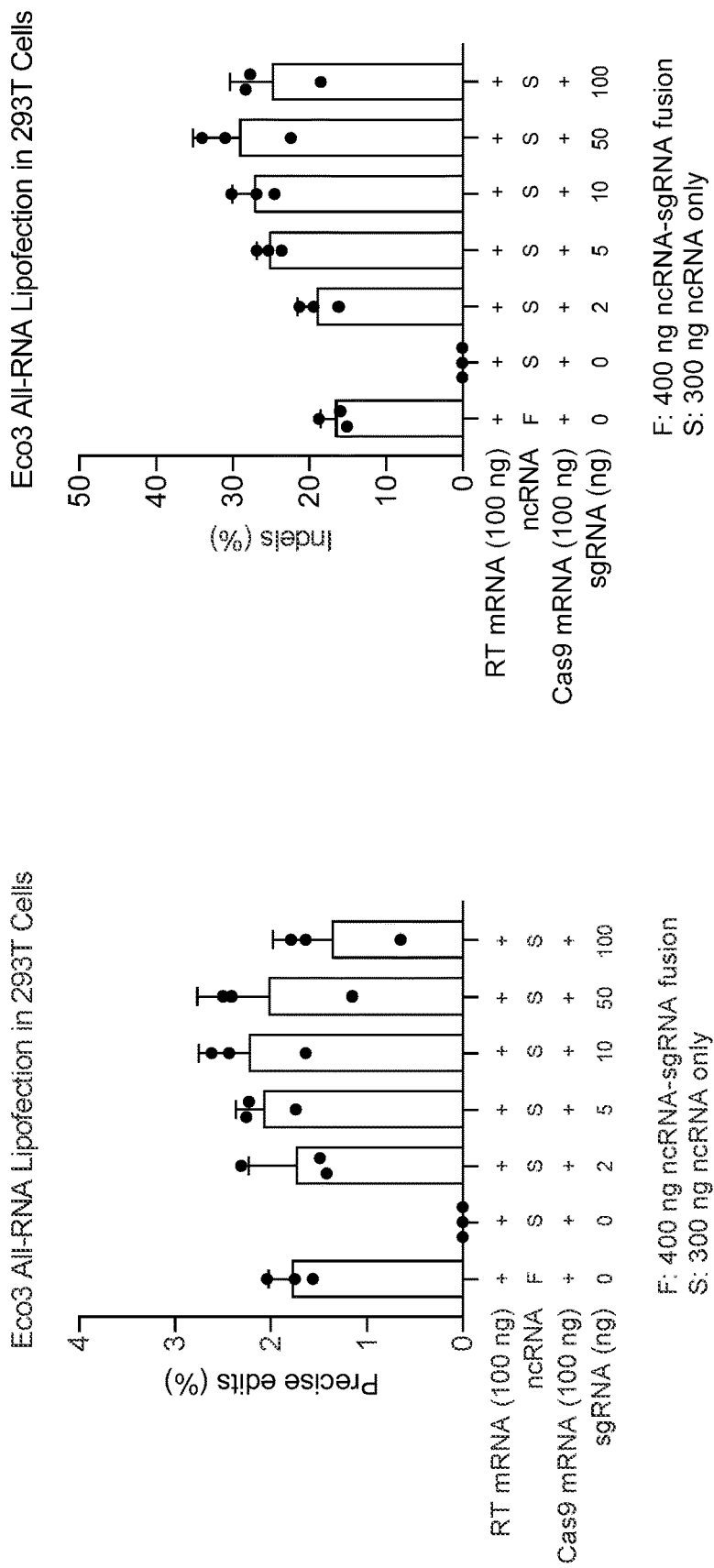

FIG. 52 shows the results of ncRNA-sgRNA fusion separation in all RNA system (RT mRNA+Cas9 mRNA+ either ncRNA-sgRNA fusion OR separate ncRNA+sgRNA) delivered to HEK293T cells by lipofection. At given amount of RT mRNA and Cas9 mRNA on the graph, the amount of guide RNA spike-in is titrated at 0, 2, 5, 10, 50 and 100 ng. At 10 ng guide RNA, precise editing peaked at 2.23% compared to 1.78% with ncRNA-sgRNA fusion. The increasing amount of guide RNA at this range did not further increase precise editing. On the right graph, frequency of indels is shown for respective conditions.

Figure 53:
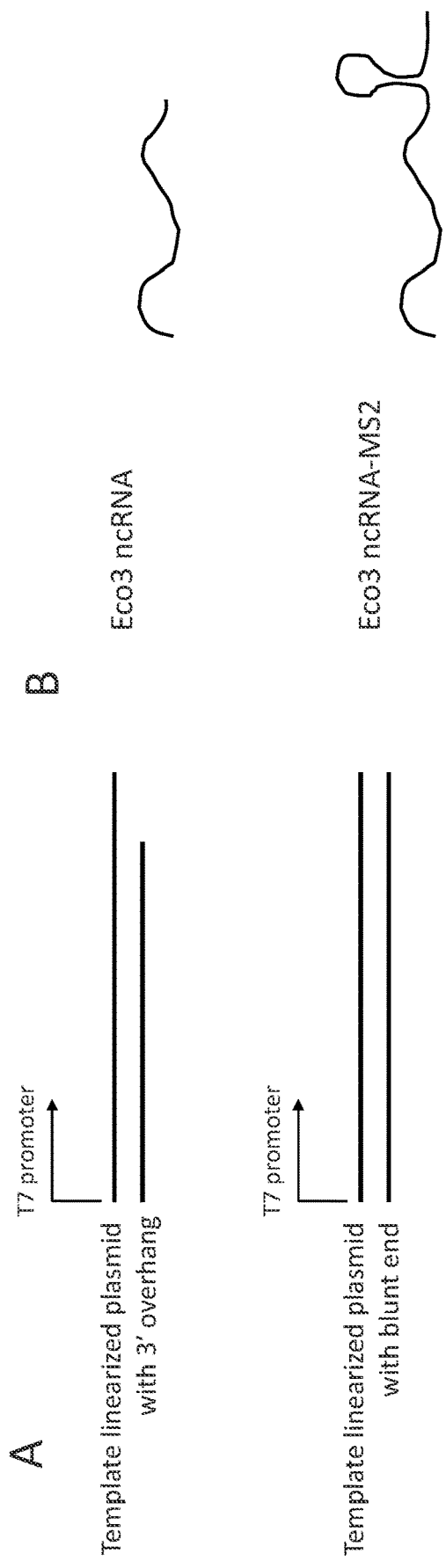
Figure 54:
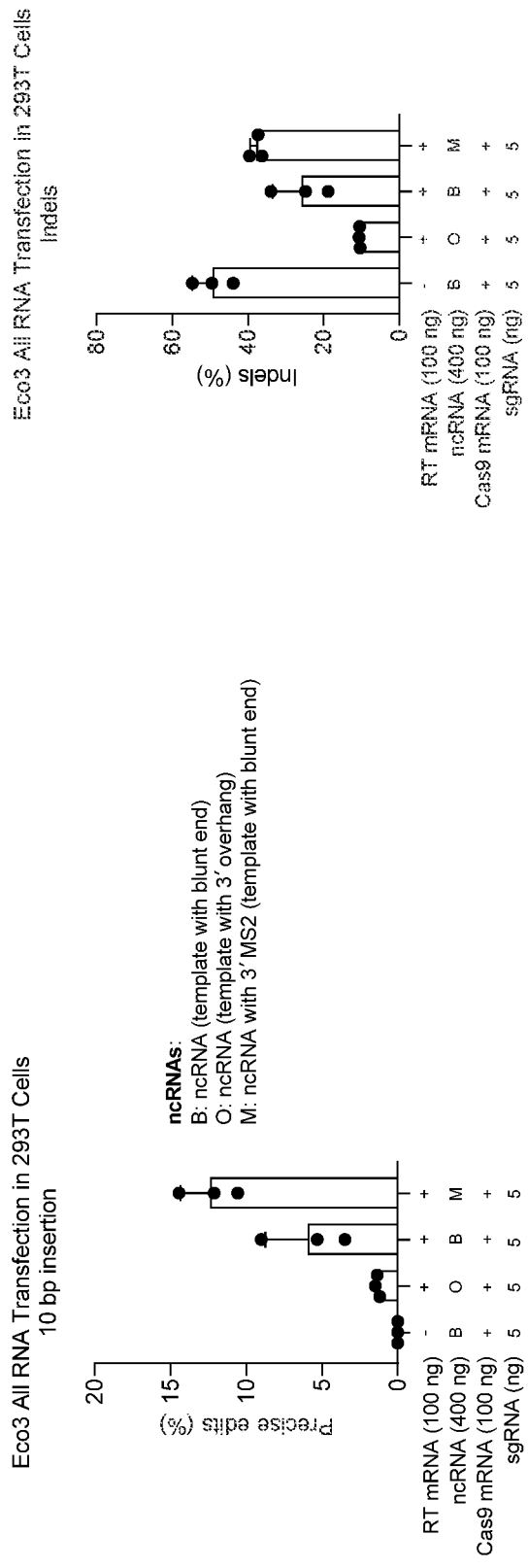

FIG. 53 is a schematic of improved templates used for in vitro transcription to produce ncRNA (left or A) and ncRNA modifications (right or B). (A) relates to the optimization of RNA production by in vitro transcription. Previously made in vitro transcription experiments to produce RNA used a double-stranded DNA template containing a 3' overhang (on same strand as T7 promoter sequence). A new template with a blunt end was designed and tested and as shown in FIG. 54 results in increased precise editing efficiency. (B) relates to modified ncRNAs which are modified by addition of an MS2 stem loop hairpin at the 3' end of the ncRNA. Without being bound by theory, the MS2 loop helps stabilize the ncRNA and results in significantly improved precise editing efficiency, as shown in FIG. 54.

FIG. 54 shows the results of ncRNA-sgRNA fusion separation in 4 component all-RNA system (RT mRNA+ Cas9 mRNA+ncRNA+sgRNA) delivered to HEK293T cells by Lipofectamine MessengerMAX. All RNA was transfected at a fixed amount as shown on the graphs. Using RNA generated from linearized plasmid template containing a 3' overhang produced 1.35% precise edits. Using RNA generated from the improved linearized plasmid template containing a blunt end increased precise editing to 5.94%. Adding an MS2 stem loop to the 3' end of the ncRNA (blunt end) further increased precise editing to 12.39%. On the right graph, frequency of indels is shown for respective conditions.

Figure 55:
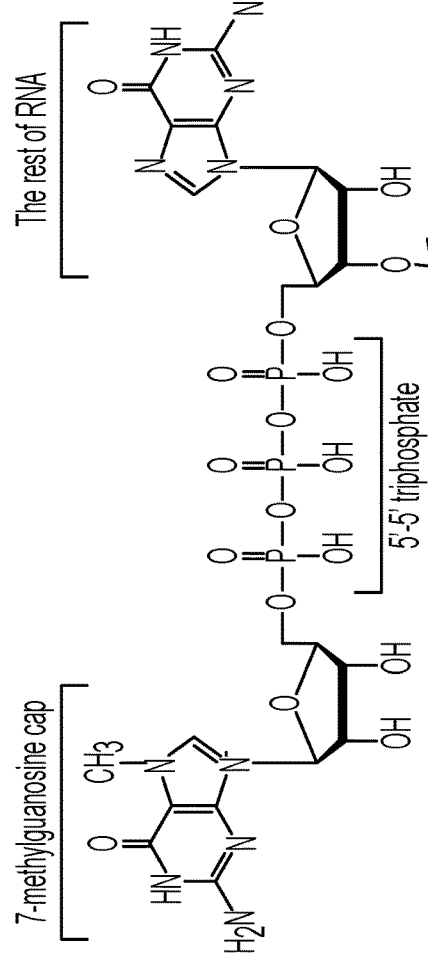

FIG. 55 provides schematics for end protection of RNA from cellular nuclease activity by capping and tailing. In (A), a 7-methylguanosine cap0 was added to 5' triphosphate of RNA. In (B), a poly-A tail was added to the 3' end by enzymatic addition. Tail length is estimated over 50 nucleotides. In (C), RNA containing both a 5' cap and a 3' tail is shown. Results are shown in FIG. 56.

Figure 56:
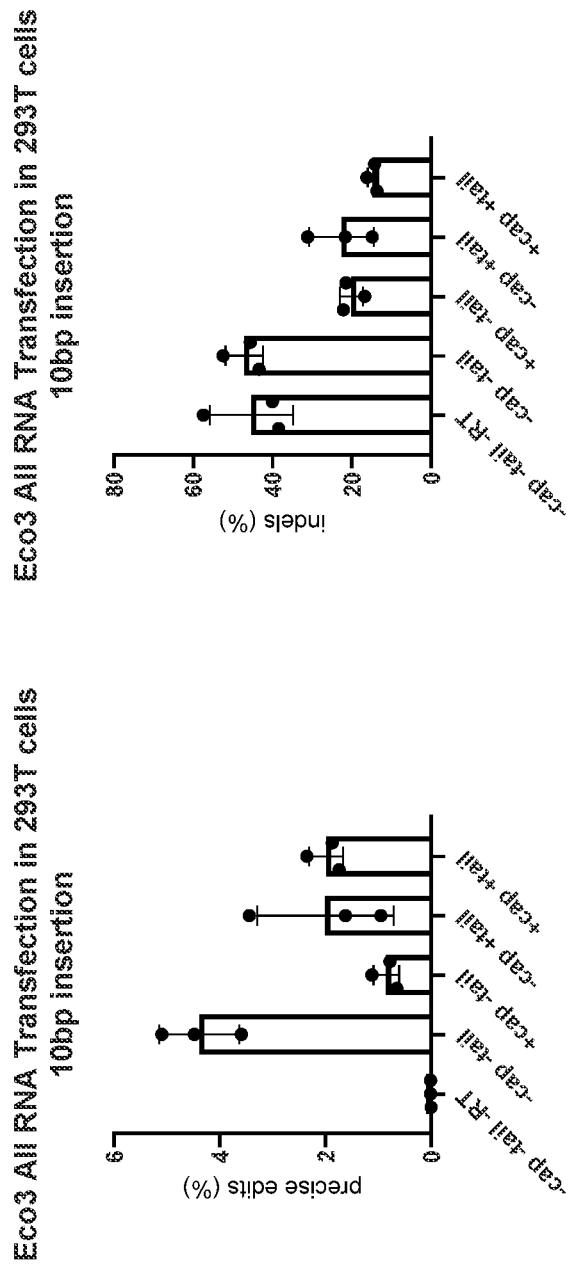

FIG. 56 shows the result of end protection of ncRNA-sgRNA fusion by cap and tail in 4 component all-RNA system (RT mRNA+Cas9 mRNA+ncRNA+sgRNA) delivered to HEK293T cells by Lipofectamine MessengerMAX. All RNA was transfected at a fixed amount RT mRNA 100 ng, ncRNA-sgRNA 400 ng, Cas9 mRNA 100 ng, and sgRNA 5 ng. ncRNA-gRNA fusion was either capped (+cap −tail) or poly-A tailed (−cap +tail) or both capped and poly-A tailed (+cap +tail). Using RNA without end protection (−cap −tail) produced ~4.5% precise edits and the editing was dependent on retron since the absence of RT abrogated precise editing. Using RNA with either or both protection by cap and tail produced lower precise editing (left graph) but lowered indels (right graph) than without cap and tail.

DEFINITIONS

All technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & 62/1005 Marham, The Harper Collins Dictionary of Biology (1991).

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges, and are also encompassed within the disclosure, subject to any specifically excluded limit in the stated range. Where the stated range includes one or both of the limits, ranges excluding either or both of those included limits are also included in the disclosure.

It must be noted that as used herein and in the appended claims, the singular forms "a," "an," and "the" include plural referents unless the context clearly dictates otherwise. Thus, for example, reference to "a ncRNA" includes a plurality of ncRNAs and reference to "the reverse transcriptase" includes reference to one or more RTs and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation. For example, claims may be drafted to exclude certain RT sequences.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub combination was individually and explicitly disclosed herein.

Biologically Active

As used herein, the term "biologically active" refers to a characteristic of an agent (e.g., DNA, RNA, or protein) that has activity in a biological system (including in vitro and in vivo biological system), and particularly in a living organism, such as in a mammal, including human and non-human mammals. For instance, an agent when administered to an organism has a biological effect on that organism, is considered to be biologically active.

Bulge

As used herein, the term "bulge" refers to a small region of unpaired base(s) that interrupts a "stem" of base-paired nucleotides. The bulge may comprise one or two single-stranded or unbase-paired nucleotides joined at both ends by base-paired nucleotides of the stem. The bulge can be symmetrical (viz., the two unbase-paired single-stranded regions have the same number of nucleotides), or asymmetrical (viz., the unbase-paired single stranded region(s) have different or unequal numbers of nucleotides), or there is only one unbase-paired nucleotide on one strand. A bulge can be described as A/B (such as a "2/2 bulge," or a "1/0 bulge") wherein A represents the number of unpaired nucleotides on the upstream strand of the stem, and B represents the number of unpaired nucleotides on the downstream strand of the stem. An upstream strand of a bulge is more 5' to a downstream strand of the bulge in the primary nucleotide sequence.

cDNA

As used herein, the term "cDNA" refers to a strand of DNA copied from an RNA template, e.g., by a reverse transcriptase.

Complementary

As used herein, the terms "complementary" or "substantially complementary" are meant to refer to a nucleic acid (e.g., RNA, DNA) that comprises a sequence of nucleotides that enables it to non-covalently bind, i.e., form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. Standard Watson-Crick base-pairing includes:

adenine (A) pairing with thymidine (T), adenine (A) pairing with uracil (U), and guanine (G) pairing with cytosine (C) [DNA, RNA]. In addition, for hybridization between two RNA molecules (e.g., dsRNA), and for hybridization of a DNA molecule with an RNA molecule (e.g., when a DNA target nucleic acid base pairs with a guide RNA, etc.): guanine (G) can also base pair with uracil (U). For example, G/U base-pairing is at least partially responsible for the degeneracy (i.e., redundancy) of the genetic code in the context of tRNA anti-codon base-pairing with codons in mRNA. Thus, in the context of this disclosure, a guanine (G) is considered complementary to both a uracil (U) and to an adenine (A). For example, when a G/U base-pair can be made at a given nucleotide position of a dsRNA duplex of a guide RNA molecule, the position is not considered to be non-complementary, but is instead considered to be complementary.

It is understood that the sequence of a polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a bulge, a loop structure or hairpin structure, etc.). A polynucleotide can comprise 60% or more, 65% or more, 70% or more, 75% or more, 80% or more, 85% or more, 90% or more, 95% or more, 98% or more, 99% or more, 99.5% or more, or 100% sequence complementarity to a target region within the target nucleic acid sequence to which it will hybridize. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656), the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489), and the like.

DNA-Guided Nuclease

As used herein, an "DNA-guided nuclease" is a type of "programmable nuclease," and a specific type of "nucleic acid-guided nuclease." An example of a DNA-guided nuclease is reported in Varshney et al., DNA-guided genome editing using structure-guided endonucleases, Genome Biology, 2016, 17(1), 187, which may be used in the context of the present disclosure and is incorporated herein by reference. As used herein, the term "DNA-guided nuclease" or "DNA-guided endonuclease" refers to a nuclease that associates covalently or non-covalently with a guide RNA thereby forming a complex between the guide RNA and the DNA-guided nuclease. The guide RNA comprises a spacer sequence which comprises a nucleotide sequence having complementarity with a strand of a target DNA sequence. Thus, the DNA-guided nuclease is indirectly guided or programmed to localize to a specific site in a DNA molecule through its association with the guide RNA, which directly binds or anneals to a strand of the target DNA through its complementarity region via Watson-Crick base-pairing.

DNA Regulatory Sequences

As used herein, the terms "DNA regulatory sequences," "control elements," and "regulatory elements," can be used interchangeably herein to refer to transcriptional and translational control sequences, such as promoters, enhancers, polyadenylation signals, terminators, protein degradation signals, and the like, that provide for and/or regulate transcription of a non-coding sequence (e.g., guide RNA) or a coding sequence and/or regulate translation of a mRNA into an encoded polypeptide.

Donor Nucleic Acid

By a "donor nucleic acid" or "donor polynucleotide" or "donor DNA" or "HDR donor DNA" it is meant a single-stranded DNA to be inserted at a site cleaved by a programmable nuclease (e.g., a CRISPR/Cas effector protein; a TALEN; a ZFN; a meganuclease) (e.g., after dsDNA cleavage, after nicking a target DNA, after dual nicking a target DNA, and the like). The donor polynucleotide can contain sufficient homology to a genomic sequence at the target site, e.g. 70%, 80%, 85%, 90%, 95%, or 100% homology with the nucleotide sequences flanking the target site, e.g., within about 200 bases or less of the target site, e.g., within about 190 bases or less of the target site, e.g., within about 180 bases or less of the target site, e.g., within about 170 bases or less of the target site, e.g., within about 160 bases or less of the target site, e.g., within about 150 bases or less of the target site, e.g., within about 140 bases or less of the target site, e.g., within about 130 bases or less of the target site, e.g., within about 120 bases or less of the target site, e.g., within about 110 bases or less of the target site, e.g., within about 100 bases or less of the target site, e.g., within about 90 bases or less of the target site, e.g., within about 80 bases or less of the target site, e.g., within about 70 bases or less of the target site, e.g., within about 60 bases or less of the target site, e.g., 50 bases or less of the target site, e.g., within about 30 bases, within about 15 bases, within about 10 bases, within about 5 bases, or immediately flanking the target site, to support homology-directed repair between it and the genomic sequence to which it bears homology.

Encodes

As used herein, a DNA sequence that "encodes" a particular RNA is a DNA nucleotide sequence that is transcribed into RNA. A DNA polynucleotide may encode an RNA (mRNA) that is translated into protein (and therefore the DNA and the mRNA both encode the protein), or a DNA polynucleotide may encode an RNA that is not translated into protein (e.g. tRNA, rRNA, microRNA (miRNA), a "non-coding" RNA (ncRNA), a guide RNA, etc.). In the case of retrons, the retron DNA may encode the ncRNA loci (which includes the msr and msd regions) as well as a retron RT.

Engineered Retron

As used herein, the term "engineered retron" or equivalently, "recombinant retron," refers to a retron that does not occur in nature. In one embodiment, engineered retrons can include wildtype or naturally-occurring retrons that are modified to contain at least one modification, including a single nucleotide substitution, insertion, or deletion, or a substitution, insertion, or deletion of more than one nucleotide, i.e., up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or up to 100, or up to 200, 300, 400, 500, 600, 700, 800, 900, 1000, 1100, 1200, 1300, 1400, 1500, 1600, 1700, 1800, 1900, or up to 2000 nucleotides substituted, inserted, or deleted from a starting point retron (e.g., a wildtype retron). Where more than one nucleotide of a starting point retron (e.g., a wildtype retron) is substituted, deleted, or inserted, the nucleotides may be contiguous or non-contiguous. While an engineered retron as a whole is not naturally-occurring, it may include components such as nucleotide sequences that do occur in nature. For example, an engineered retron can have nucleotide sequences from different organisms (e.g., from different bacteria species), or from completely synthetic/artificial/recombinant nucleic acid sequences. Thus, an engineered retron can have a bacterial nucleotide sequence, a human nucleotide sequence, a viral nucleotide sequence, and/or a synthetic/artificial/recombinant nucleotide sequence, and/or combinations of such sequences. An example of modifications of the recombinant retrons disclosed herein include the insertion of a heterologous nucleic acid sequence in a retron, for example, inserted into the ncRNA locus, such as in the msr or the msd loci. Linking guide RNA molecules to the 5' and/or 3' ends (i.e., linking one at the 5' end of a ncRNA and/or one at the 3' end of a ncRNA) also represent another modification envisioned by the recombinant retrons disclosed herein. In such embodiments, the guide RNA molecules may also be categorized or referred to more generally as types of heterologous nucleic acid sequences used to modify starting point retrons.

Exosomes

As used herein, the term "exosomes" refer to small membrane bound vesicles with an endocytic origin. Without wishing to be bound by theory, exosomes are generally released into an extracellular environment from host/progenitor cells post fusion of multivesicular bodies the cellular plasma membrane. As such, exosomes can include components of the progenitor membrane in addition to designed components (e.g. engineered retron). Exosome membranes are generally lamellar, composed of a bilayer of lipids, with an aqueous inter-nanoparticle space.

Expression Vector

As used herein, the term "expression vector" or "expression construct" refers to a vector that includes one or more expression control sequences, and an "expression control sequence" is a DNA sequence that controls and regulates the transcription and/or translation of another DNA sequence. Suitable expression vectors include, without limitation, plasmids and viral vectors derived from, for example, bacteriophage, baculoviruses, tobacco mosaic virus, herpes viruses, cytomegalovirus, retroviruses, vaccinia viruses, adenoviruses, and adeno-associated viruses. Numerous vectors and expression systems are commercially available, such as from Novagen (Madison, WI), Clontech (Palo Alto, CA), Stratagene (La Jolla, CA), and Invitrogen/Life Technologies (Carlsbad, CA). The present invention comprehends recombinant vectors that may include viral vectors, bacterial vectors, protozoan vectors, DNA vectors, or recombinants thereof.

Heterologous Nucleic Acid Sequence

As used herein, the term "heterologous nucleic acid" refers to a genotypically distinct entity from that of the rest of the entity to which it is compared or into which it is introduced or incorporated. For example, a polynucleotide introduced by genetic engineering techniques into a different cell type is a heterologous polynucleotide (e.g., DNA or RNA) and, if expressed, can encode a heterologous polypeptide. Similarly, a cellular sequence (e.g., a gene or portion thereof) that is incorporated into a viral vector is a heterologous nucleotide sequence with respect to the vector. In some embodiments, the heterologous sequence inserted into the wild-type retron regions does not naturally insert into such regions (e.g., the engineered retron with the inserted heterologous sequence is not naturally existing). For example, the heterologous sequence can be from the same species of bacteria in which the wild-type retron is normally found, so long as the heterologous sequence is not naturally inserted in the wild-type retron at the location in which the heterologous sequence is inserted. In certain embodiments, the heterologous sequence is a mammalian sequence (e.g., a human sequence), or a reverse complement thereof. Heterologous nucleic acid sequences introduced into retrons can including without limitation guide RNA sequences, HDR donor templates, protein-encoding genes, or non-coding functional RNA elements (e.g., stem-loops, hairpins, and bulges).

Lipid Nanoparticle (LNP)

As used herein, the term "lipid nanoparticle" or LNP refers to a type of lipid particle delivery system formed of small solid or semi-solid particles possessing an exterior lipid layer with a hydrophilic exterior surface that is exposed to the non-LNP environment, an interior space which may aqueous (vesicle like) or non-aqueous (micelle like), and at least one hydrophobic inter-membrane space. LNP membranes may be lamellar or non-lamellar and may be comprised of 1, 2, 3, 4, 5 or more layers. In some embodiments, LNPs may comprise a nucleic acid (e.g. engineered retron) into their interior space, into the inter membrane space, onto their exterior surface, or any combination thereof. In some embodiments, an LNP of the present disclosure comprises an ionizable lipid, a structural lipid, a PEGylated lipid (aka PEG lipid), and a phospholipid. In alternative embodiments, an LNP comprises an ionizable lipid, a structural lipid, a PEGylated lipid (aka PEG lipid), and a zwitterionic amino acid lipid.

Further discuss of liposomes can be found, for example, in Tenchov et al., "Lipid Nanoparticles—From Liposomes to mRNA Vaccine Delivery, a Landscape of Diversity and Advancement," *ACS Nano,* 2021, 15, pp. 16982-17015 (the contents of which are incorporated by reference).

Linker

As used herein, the term "linker" refers to a molecule linking or joining two other molecules or moieties. The linker can be an amino acid sequence in the case of a linker joining two fusion proteins. For example, an RNA-guided nuclease (e.g., Cas12a) can be fused to a retron reverse transcriptase by an amino acid linker sequence. The linker can also be a nucleotide sequence in the case of joining two nucleotide sequences together. For example, in the instant case, a ncRNA at its 5' and/or 3' ends may be linked by a nucleotide sequence linker to one or more guide RNAs. In other embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

Liposomes

As used herein, the term "liposomes" refer to a type of lipid particle delivery system comprising small vesicles that contain at least one lipid membrane surrounding an aqueous inner-nanoparticle space that is generally not derived from a progenitor/host cell. Liposomes are a versatile carrier platform in that they are capable of transporting hydrophobic or hydrophilic molecules, including small molecules, proteins, and nucleic acids into cells. They were the earliest developed generation of nanoscale medicine delivery platform. Numerous liposomal drug formulations have been approved for human medicines, e.g., Doxil, a lipid nanoparticle formulation of the antitumor agent doxorubicin. Further discuss of liposomes can be found, for example, in Tenchov et al., "Lipid Nanoparticles—From Liposomes to mRNA Vaccine Delivery, a Landscape of Diversity and Advancement," ACS Nano, 2021, 15, pp. 16982-17015 (the contents of which are incorporated by reference).

Loop

As used herein, the term "loop" in a polynucleotide refers to a single stranded stretch of one or more nucleotides, such as 2, 3, 4, 5, 6, 7, 8, 9, or 10 nucleotides, wherein the most 5' nucleotide and the most 3' nucleotide of the loop are each linked to a base-paired nucleotide in a stem.

Micelles

As used herein, the term "micelles" refer to small particles which do not have an aqueous intra-particle space.

Nanoparticle

As used herein, the term "nanoparticle" refers to any nanoscale particle typically ranging in size from about 1 nm to 1000 nm.

Nuclear Localization Sequence (NLS)

As used herein, the term "nuclear localization sequence" or "NLS" refers to an amino acid sequence that promotes import of a protein (e.g., a RNA-guided nuclease) into the cell nucleus, for example, by nuclear transport. Nuclear localization sequences are known in the art. For example, NLS sequences are described in Plank et al., international PCT application, PCT/EP2000/011690, filed Nov. 23, 2000, published as WO/2001/038547 on May 31, 2001, the contents of which are incorporated herein by reference for its disclosure of exemplary nuclear localization sequences.

Nucleic Acid

As used herein, the term "nucleic acid" or "nucleic acid molecule" or "nucleic acid sequence" or "polynucleotide" generally refer to deoxyribonucleic or ribonucleic oligonucleotides in either single- or double-stranded form. The term may also encompass oligonucleotides containing known analogues of natural nucleotides. The term also may also encompass nucleic acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. The term encompasses both ribonucleic acid (RNA) and DNA, including cDNA (including RT DNA), genomic DNA, synthetic, synthesized (e.g., chemically synthesized) DNA, and/or DNA (or RNA) containing nucleic acid analogs. The nucleotides Adenine (A), Thymine (T), Guanine (G) and Cytosine (C) also may (or may not) encompass nucleotide modifications, e.g., methylated and/or hydroxylated nucleotides, e.g., Cytosine (C) encompasses 5-methylcytosine and 5-hydroxymethylcytosine.

Nucleic Acid-Guided Nuclease

As used herein, the term "nucleic acid-guided nuclease" or "nucleic acid-guided endonuclease" refers to a nuclease that associates covalently or non-covalently with a guide nucleic acid (e.g., a guide RNA or a guide DNA) thereby forming a complex between the guide nucleic acid and the nucleic acid-guided nuclease. The guide nucleic acid comprises a spacer sequence which comprises a nucleotide sequence having complementarity with a strand of a target DNA sequence. Thus, the nucleic acid-guided nuclease is indirectly guided or programmed to localize to a specific site in a DNA molecule through its association with the guide nucleic acid, which directly binds or anneals to a strand of the target DNA through its complementarity region via Watson-Crick base-pairing. In some embodiments, the nucleic acid-guided nuclease will include a DNA-binding activity (e.g., as in the case for CRISPR Cas9). Most commonly, the nucleic acid-guided nuclease is programmed by associating with a guide RNA molecule and in such cases the nuclease may be called "RNA-guided nuclease." When programmed by a guide DNA, the nuclease may be called a "DNA-guided nuclease." Nucleic acid-guided, RNA-guided, or DNA-guided nucleases may also be referred to as "programmable nucleases," which also include other classes of programmable nucleases which associate with specific DNA sequences through amino acid/nucleotide sequence recognition (e.g., zinc fingers nucleases (ZFN) and transcription activator like effector nucleases (TALEN)) rather than through guide RNAs. In addition, any nuclease contemplated herein may also be engineered to remove, inactivate, or otherwise eliminate one or more nuclease activities (e.g., by introducing a nuclease-inactivating mutation in the active site(s) of a nuclease). A nuclease that has been modified to remove, inactivate, or otherwise eliminate all nuclease activity may be referred to as a "dead" nuclease. A dead nuclease is not able to cut either strand of a double-stranded DNA molecule. A nuclease that has been modified to remove, inactivate, or otherwise eliminate at least one nuclease activity but which still retains at least one nuclease activity may be referred to as a "nickase" nuclease. A nickase nuclease cuts one strand of a double-stranded DNA molecule, but not both strands. For example, a CRISPR Cas9 naturally comprises two distinct nuclease activity domains, namely, the HNH domain and the RuvC domain. The HNH domain cuts the strand of DNA bound to the guide RNA and the RuvC domain cuts the protospacer strand. One can obtain a nickase Cas9 by inactivating either the HNH domain or the RuvC domain. One can obtain a dead Cas9 by inactivating both the HNH domain and the RuvC domain. Other RNA-guided nuclease may be similarly converted to nickases and/or dead nucleases by inactivating one or more of the existing nuclease domains.

Operably Linked

As used herein, the term "operably linked" or "under transcriptional control," when used in conjunction with the description of a promoter, refers to the correct location and orientation in relation to a polynucleotide (e.g., a coding sequence) to control the initiation of transcription by RNA polymerase and expression of the coding sequence, such as one for the msr gene, msd gene, and/or the ret gene. Other transcriptional control regulatory elements (e.g., enhancer sequences, transcription factor binding sites) may also be operably linked to a gene if their location relative to a gene controls or regulates the expression of the gene.

Programmable Nuclease

As used herein, the term "programmable nuclease" is meant to refer to a polypeptide that has the property of selective localization to a specific desired nucleotide sequence target in a nucleic acid molecule (e.g., to a specific gene target) due to one or more targeting functions. Such targeting functions can include one or more DNA-binding domains, such as zinc finger domains characteristic of many different types of DNA binding proteins or TALE domains characteristic of TALEN proteins. Such targeting function may also include the ability to associate and/or form a complex with a guide RNA, which then localizes to a specific site on the DNA which bears a sequence that is complementary to a portion of the guide RNA (i.e., the spacer of the guide RNA). In some embodiments, the programmable nuclease may be a single protein which comprises both a domain that binds directly (e.g., a ZF protein) or indirectly (e.g., an RNA-guided protein) to a target DNA site, as well as a nuclease domain. In other embodiments, the programmable nuclease may be a composite of two or more separate proteins or domains (from different proteins) which together provide the necessary functions of selective DNA binding and nuclease activity. For example, the programmable nuclease may comprise a (a) nuclease-inactive RNA-guided nuclease (which still is capable of binding a guide RNA, localizing to a target DNA, and binding to the target DNA, but not capable of cutting or nicking the strands) fused to a (b) nuclease protein or domain, such as a FokI nuclease.

Promoter

As used herein, the term "promoter" is art-recognized and refers to a nucleic acid molecule with a sequence recognized by the cellular transcription machinery and which is able to initiate transcription of a downstream gene. A promoter can be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. Within the promoter sequence will be found a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive expression by the various vectors of the present disclosure.

Recombinant Nucleic Acid

A "recombinant nucleic acid" or "recombinant nucleotide" refers to a molecule that is constructed by joining nucleic acid molecules, which optionally may self-replicate in a live cell.

Retron

As used herein, the term "retron" refers to a specific type of naturally-occurring and distinct DNA sequence found in the genome of many bacteria which typically encodes three distinct components, namely, (a) a non-coding RNA ("ncRNA") (comprising contiguous inverted sequences (msr and msd), (b) a reverse transcriptase (RT)-coding gene (ret), and (c) in many cases, a retron-associated gene of unknown function. Retrons are particularly defined by their unique ability to produce a satellite DNA known as msDNA (multicopy single-stranded DNA). The ncRNA (comprising the msr and msd elements) and the ret gene are transcribed as a single polycistronic RNA transcript which processed into the ncRNA transcript and a transcript encoding the ret gene. The ncRNA then becomes folded into a specific secondary structure. Once translated, the RT then binds the folded ncRNA and reverse transcribes the msd region to form a single strand of cDNA (the msDNA) that remains covalently attached to the RNA template via a 2'-5' phosphodiester bond and base-pairing between the 3' ends of the msDNA and the RNA template. See FIG. 1A which provides a schematic of the production of an msDNA from a naturally-occurring retron.

Retron Component

As used herein, the term "retron component" refers to a distinct element or feature of a retron, namely (a) a non-coding RNA ("ncRNA") (comprising contiguous inverted sequences (msr and msd), (b) a reverse transcriptase (RT)-coding gene (ret), and (c) in many cases, a retron-associated gene of unknown function.

RNA-Guided Nuclease

As used herein, an "RNA-guided nuclease" is a type of "programmable nuclease," and a specific type of "nucleic acid-guided nuclease." As used herein, the term "RNA-guided nuclease" or "RNA-guided endonuclease" refers to a nuclease that associates covalently or non-covalently with a guide RNA thereby forming a complex between the guide RNA and the RNA-guided nuclease. The guide RNA comprises a spacer sequence which comprises a nucleotide sequence having complementarity with a strand of a target DNA sequence. Thus, the RNA-guided nuclease is indirectly guided or programmed to localize to a specific site in a DNA molecule through its association with the guide RNA, which directly binds or anneals to a strand of the target DNA through its complementarity region via Watson-Crick base-pairing.

Sequence Identity

As used herein, the term "sequence identity" refers to the overall relatedness between polymeric molecules, e.g., between polynucleotide molecules (e.g., DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). For example, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna. CMP matrix. Methods commonly employed to determine percent identity between sequences include, but are not limited to those disclosed in Carillo, H. and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., Nucleic Acids Research, 12(1), 387 (1984)), BLASTP, BLASTN, and FASTA Altschul, S. F. et al., J. Molec. Biol., 215, 403 (1990).

Subject

As used herein, the term"subject" refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development. The terms "individual," "subject," "host," and "patient," used interchangeably herein.

Stem

As used herein, the term "stem" refers to two or more base pairs, such as 3, 4, 5, 6, 7, 8, 9, 10, 11, 12, 13, 14, 15, 16, 17, 18, 19, 20 or more base pairs, formed by inverted repeat sequences connected at a "tip," where the more 5' or "upstream" strand of the stem bends to allows the more 3' or "downstream" strand to base-pair with the upstream strand. The number of base pairs in a stem is the "length" of the stem. The tip of the stem is typically at least 3 nucleotides, but can be 4, 5, 6, 7, 8, 9, 10, 11, 12, 13, 14, 15 or more nucleotides. Larger tips with more than 5 nucleotides are also referred to as a "loop." An otherwise continuous stem may be interrupted by one or more bulges as defined herein. The number of unpaired nucleotides in the bulge(s) are not included in the length of the stem. The position of a bulge closest to the tip can be described by the number of base pairs between the bulge and the tip (e.g., the bulge is 4 bps from the tip). The position of the other bulges (if any) further away from the tip can be described by the number of base pairs in the stem between the bulge in question and the tip, excluding any unpaired bases of other bulges in between.

Synthetic or Artificial Nucleic Acid

A "synthetic or artificial nucleic acid" refers nucleic acids that are non-naturally occurring sequences. Such sequences do not originate from, or are not known to be present in any living organism (e.g., based on sequence search in existing sequence databases). Recombinant nucleic acids and synthetic nucleic acids also include those molecules that result from the replication of either of the foregoing. Engineered nucleic acid constructs of the present disclosure, such as the engineer ed retron described herein, may be encoded by a single molecule (e.g., encoded by or present on the same plasmid or other suitable vector) or by multiple different molecules (e.g., multiple independently-replicating vectors).

Target Site

As used herein, a "target site" as used herein is a polynucleotide (e.g., DNA such as genomic DNA) that includes a site or specific locus ("target site" or "target sequence") targeted by a recombinant retron genome modification system disclosed herein. In the context of retron genome modification systems disclosed herein that comprise an RNA-guided nuclease, a target sequence is the sequence to which the guide sequence of a guide nucleic acid (e.g., guide RNA) will hybridize. For example, the target site (or target sequence) 5'-GTCAATGGACC-3' (SEQ ID NO:19145) within a target nucleic acid is targeted by (or is bound by, or hybridizes with, or is complementary to) the sequence 5'-GGTCCATTGAC-3'(SEQ ID NO:19146). Suitable hybridization conditions include physiological conditions normally present in a cell. For a double stranded target nucleic acid, the strand of the target nucleic acid that is complementary to and hybridizes with the guide RNA is referred to as the "complementary strand" or "target strand"; while the strand of the target nucleic acid that is complementary to the "target strand" (and is therefore not complementary to the guide RNA) is referred to as the "non-target strand" or "non-complementary strand."

Treatment

As used herein, the terms"treatment," "treat," and"treating," refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Upstream and Downstream

As used herein, the terms "upstream" and "downstream" are terms of relativity that define the linear position of at least two elements located in a nucleic acid molecule (whether single or double-stranded) that is orientated in a 5'-to-3' direction. A first element is said to be upstream of a second element in a nucleic acid molecule where the first element is positioned somewhere that is 5' to the second element. Conversely, a first element is downstream of a second element in a nucleic acid molecule where the first element is positioned somewhere that is 3' to the second element.

Variant

As used herein the term"variant" should be taken to mean the exhibition of qualities that have a pattern that deviates from what occurs in nature, e.g., a variant retron RT is retron RT comprising one or more changes in amino acid residues as compared to a wild type retron RT amino acid sequence. The term"variant" encompasses homologous proteins having at least 75%, or at least 80%, or at least 85%, or at least 90%, or at least 95%, or at least 99% percent identity with a reference sequence and having the same or substantially the same functional activity or activities as the reference sequence. The term also encompasses mutants, truncations, or domains of a reference sequence, and which display the same or substantially the same functional activity or activities as the reference sequence.

Vector

As used herein, the term "vector" permits or facilitates the transfer of a polynucleotide from one environment to another. It is a replicon such as a plasmid, phage, or cosmid into which another DNA segment may be inserted so as to bring about the replication of the inserted segment (e.g., the subject engineered retron). Generally, a vector is capable of replication when associated with the proper control elements. The term "vector" may include cloning and expression vectors, as well as viral vectors and integrating vectors.

Wild Type

As used herein the term "wild type" is a term of the art understood by skilled persons and means the typical form of an organism, strain, gene, protein, or characteristic as it occurs in nature as distinguished from mutant or variant forms.

DETAILED DESCRIPTION

The present disclosure provides systems, methods and compositions used for precise genome editing, including installing nucleic acid insertions, replacements, and deletions at targeted and precise genome sites, wherein said systems, methods, and compositions are based on novel and/or modified retrons or components thereof, such as modified versions of the retron RTs of Table X, modified versions of the ncRNAs of Table A, and modified versions of the RTs of Table B.

In one aspect, the present disclosure provides recombinant retrons comprising one or more genetic modifications which improves the functionality and/or properties of a retron. Such genetic modifications can include a mutation, insertion, deletion, inversion, replacement, substitution, or translocation of one or more contiguous or non-contiguous nucleobases in a nucleic acid molecule encoding a retron or a component of a retron, such as an ncRNA or a reverse transcriptase. In various aspects, the retron that becomes modified with the one or more genetic modifications (i.e., the "pre-modified" or "unmodified" retron or retron component) is a naturally occurring retron or retron component (e.g., naturally occurring ncRNA of Table A or RT) ability to facilitate homology-dependent recombination (or HDR) in a cell, thereby resulting in a relative increase in the concentrations or amounts of msDNA comprising a DNA donor template. In particular embodiments, the recombinant retrons are based on and/or derived from a naturally-occurring retron, such as any retron-related sequence provided by Table X (the introduction of the one or more genetic modifications into a set of 7257 previously unknown retrons discovered through computational methods described herein (e.g., see Examples). In other embodiments, the recombinant retrons are based on introducing the one or more genetic modifications into previously available retron sequences (e.g., the "Mestre et al., *Systematic Prediction of Genes Functionally Associated with Bacterial Retrons and Classification of The Encoded Tripartite Systems*, Nucleic Acids Research, Volume 48, Issue 22, 16 Dec. 2020, Pages 12632-12647" (incorporated herein by reference) to achieve recombinant retrons with the enhanced ability to produce increased concentrations or amounts of msDNA comprising a DNA donor template.

In another aspect, the present disclosure further provides nucleic acid molecules encoding the recombinant retrons and/or recombinant retron components (e.g., a recombinant ncRNA and/or a recombinant retron RT). In still another aspect, the present disclosure provides genome editing systems comprising recombinant retron components (e.g., recombinant ncRNA and/or recombinant RT), programmable nucleases (e.g., RNA-guided nucleases, such as CRISPR-Cas proteins, ZFPs, and TALENS), and guide RNAs (in the case where RNA-guide nucleases are used in said genome editing systems). In a further aspect, the disclosure provides nucleic acid molecules encoding the described genome editing systems and said components thereof, as well as polypeptides making up the components of said genome editing systems. In yet another aspect, the disclosure provides vectors for transferring and/or expressing said genome editing systems, e.g., under in vitro, ex vivo, and in vivo conditions. In still another aspect, the disclosure provides cell-delivery compositions and methods, including compositions for passive and/or active transport to cells (e.g., plasmids), delivery by virus-based recombinant vectors (e.g., AAV and/or lentivirus vectors), delivery by non-virus-based systems (e.g., liposomes and LNPs), and delivery by virus-like particles. Depending on the delivery system employed, the retron-based genome editing systems described herein may be delivered in the form of DNA (e.g., plasmids or DNA-based virus vectors), RNA (e.g., ncRNA and mRNA delivered by LNPs), a mixture of DNA and RNA, protein (e.g., virus-like particles), and ribonucleoprotein (RNP) complexes. Any suitable combinations of approaches for delivering the components of the herein disclosed retron-based genome editing systems may be employed. In one embodiment, each of the components of the retron-based genome editing system is delivered by an all-RNA system, e.g., the delivery of one or more RNA molecules (e.g., mRNA and/or ncRNA) by one or more LNPs, wherein the one or more RNA molecules form the ncRNA and guide RNA (as needed) and/or are translated into the polypeptide components (e.g., the RT and a programmable nuclease). In yet another aspect, the disclosure provides methods for genome editing by introducing a retron-based genome editing system described herein into a cell (e.g., under in vitro, in vivo, or ex vivo conditions) comprising a target edit site, thereby resulting in an edit at the target edit. In other aspects, the disclosure provides formulations comprising any of the aforementioned components for delivery to cells and/or tissues, including in vitro, in vivo, and ex vivo delivery, recombinant cells and/or tissues modified by the recombinant retron-based genome modification systems and methods described herein, and methods of modifying cells by conducting genome editing and related DNA donor-dependent methods, such as recombineering, or cell recording, using the herein disclosed retron-based genome modification systems. The disclosure also provides methods of making the recombinant retrons, retron-based genome modification systems, vectors, compositions and formulations described herein, as well as to pharmaceutical compositions and kits for modifying cells under in vitro, in vivo, and ex vivo conditions that comprise the herein disclosed genome editing and/or modification systems.

Described herein are engineered retrons comprising one or more heterologous nucleic acids. The one or more heterologous nucleic acids may be inserted, for example, at or within a location selected from: the msd locus, upstream of the msr locus, upstream of the msd locus, and downstream of the msd locus. In some embodiments, the engineered retrons have structural improvements over their naturally existing counterparts or wild-type retrons at least with respect to the encoded ncRNA and/or the reverse transcriptase (RT), such that the engineered retron or the encoded ncRNA thereof, when delivered to a host cell, such as a mammalian host cell, exhibits various functional improvements over its naturally existing/wild-type retron elements.

Exemplary (non-limiting functional improvements) may include any one or more of the features described herein. For example, in some embodiments, the engineered retron may comprise a sequence modification (e.g., insertion, deletion, and/or substitution of one or more nucleotide(s)) in the msr locus and/or the msd locus that: i) modulates (e.g., enhances) reverse transcription, processivity, accuracy/fidelity, and/or production of the msDNA (e.g., in the mammalian cell); ii) modulates (e.g., reduces) immunogenicity of the ncRNA encoded by the engineered retron (e.g., encoded by the msr locus and/or the msd locus) in a host (e.g., a host comprising the mammalian cell); iii) comprises a nucleotide sequence that modulates (e.g., inhibits or antagonizes) a function of the msDNA; and/or iv) modulates (e.g., improves) efficiency of targeted genomic engineering.

Thus, in general, the engineered retron is an engineered nucleic acid construct comprising: a) a first polynucleotide encoding a non-coding RNA (ncRNA), said first polynucleotide comprising: i) an msr locus encoding the msr RNA portion of a multi-copy single-stranded DNA (msDNA); and ii) an msd locus encoding the msd RNA portion of the msDNA; and b) one or more heterologous nucleic acids inserted at or within a location selected from: the msd locus, upstream of the msr locus, upstream of the msd locus, and downstream of the msd locus.

The engineered nucleic acid construct (e.g., the engineered retron) may further comprise a second polynucleotide encoding a reverse transcriptase (RT), or a portion thereof, wherein the encoded RT is capable of synthesizing a DNA copy of at least a portion of the msd locus encoding the msDNA.

In certain embodiments, the engineered retron of the invention encodes a reverse transcriptase (RT) or a functional domain thereof, comprising: i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or ii) a polypeptide listed in any one of Table C. In some embodiments, the RT does not comprise a polypeptide listed in Table X.

In certain embodiments, the engineered retron of the invention encodes a reverse transcriptase (RT) or a functional domain thereof, comprising: i) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A; and/or ii) a consensus polynucleotide sequence listed in Table C. In some embodiments, the polynucleotide encoding the RT does not comprise a polynucleotide of Table X.

In certain embodiments, the engineered retron of the invention encodes an ncRNA comprising: (I) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA in Table B.

In certain embodiments, the engineered retron of the invention encodes an ncRNA and a reverse transcriptase (RT) or a functional domain thereof, wherein the ncRNA and the RT or functional domain thereof are as described above.

Specifically, in such embodiment, the ncRNA may comprise: (I) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B.

Also in such embodiment, the reverse transcriptase (RT) or functional domain thereof comprises: (A) i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or ii) a polypeptide listed in Table C; optionally, the RT does not comprise a polypeptide listed in Table X; OR (B) i) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide in Table A; and/or optionally, the polynucleotide encoding the RT does not comprise a polynucleotide in Table X.

In certain embodiments, the engineered nucleic acid construct comprises: 1) an msr locus (that encodes the msr RNA portion of an msDNA); 2) an msd locus encoding the msd RNA portion of the msDNA; 3) a sequence encoding a retron reverse transcriptase (RT), wherein said msd RNA is capable of being reverse transcribed to form the msDNA by the retron reverse transcriptase (RT); and, 4) a heterologous nucleic acid inserted at or within the msd locus, upstream of the msr locus, upstream or downstream of the msd locus; wherein the engineered nucleic acid construct is engineered based on and/or to resemble a secondary structure of a wild-type or consensus retron encoding a wild-type or consensus retron ncRNA encompassed by: a) any one of the sequences and/or structures as depicted in any one of SEQ ID NOs: of Table B and/or FIGS. 2-27 (SEQ ID NO:19191-19216); or b) a variant of a), having: i) up to 1, 2, or 3 (e.g., up to 1) nucleotide changes per 10 red lettered-nucleotides; ii) up to 4, 5, or 6 (e.g., up to 1 or 2) nucleotide changes per 10 black lettered-nucleotides; and/or iii) up to 7, 8, or 9 (e.g., up to 3 or 4) nucleotide changes per 10 grey lettered-nucleotides; and/or optionally further comprising: i) 7, 8, 9, or 10 (e.g., 9 or 10) nucleotides present per 10 red-circled nucleotides; ii) 6, 7, 8, 9, or 10 (e.g., 8, 9 or 10) nucleotides present per 10 black-circled nucleotides; iii) 4, 5, 6, 7, 8, 9, or 10 (e.g., 6, 7, 8, 9 or 10) nucleotides present per 10 grey-circled nucleotides; and/or iv) 2, 3, 4, 5, 6, 7, 8, 9, or 10 (e.g., 4, 5, 6, 7, 8, 9, or 10) nucleotides present per 10 white-circled nucleotides; wherein the ncRNA does not comprise an ncRNA associated with the sequences of Table X.

The engineered nucleic acid construct (e.g., the engineered retron) may comprise one or more sequence modifications (e.g., an insertion, deletion, and/or substitution of one or more nucleotide(s)) in the msr locus and/or the msd locus that: a) modulates (e.g., enhances) reverse transcription, processivity, accuracy/fidelity, and/or production of the msDNA (e.g., in the mammalian cell); b) modulates (e.g., reduces) immunogenicity of ncRNA encoded by the engineered retron (e.g., the msr locus and/or the msd locus) in a host (e.g., a host comprising the mammalian cell); c) modulates (e.g., inhibits, either permanently or transiently) a function of the msDNA; and/or d) modulates (e.g., improves) efficiency of targeted genome editing/engineering.

In some embodiments, the engineered nucleic acid construct (e.g., the engineered retron) is engineered based on and/or to resemble a secondary structure of a wild-type or consensus retron encoding a wild-type or consensus retron ncRNA encompassed by: a) the sequence of any one of Table B ncRNA sequences and/or the structure depicted in any one of FIGS. 2-27 (SEQ ID NO:19191-19216); or b) a variant of a), having: i) up to 1, 2, or 3 (e.g., up to 1) nucleotide changes per 10 red lettered-nucleotides; ii) up to 4, 5, or 6 (e.g., up to 1 or 2) nucleotide changes per 10 black lettered-nucleotides; and/or iii) up to 7, 8, or 9 (e.g., up to 3 or 4) nucleotide changes per 10 grey lettered-nucleotides; and/or optionally further comprising: i) 7, 8, 9, or 10 (e.g., 9 or 10) nucleotides present per 10 red-circled nucleotides; ii) 6, 7, 8, 9, or 10 (e.g., 8, 9 or 10) nucleotides present per 10 black-circled nucleotides; iii) 4, 5, 6, 7, 8, 9, or 10 (e.g., 6, 7, 8, 9 or 10) nucleotides present per 10 grey-circled nucleotides; and/or iv) 2, 3, 4, 5, 6, 7, 8, 9, or 10 (e.g., 4, 5, 6, 7, 8, 9, or 10) nucleotides present per 10 white-circled nucleotides.

Another aspect of the disclosure provides a vector system comprising a vector comprising the engineered retron described herein.

Another aspect of the disclosure provides an isolated host cell comprising the engineered retron described herein, or the vector system described herein.

Another aspect of the disclosure provides a pharmaceutical composition comprising the engineered retron described herein, or the vector system described herein.

Another aspect of the disclosure provides a delivery vehicle comprising the engineered retron described herein or the ncRNA encoded by the engineered retron described herein, the vector or vector system described herein, the host cell described herein, or the pharmaceutical composition described herein.

Another aspect of the disclosure provides a kit comprising the engineered retron described herein or the ncRNA encoded by the engineered retron described herein, and optionally instructions for genetically modifying a cell using the engineered retron described herein or the ncRNA encoded by the engineered retron described herein.

Another aspect of the disclosure provides a method of modifying a target DNA sequence in a host cell (e.g., a mammalian cell), the method comprising introducing into the host cell (e.g., the mammalian cell) the engineered retron of the invention, the ncRNA encoded by the engineered retron of the invention, or the vector/vector system described herein, to allow the production of the msDNA in the host cell (e.g., mammalian cell), wherein at least a part of the heterologous nucleic acid in the msDNA is integrated into the genome of the host (e.g., mammalian) cell at the target DNA sequence. Optionally, the target sequence is recognized by a suitable nuclease, such as a CRISPR/Cas effector enzyme, a ZFN, a TALEN, a meganuclease, TnpB, IscB, or a restriction endonuclease (RE), and a double-stranded break (DSB) is created by the nuclease to facilitate/promote the insertion of the part of the heterologous nucleic acid into the target sequence. Further optionally, the target sequence modified/inserted by the part of the heterologous nucleic acid can no longer be recognized by the nuclease to re-create a DSB.

Another aspect of the disclosure provides a use of the engineered retron in the various methods described herein.

Another aspect of the disclosure provides a genome editing system comprising: a) nuclease capable of acting at a target site on a genome (e.g. human genome), such as a CRISPR/Cas effector enzyme, a ZFN, a TALEN, a meganuclease, TnpB, IscB, or a restriction endonuclease (RE); and b) an engineered retron described herein, or an ncRNA encoded thereby, or a vector or a vector system comprising or encoding the same. Optionally, the nuclease may be linked to one or more element(s) of the engineered retron or the encoded ncRNA. For example, in one embodiment, the nuclease may be linked (e.g., fused or conjugated) to the reverse transcriptase of the engineered retron described herein. In another embodiment, the nuclease may engage/bind to form a complex with a nucleic acid guide sequence (such as a single-guided RNA of a Cas enzyme), wherein the guide sequence is linked to the ncRNA and/or msDNA of the engineered retron described herein.

Another aspect of the disclosure provides an enhanced genome editing system, comprising the genome editing system of the disclosure connected to a biomolecule that modulates host DNA repair, in order to, for example, modulate (e.g., enhance) the incorporation of the heterologous nucleic acid sequence into a genome (e.g., human genome).

With the general aspect of the disclosure described herein, specific aspects and embodiments of the disclosure are further described in the sections below. It should be understood that any one embodiment of the disclosure, including those described only in the examples or the claims, or only in one section herein below, can be combined with any one or more additional embodiments of the invention, unless such combination is expressly disclaimed or are improper.

A. Recombinant Retrons

The present disclosure provides engineered retrons, as well as compositions, systems, and methods that include or utilize the engineered retrons for genome modification, such as genome editing, cell recording, and recombineering.

Retrons were originally discovered in 1984 in *Myxococcus xanthus* bacterium when a short, multi-copy single-stranded DNA (msDNA) that is abundantly present in the bacterial cell was identified. Since then, a number of naturally existing retrons have been found in many prokaryotes such as bacteria.

As depicted in FIG. 1A, retrons encode and transcribe as a single RNA, which comprises a non-coding RNA (ncRNA) portion and a portion encoding a specialized reverse transcriptase (RT). The retron ncRNA (msr and msd) is the precursor of the hybrid molecule that eventually forms, and it initially folds into a typical RNA secondary structure that is recognized by the accompanying RT. The translated RT typically recognizes certain secondary structures in the ncRNA, and binds the RNA template downstream from the msd region. The RT initiates reverse transcription of the RNA towards its 5' end, starting from the 2'-end of a conserved guanosine (G) residue found immediately after a double-stranded RNA structure (the a1/a2 region) within the ncRNA. A portion of the ncRNA serves as a template for reverse transcription, and reverse transcription terminates before reaching the msr locus. During reverse transcription, cellular RNase H degrades the segment of the ncRNA that serves as template, but not other parts of the ncRNA. The result of the reverse transcription, the msDNA, remains covalently attached to the RNA template via the 2'-5' phosphodiester bond, and base-pairs with the RNA template using the 3' end of the msDNA. See FIG. 1A for a general or typical organization of the retron coding sequence, including the RT encoding sequence and the msr and msd loci, as well as the synthesis of the msDNA by reverse transcription of the initial ncRNA transcript.

Many retrons also contain an accessory protein (not depicted in FIG. 1A), which may have a variable function that may not be fully understood. In certain embodiments, the engineered retrons described herein do not comprise the accessory protein naturally associated with the wild-type or template retron.

Applicant has discovered, analyzed, and phylogenetically classified 7257 previously unknown retrons from nature based on multiple criteria, including sequence homology and conserved predicted secondary structures, and has grouped these retrons into different phylogenetic clades based on sequence homology and/or conserved predicted secondary structures. These clades include Type IA_IIA1 (FIG. 2), Type 1B1 (FIG. 3), Type IB2 (FIG. 4), Type 1C (FIG. 5), Type IIA1 other (FIG. 6), Type IIA2 (FIG. 7), Type IIA3 (FIG. 8), Type IIA4 (FIG. 9), Type IIA5 (FIG. 10), Type IIIA1 (FIG. 11), Type IIIA2 (FIG. 12), Type IIIA3 (FIG. 13), Type IIIA4 (FIG. 14), Type IIIA5 (FIG. 15), Type IIIunk (FIG. 16), Type IV (FIG. 1X), Type V (FIG. 19), Type VI (FIG. 20), Type XI Group 1 (FIG. 21), Type XI (Group 2) (FIG. 22), Type XII (FIG. 23), Type XIII (FIG. 24), Type XIV (FIG. 25), Eco107-like (FIG. 26), and Outgroup A (FIG. 27). The disclosure further describes the engineering and/or modification of these newly discovered retron sequences as a starting point to obtain useful recombinant retrons, such as those depicted in FIG. 1B.

Figure 1B:
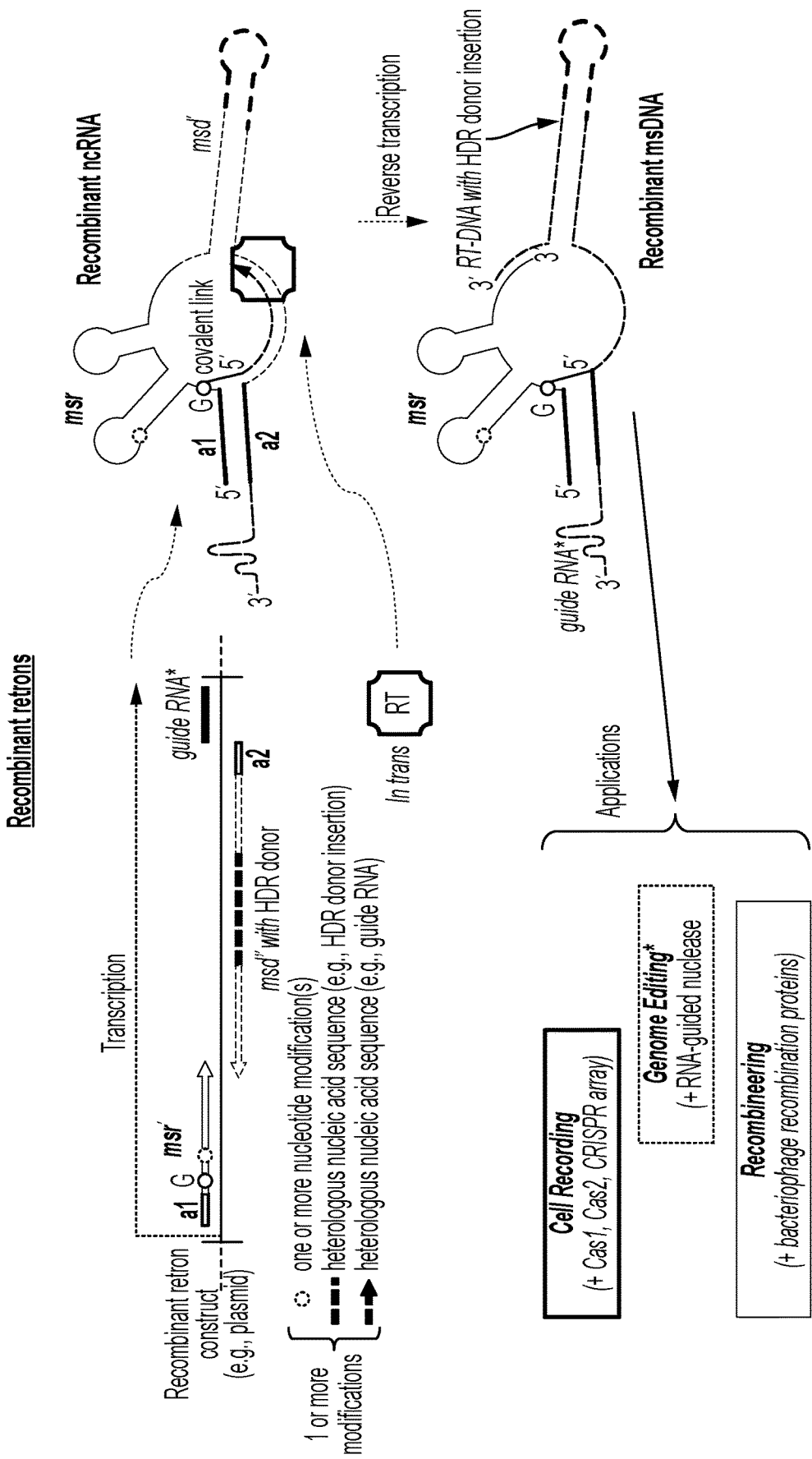
FIG. 1B is a schematic depicting an embodiment of a recombinant retron contemplated by this disclosure. In this embodiment, a nucleic acid molecule comprises a nucleotide sequence encoding a retron ncRNA region (the msr/msd region) is depicted at the top left. The msr region has been modified by introducing one or more nucleotide modifications (e.g., a nucleotide substitution, deletion, or insertion). For example, it may be desirable to introduce one or more nucleotide substitutions in the msr to enhance functionality (e.g., binding of the corresponding ncRNA to RT, improved stability, improved folding, etc.). The modified msr is referred to as msr'. In addition, the msd has been modified by introducing a heterologous nucleotide sequence encoding an HDR donor template. Lastly, the retron DNA has been modified to introduce a nucleotide sequence encoding a guide RNA at the 3' end of the retron DNA sequence. is configured on a DNA vector (e.g., a plasmid). The DNA is shown to be transcribed as a polycistronic message that includes the msr'/msd' region (forming the ncRNA) which is fused at its 3' end to the guide RNA (in other embodiments, the guide RNA could be fused to the 5' end of the retron ncRNA. This intermediate is shown to form a complex with a reverse transcriptase provided in trans (e.g., by way of a separate expression vector or delivered mRNA). The top right schematic shows the formation of a complex between the recombinant ncRNA and the RT and the beginning of reverse transcription from the covalently-linked conserved guanosine (G) (i.e., the "priming G" or "priming guanosine") using the msd RNA as a template sequence. Following the completion of reverse transcription and RNaseH degradation of the template RNA sequence, a recombinant msDNA is formed which comprises three modifications, as shown: (a) a guide RNA linked to the 3' end of the msDNA, (b) a nucleotide change in the msr', and (c) the reverse-transcribed single-strand DNA comprises a region that is an HDR donor template. Such a recombinant msDNA could then facilitate various genome modification applications in the cell, including genome editing with an RNA-guided nuclease provided to the cell in trans.
Figure 1D:
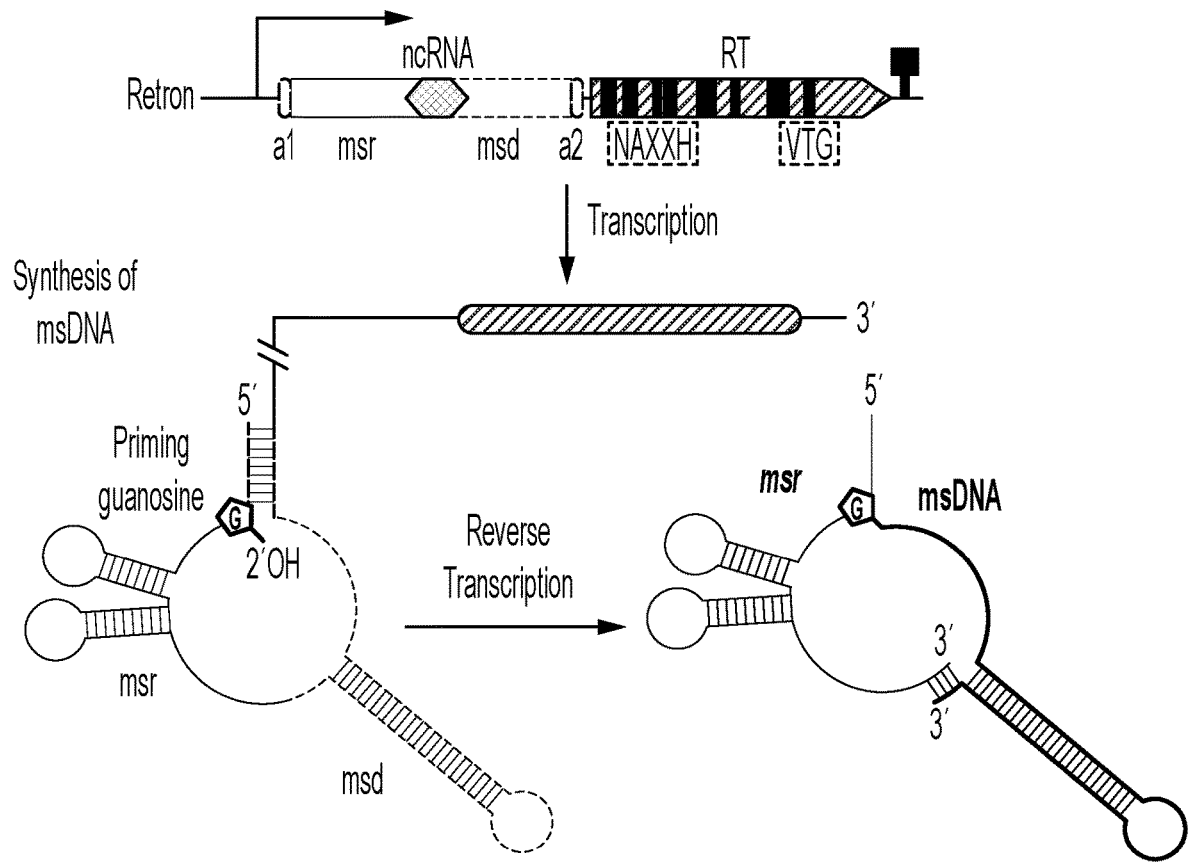
FIG. 1D provides a simplified schematic of a the natural lifecycle of a retron. Retrons typically comprise a reverse transcriptase (RT) and two non-coding contiguous inverted sequences (msr and msd) transcribed as a single RNA that is folded into a specific secondary structure. The conserved NAXXH motif and VTG triplet in retron RTs are indicated. The RT binds downstream from the msd locus in the RNA, initiating reverse transcription of the RNA template towards its 5' end, assisted by the 2'OH group present in a conserved branching G residue acting as a primer. Reverse transcription halts before the msr region is reached, and the resulting msDNA remains covalently attached to the RNA template via a 2'-5' phosphodiester bond and base-pairing of the 3' ends of the molecules.
Figure 1E:
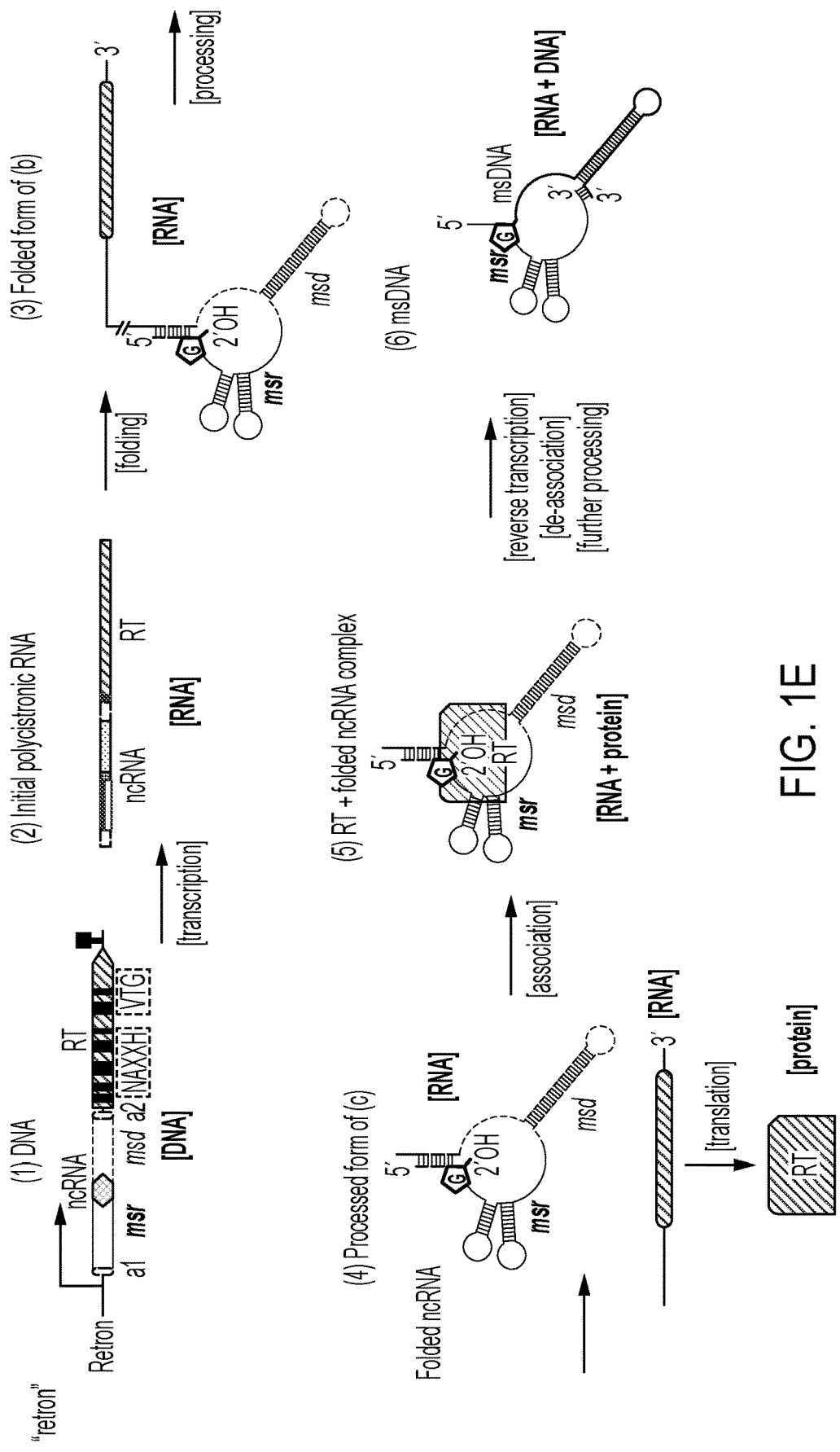
FIG. 1E provides a detailed representation of the natural biological pathway of a retron in a cell, concluding with the generation of the msDNA satellite molecule. This figure parallels FIG. 1D but more completely depicts the stages of msDNA production. (1) depicts the retron locus which includes an ncRNA locus having an msr locus and a msd locus (both of which are non-coding) and a reverse transcriptase (RT) locus. The ncDNA locus and the RT locus are transcribed as a single RNA transcript, which is depicted in (2). The colors representing each component in (1) are carried through each of stages (2) through (6). Stages (3) and (4) depict the folding of the ncRNA portion into a series of stem loops, wherein the 5' end and the 3' ends of the ncRNA form a duplex. In addition, the position of the conserved branching guanosine residue having a 2'OH group is show. The branching guanosine serves as a future priming site for the reverse transcriptase. Stage (4) further shows that the region of the transcript encoding the reverse transcriptase is removed, separately being translated to produce the reverse transcriptas enzyme. In stage (5), the reverse transcriptase associates with the folded ncRNA and begins polymerization of a single strand of DNA (i.e., the reverse transcription product) from the primer site (i.e., the conserved branching guanosine residue having the 2'OH end) and using the msd RNA sequence as a template. Reverse transcription terminates at the msr region. The msd RNA template is exonucleotically removed, thereby resulting in a chimeric molecule comprising the msr RNA region which is covalently joined to the ssDNA transcription product through covalent linkage to the conserved guanosine primer residue. There is also a short duplex region that forms between the 3' end of the msr RNA and the 3' of the ssDNA reverse transcript product. The complete molecule is referred to as the "msDNA."
Figure 1F:
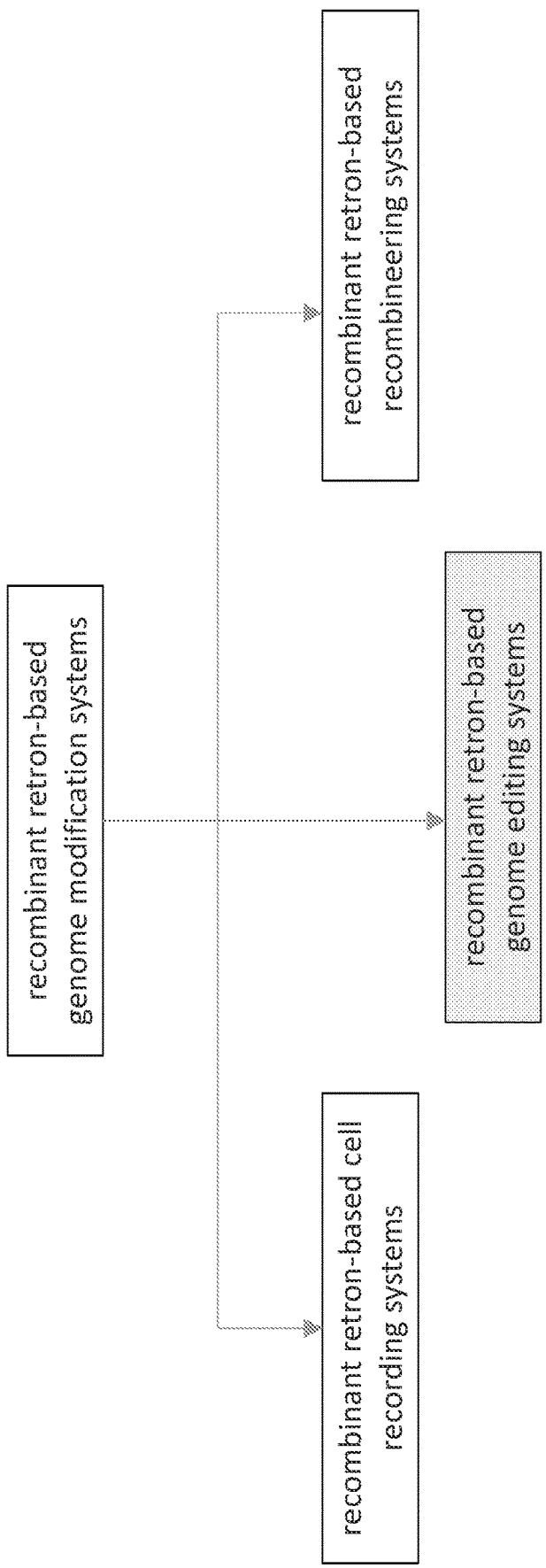
FIG. 1F is a schematic depicting that the herein disclosed recombinant retron-based genome modification systems may be implemented as (a) cell recorder systems, (b) genome editing systems, and (c) recombineering systems. These uses are not intended to be limiting.

FIG. 1B.1 depicts an embodiment of a recombinant retron construct (e.g., a nucleotide sequence cloned into an expression vector) contemplated by the present disclosure. In the top left schematic, the single thin black line represents a double-stranded nucleotide sequence (e.g., as cloned into an expression vector, such as a plasmid). The recombinant retron is constructed by modifying a starting point retron DNA sequence encoding a ncRNA (the msr/msd region) (such as any one of the herein disclosed 7257 newly discovered retron sequences, and specifically any one of the 7257 ncRNA sequences of Table B. A starting point retron DNA sequence encoding an ncRNA may be modified in any number of ways and can including one modification or more than one modification. For example, the retron DNA may modified to contain at least one nucleotide modification, including a single nucleotide substitution, insertion, or deletion, or a substitution, insertion, or deletion of more than one nucleotide, i.e., up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or up to 100, or up to 200, 300, 400, 500, 600, 700, 800, 900, 1000, 1100, 1200, 1300, 1400, 1500, 1600, 1700, 1800, 1900, or up to 2000 nucleotides substituted, inserted, or deleted from a starting point retron (e.g., a wildtype retron). Where more than one nucleotide of a starting point retron (e.g., a wildtype retron) is substituted, deleted, or inserted, the nucleotides may be contiguous or non-contiguous. While an engineered retron as a whole is not naturally-occurring, it may include components such as nucleotide sequences that do occur in nature. For example, an engineered retron can have nucleotide sequences from different organisms (e.g., from different bacteria species), or from completely synthetic/artificial/recombinant nucleic acid sequences. Thus, an engineered retron can have a bacterial nucleotide sequence, a human nucleotide sequence, a viral nucleotide sequence, and/or a synthetic/artificial/recombinant nucleotide sequence, and/or combinations of such sequences. An example of modifications of the recombinant retrons disclosed herein include the insertion of a heterologous nucleic acid sequence in a retron, for example, inserted into the ncRNA locus, such as in the msr or the msd loci. Linking guide RNA molecules to the 5' and/or 3' ends (i.e., linking one at the 5' end of a ncRNA and/or one at the 3' end of a ncRNA) also represents another modification contemplated by the recombinant retrons disclosed herein. In such embodiments, the guide RNA molecules may also be categorized or referred to more generally as types of heterologous nucleic acid sequences used to modify starting point retrons. These modifications are depicted in FIG. 1B.

In addition to the DNA encoding the ncRNA, the DNA encoding the RT may also be modified to obtain a recombinant RT. For example, the RT-encoding DNA may modified to contain at least one nucleotide modification, including a single nucleotide substitution, insertion, or deletion, or a substitution, insertion, or deletion of more than one nucleotide, i.e., up to 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or up to 100, or up to 200, 300, 400, 500, 600, 700, 800, 900, 1000, 1100, 1200, 1300, 1400, 1500, 1600, 1700, 1800, 1900, or up to 2000 nucleotides substituted, inserted, or deleted from a starting point retron (e.g., a wildtype retron) within the RT gene.

Such modifications to the DNA encoding ncRNA and/or RT may modulate the function of the ncRNA and/or RT in various ways, including i) modulating (e.g., enhancing) reverse transcription, processivity, accuracy/fidelity, and/or production of the msDNA (e.g., in the mammalian cell); ii) modulating (e.g., reducing) immunogenicity of ncRNA (msr locus and msd locus) encoded by the engineered retron in a host (e.g., a host comprising the mammalian cell); iii) modulating (e.g., inhibits, either permanently or transiently) a function of the msDNA; and/or iv) modulating (e.g., improving) efficiency of targeted genome editing/engineering.

In one embodiment, the present disclosure provides recombinant retrons having the general structure of: a) an msr locus; b) an msd locus encoding the msd RNA portion of the msDNA; c) a sequence encoding a retron reverse transcriptase (RT) (optionally in trans to the ncRNA), wherein the msd RNA is capable of being reverse transcribed (e.g., in a host cell such as a mammalian cell) to form an msDNA by the retron reverse transcriptase (RT); d) a heterologous nucleic acid (e.g., heterologous DNA) capable of being transcribed with the msr locus and/or the msd locus, optionally, the heterologous nucleic acid is inserted at or within the msd locus, upstream of the msr locus, upstream or downstream of the msd locus.

The engineered retrons of the invention are optionally structurally further modified to include one or more heterologous nucleic acids. The engineered retron may be further modified to provide various functional improvements, such as (without limitation), to enhance the production of msDNA in a cell (e.g., a mammalian cell, including a human cell).

In certain embodiments, the disclosure provides engineered retrons based on their conserved predicted secondary structures, such as those in FIGS. 2-27 (SEQ ID NO:19191-19216).

In other embodiments, the disclosure provides engineered retrons based on their sequence identity. Exemplary RT amino acid sequences and ret gene nucleic acid sequences are provided in Table A. Exemplary RT consensus amino acid sequences and/or ret gene nucleic acid sequences are provided in Table C. Exemplary ncRNA sequences are provided in Table B.

Retron sequences provisioned out of the scope of the invention are provided in Table X.

In certain embodiments, exemplary engineered retrons of the invention (1) are engineered based on or engineered to resemble the secondary structures as depicted in any one of FIGS. 2-27 (SEQ ID NO:19191-19216), and/or (2) are provided in Table B. Sequences with significant sequence percentage identity (e.g., at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity) are also within the scope of the invention.

In certain embodiments, the engineered nucleic acid construct comprises: 1) an msr locus (that encodes the msr RNA portion of an msDNA); 2) an msd locus encoding the msd RNA portion of the msDNA; 3) a sequence encoding a retron reverse transcriptase (RT), wherein said msd RNA is capable of being reverse transcribed to form the msDNA by the retron reverse transcriptase (RT); and, 4) a heterologous nucleic acid inserted at or within the msd locus, upstream of the msr locus, upstream or downstream of the msd locus; wherein the engineered nucleic acid construct is engineered based on and/or to resemble a secondary structure of a wild-type or consensus retron encoding a wild-type or consensus retron ncRNA encompassed by: a) any one of the sequences and/or structures as depicted in any one of SEQ ID Nos of Table B and/or FIGS. 2-27; or b) a variant of a), having: i) up to 1, 2, or 3 (e.g., up to 1) nucleotide changes per 10 red lettered-nucleotides; ii) up to 4, 5, or 6 (e.g., up to 1 or 2) nucleotide changes per 10 black lettered-nucleotides; and/or iii) up to 7, 8, or 9 (e.g., up to 3 or 4) nucleotide changes per 10 grey lettered-nucleotides; and/or optionally further comprising: i) 7, 8, 9, or 10 (e.g., 9 or 10) nucleotides present per 10 red-circled nucleotides; ii) 6, 7, 8, 9, or 10 (e.g., 8, 9 or 10) nucleotides present per 10 black-circled nucleotides; iii) 4, 5, 6, 7, 8, 9, or 10 (e.g., 6, 7, 8, 9 or 10) nucleotides present per 10 grey-circled nucleotides; and/or iv) 2, 3, 4, 5, 6, 7, 8, 9, or 10 (e.g., 4, 5, 6, 7, 8, 9, or 10) nucleotides present per 10 white-circled nucleotides; wherein the ncRNA does not comprise an ncRNA associated with the sequences of Table X.

In certain embodiments, the engineered retron of the invention encodes a reverse transcriptase (RT) or a functional domain thereof, comprising: i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A. In some embodiments, the RT does not comprise a polypeptide identified in Table X.

In certain embodiments, the engineered retron of the invention encodes a reverse transcriptase (RT) or a functional domain thereof, comprising: i) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide of Table A and/or ii) a consensus polynucleotide sequence listed in Table A. In some embodiments, the polynucleotide encoding the RT does not comprise a polynucleotide identified in Table X.

In certain embodiments, the engineered retron of the invention encodes an ncRNA comprising: (I) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA of Table B.

In certain embodiments, the engineered retron of the invention encodes an ncRNA and a reverse transcriptase (RT) or a functional domain thereof, wherein the ncRNA and the RT or functional domain thereof are as described above.

Specifically, in such embodiments, the ncRNA may comprise: (I) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B; and wherein the ncRNA optionally excludes the ncRNA associated with the sequences identified in Table X.

Also in such embodiment, the reverse transcriptase (RT) or functional domain thereof comprises: (A) i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or ii) a polypeptide listed in Table C; optionally, the RT does not comprise a polypeptide identified in Table X; OR (B) i) a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A; optionally, the polynucleotide encoding the RT does not comprise a polynucleotide associated with the sequences identified in Table X.

In certain embodiments, the heterologous nucleic acid is between >20 nucleotides and about 10,000 nucleotides.

The engineered retron may further comprise a sequence modification (e.g., insertion, deletion, and/or substitution of one or more nucleotide(s)) in the msr locus and/or the msd locus that: i) modulates (e.g., enhances) reverse transcription, processivity, accuracy/fidelity, and/or production of the msDNA (e.g., in the mammalian cell); ii) modulates (e.g., reduces) immunogenicity of ncRNA (msr locus and msd locus) encoded by the engineered retron in a host (e.g., a host comprising the mammalian cell); iii) comprises a nucleotide sequence that modulates (e.g., inhibits, either permanently or transiently) a function of the msDNA; and/or iv) modulates (e.g., improves) efficiency of targeted genome editing/engineering.

Retron msr gene, msd gene, and RT nucleic acid sequences (e.g., the ret gene) as well as the encoded retron reverse transcriptase protein sequences that may serve as the template of the engineered retron described herein may be derived from any source, such as those in Table A, optionally excluding those associated with the sequences of Table X.

In some embodiments, template or wild-type (wt) sequences of the msr gene, msd gene, and the RT coding sequence (viz., the ret gene) used in the engineered retron are derived from a bacterial retron.

In some embodiments, representative template/wild-type retrons are from gram negative bacteria. In some embodiments, the retron is from a bacterium listed in Table X.

In some embodiments, the engineered retrons are engineered based on clades defined on retron/retron RTs, in which the retrons are associated with a tripartite system composed of the ncRNA, the RT and an additional protein or RT-fused domain with diverse enzymatic functions. See, for example, "Mestre et al., *Systematic Prediction of Genes Functionally Associated with Bacterial Retrons and Classification of The Encoded Tripartite Systems*, Nucleic Acids Research, Volume 48, Issue 22, 16 Dec. 2020, Pages 12632-12647" (incorporated herein by reference). While the clades are based primarily upon naturally occurring ncRNA and retron/retron RT, and an additional protein or RT-fused domain, the clades, for the purpose of serving as the templates for the subject engineered retrons, are not limited to naturally occurring sequences. Rather, the clades can also encompass non-naturally occurring ncRNA and RT, including, without limitation, recombinant, modified or altered, chimeric, hybrid, synthetic, artificial, etc.

Thus, according to the instant disclosure, retrons may be considered phylogenetically related based on a Neighbor-Joining algorithm of at least 75% (of at least 1000 replicates) and a Poisson correction distance measurement of no more than 0.05, based on alignment of the retron RT. Alternatively or in addition, retrons may be considered phylogenetically related when/if the same RT, or closely related RT, can recognize the secondary structures of the ncRNA of the retrons and reserve transcribe the retrons to produce msDNA.

In certain embodiments, sequence alignments between different retron sequences (e.g., ncRNA and/or RT (protein and/or nucleic acid) sequences) or secondary structure generations are based on software known to one of ordinary skill in the art.

The retron ncRNA sequences including msr and msd sequences within the same clade may be highly conserved at certain positions, while being less conserved at other positions.

Exemplary consensus sequences based on clade members were generated (see, for example, the corresponding FIGS. 2-27 (SEQ ID NO:19191-19216), respectively) to show these conserved sequences and/or secondary structures, including the highly conserved nucleotides with at least 97% sequence conservation at red lettered-nucleotides, those with between 90-97% sequence conservation at black lettered-nucleotides, and 75-90% nucleotide sequence identity at grey-lettered nucleotides. Further structural limitations of the consensus sequences for the clades are provided as colored circles indicating the probability of having a base at that specific position, including red circles representing a base in 97% of the cases, black circles representing a base in 90-97% of the cases, and grey circles representing a base in 75-90% of the cases.

In some embodiments, the template ncRNA based on which the subject engineered retron is modified (including the msr and msd region sequences) is a consensus sequence for the various retron ncRNA (including msr and msd nucleic acid sequences) clades, as provided in any one of SEQ ID NOs: of Table B and the corresponding FIGS. 2-27 (SEQ ID NO:19191-19216), respectively, including the bases that are highly conserved and depicted by a specific-colored letters or circles, and optionally further including bases that may be present at specific locations by specific-colored circles.

In some embodiments, the engineered retron is engineered, based on and/or to resemble a secondary structure of a wild-type or consensus retron encoding a wild-type or consensus retron ncRNA encompassed by: 1) the sequences and/or structures as depicted in any one of SEQ ID NOs: of Table B and the corresponding FIGS. 2-27 (SEQ ID NO:19191-19216), respectively; or 2) a variant of 1), having: A) up to 1, 2, or 3 (e.g., up to 1) nucleotide changes per 10 red lettered-nucleotides; B) up to 4, 5, or 6 (e.g., up to 1 or 2) nucleotide changes per 10 black lettered-nucleotides; and/or C) up to 7, 8, or 9 (e.g., up to 3 or 4) nucleotide changes per 10 grey lettered-nucleotides. Optionally, the variant of 1) further comprises: a) 7, 8, 9, or 10 (e.g., 9 or 10) nucleotides present per 10 red-circled nucleotides; b) 6, 7, 8, 9, or 10 (e.g., 8, 9 or 10) nucleotides present per 10 black-circled nucleotides; c) 4, 5, 6, 7, 8, 9, or 10 (e.g., 6, 7, 8, 9 or 10) nucleotides present per 10 grey-circled nucleotides; and/or d) 2, 3, 4, 5, 6, 7, 8, 9, or 10 (e.g., 4, 5, 6, 7, 8, 9, or 10) nucleotides present per 10 white-circled nucleotides.

The engineered retron may be engineered by introducing the sequence modifications (e.g., deletions, additions, or substitutions) into the wild-type retron encoding wild-type retron ncRNA, or into the retron encoding the consensus retron ncRNA.

For example, a variant retron may not satisfy the sequence and/or structural requirements of any one of SEQ ID NOs: of Table B and the corresponding FIGS. 2-27 (SEQ ID NO:19191-19216), respectively, but may still be a suitable template for the engineered retron described herein, so long as one or more of the conditions set forth in A)-C) and/or a)-d) are met.

In certain embodiments, the highly conserved sequences in the template retrons are preserved/conserved or substantially preserved/conserved in the engineered retron described herein.

In certain embodiments, all or substantially all the red lettered-nucleotides (i.e., those conserved in about 97% or more of the retrons in the same clade) are preserved/conserved in the engineered retron described herein. In certain embodiments, no more than 1, 2, or 3 (e.g., up to 1) nucleotide change(s) (e.g., deleted or substituted) occur per 10 red lettered-nucleotides in the engineered retron described herein. In certain embodiments, no more than about 0.3%, 0.5%, 1%, 2%, 3%, 4%, or 5% of the red lettered-nucleotides are changed (e.g., deleted or substituted) in the engineered retron described herein.

In certain embodiments, all or substantially all the black lettered-nucleotides (i.e., those conserved in about 90-97% of the retrons in the same clade) are preserved/conserved in the engineered retron described herein. In certain embodiments, no more than 1, 2, 3, 4, 5, 6, 7, 8, 9, or 10 (e.g., up to 1 or 2) nucleotide change(s) (e.g., deleted or substituted) occur per 10 black lettered-nucleotides are changed in the engineered retron described herein. In certain embodiments, no more than about 3%, 4%, 5% or 10% of the black lettered-nucleotides are changed (e.g., deleted or substituted) in the engineered retron described herein.

In certain embodiments, all or substantially all the grey lettered-nucleotides (i.e., those conserved in about 75-90% of the retrons in the same clade) are preserved/conserved in the engineered retron described herein. In certain embodiments, no more than 1, 2, 3, 4, 5, 6, 7, 8, 9, 10, 11, 12, 13, 14, or 15 (e.g., up to 3 or 4, or up to 7, 8, or 9) nucleotide change(s) (e.g., deleted or substituted) occur per 10 grey lettered-nucleotides are changed in the engineered retron described herein. In certain embodiments, no more than about 5%, 10%, 15%, 20%, or 25% of the grey lettered-nucleotides are changed (e.g., deleted or substituted) in the engineered retron described herein.

In certain embodiments, all or substantially all the red circled-nucleotides (i.e., those with a nucleotide in about 97% or more of the retrons in the same clade) are present in the engineered retron described herein. In certain embodiments, no more than 1, 2, or 3 (e.g., 0.3, 0.5, or up to 1) nucleotides are absent (e.g., deleted) per 10 red circled-nucleotides in the engineered retron described herein. In certain embodiments, 7, 8, 9, or 10 (e.g., 9 or 10) nucleotides are present per 10 red circled-nucleotides in the engineered retron described herein. In certain embodiments, no more than about 0.3%, 0.5%, 1%, 2%, 3%, 4%, or 5% of the red circled-nucleotides are absent (e.g., deleted) in the engineered retron described herein.

In certain embodiments, all or substantially all the black circled-nucleotides (i.e., those with a nucleotide in about 90-97% of the retrons in the same clade) are present in the engineered retron described herein. In certain embodiments, no more than 1, 2, 3, or 4 (e.g., up to 1 or 2) nucleotides are absent (e.g., deleted) per 10 black circled-nucleotides in the engineered retron described herein. In certain embodiments, 6, 7, 8, 9, or 10 (e.g., 8, 9 or 10) nucleotides are present per 10 black circled-nucleotides in the engineered retron described herein. In certain embodiments, no more than about 1%, 2%, 3%, 5% or 10% of the black circled-nucleotides are absent (e.g., deleted) in the engineered retron described herein.

In certain embodiments, all or substantially all the grey circled-nucleotides (i.e., those with a nucleotide in about 75-90% of the retrons in the same clade) are present in the engineered retron described herein. In certain embodiments, no more than 1, 2, 3, 4, or 5 (e.g., up to 2, 3, or 4) nucleotides are absent (e.g., deleted) per 10 grey circled-nucleotides in the engineered retron described herein. In certain embodiments, 4, 5, 6, 7, 8, 9, or 10 (e.g., 6, 7, 8, 9 or 10) nucleotides are present per 10 grey circled-nucleotides in the engineered retron described herein. In certain embodiments, no more than about 5%, 10%, 15%, 20%, or 25% of the grey circled-nucleotides are absent (e.g., deleted) in the engineered retron described herein.

In certain embodiments, all or substantially all the white circled-nucleotides (i.e., those with a nucleotide in about 50-75% of the retrons in the same clade) are present in the engineered retron described herein. In certain embodiments, no more than 1, 2, 3, 4, 5, 6, or 6 (e.g., up to 2, 3, 4, 5, 6) nucleotide are absent (e.g., deleted) per 10 white circled-nucleotides in the engineered retron described herein. In certain embodiments, 2, 3, 4, 5, 6, 7, 8, 9, or 10 (e.g., 4, 5, 6, 7, 8, 9 or 10) nucleotides are present per 10 grey circled-nucleotides in the engineered retron described herein. In certain embodiments, no more than about 5%, 10%, 15%, 20%, 30%, 40%, or 50% of the white circled-nucleotides are absent (e.g., deleted) in the engineered retron described herein.

In some embodiments, the engineered retron is synthetically produced. In other embodiments, the synthetically produced engineered retron comprises the sequences and/or secondary structures as depicted in any one of SEQ ID NOs: of Table B and the corresponding FIGS. 2-27 (SEQ ID NO:19191-19216), respectively, and at least the conserved color lettered nucleotides according to their respective levels of sequence identity (e.g., red, black and gray letters), and/or at least the conserved colored circle nucleotides according to their respective levels of probability of sequence presence (e.g., red, black and gray circles).

In some embodiments, the sequence modification in the engineered retrons leads to/results in the encoded retron ncRNA having the desired functional improvement.

In certain embodiments, the one or more sequence modifications comprises, in the ncRNA, one or more of: (i) a modified (e.g., mutated, reduced, or eliminated) bulge in a1, a2, or both a1 and a2; (ii) an extension or shortening of a1, a2, or both a1 and a2; (iii) an extension or shortening of a spacer sequence between hairpin loops (e.g., S1, S2, S3, and/or S4 in FIG. 2, or any of the S regions in an one of FIGS. 2-27); (iv) an additional or modified (e.g., mutated or eliminated) bulge in hairpin loops (e.g., L2 and/or L3 in FIG. 2, or any of the L regions in an one of FIGS. 2-27 (e.g., by removing unpaired bases in the bulge, or by replacing unpaired bases with an equivalent number of base pairs)); (v) a modified (e.g., extended or shortened) length of hairpin loops (e.g., L1, L2, L3, and/or L4 in FIG. 2, or any of the L regions in an one of FIGS. 2-27); (vi) an alternative L1 and/or L2 (in FIG. 2, or any of the L regions in an one of FIGS. 2-27) having complement, reverse, or reverse complement sequences; (vii) a modified (e.g., increased) number of unpaired bases at the tip of hairpin loops (e.g., L1, L2, L3, and/or L4 in FIG. 2, or any of the L regions in an one of FIGS. 2-27); (viii) a modified (e.g., increased or decreased) GC content in hairpin loops (e.g., L1, L2, L3, and/or L4 in FIG. 2, or any of the L regions in an one of FIGS. 2-27); (ix) an insertion of the heterologous nucleic acid in spacer sequences between hairpin loops (e.g., S1, S2, S3 and/or S4 in FIG. 2, or any of the S regions in an one of FIGS. 2-27), or at the tip of hairpin loops (e.g., L1, L2, L3, and/or L4 in FIG. 2, or any of the L regions in an one of FIGS. 2-27); (x) a deletion of one or more hairpin loops (e.g., L1, L2, L3 and/or L4 in FIG. 2, or any of the L regions in an one of FIGS. 2-27); (xi) an addition of a new loop in a spacer sequence between hairpin loops (e.g., S1, S2, S3, and/or S4 in FIG. 2, or any of the S regions in an one of FIGS. 2-27); (xii) circularization of the ncRNA with the 5' end and the 3' end of the ncRNA being connected either directly, or via a spacer sequence; (xiii) a repositioned branching guanosine capable of initiating reverse transcription priming; (xiv) a staggered end sequence that reduces immunogenicity of the retron ncRNA, created by, e.g., adding or removing the 5' a1 nucleotides and/or the 3' a2 nucleotides; and/or, (xv) an antisense sequence complementary to a CRISPR/Cas guide RNA (gRNA) sequence encoded by the heterologous nucleic acid, wherein the antisense sequence hybridizes to and inhibits said gRNA in the encoded retron ncRNA, and wherein said antisense sequence is removed upon reverse transcription of the msDNA.

Unless specifically indicated otherwise, the a1 and a2 regions are both single-stranded and substantially reverse complementary to each other, forming a stem with optional interruption by a symmetric or asymmetric bulge, with optional one or more 5' and/or 3' overhang/unpaired nucleotide(s), wherein the a1 region generally ends before (e.g., ends immediately 5' to) the conserved branching guanosine (G) providing the 2'-OH for reverse transcription priming.

In some embodiments, the sequence change comprises a mutated, reduced, or eliminated bulge in the a1/a2 stem region, including sequence change(s) in one (i.e., a1 or a2) strand, or both a1 and a2 strands.

For example, in some embodiments, the sequence change comprises deleting nucleotides from a1, a2, or both a1 and a2, such that the size of the bulge is reduced, or a symmetrical bulge becomes asymmetrical or vice versa, or a bulge is eliminated.

In some embodiments, the sequence change comprises replacing/substituting nucleotides in a1, a2, or both a1 and a2, such that previously unpaired bases in the bulge become base-paired.

In some embodiments, the sequence change comprises replacing an unpaired purine base with one or more unpaired pyrimidine base(s).

In some embodiments, the sequence change comprises replacing an unpaired pyrimidine base with one or more unpaired purine base(s).

In some embodiments, the sequence change comprises replacing one unpaired purine base (e.g., A or G) with another unpaired purine base (e.g., G or A, respectively).

In some embodiments, the sequence change comprises replacing one unpaired pyrimidine base (e.g., T/U or C) with another unpaired pyrimidine base (e.g., C or T/U, respectively).

In some embodiments, the sequence change comprises an extension or shortening of a1, a2, or both a1 and a2.

For example, the length of a1 can be shortened by deleting 5' overhang, deleting any upstream bulge nucleotides, deleting bases involved in base-pairing. Likewise, the length of a1 can be extended by adding 5' overhang, adding any upstream bulge nucleotides, adding bases involved in base-pairing.

In some embodiments, the length of a2 can be shortened by deleting 5' overhang, deleting any downstream bulge nucleotides, deleting bases involved in base-pairing. Likewise, the length of a2 can be extended by adding 5' overhang, adding any downstream bulge nucleotides, adding bases involved in base-pairing.

In some embodiments, the spacer sequences between hairpin loops as depicted in any one of FIGS. 2-27, (e.g., S1, S2, S3 and/or S4 in FIG. 2) can be extended or shortened. In some embodiments the modification can be by inserting a heterologous nucleic acid sequence in spacer sequences between hairpin loops (e.g., S1, S2, S3 and/or S4 in FIG. 2). In certain embodiments, one or more heterologous nucleic acid sequences is inserted in a spacer sequence in the msd region. In some embodiments, the modification of the spacer region can be by interrupting the spacer with additional bulges or hairpin loops.

In other embodiments, a bulge in the hairpin loops are mutated or eliminated (e.g., by removing unpaired bases) in the bulge, such that, for example, a symmetric bulge becomes an unsymmetrical bulge, or an unsymmetrical bulge becomes a symmetric one or an even more unsymmetrical one. In certain embodiments, unpaired bases in the bulge is replaced with an equivalent number of base pairs. The additional base pairs may be merged into the stem at one or both ends of the previous bulge, or may bisect a previous bulge to create two bulges.

In some embodiments, the length of one or more hairpin loops as depicted in any one of FIGS. 2-27, (e.g., L1, L2, L3 and/or L4 of FIG. 2) can be extended or shortened. For example, the number of unpaired bases within the tip or loop can be increased or decreased. Further, a heterologous nucleic acid sequence of interest can be inserted within the tip or the hairpin loop. In certain embodiments, the heterologous nucleic acid sequence of interest is inserted within the tip or the hairpin loop in the msd locus.

In other embodiments, the GC content in the tip or hairpin loops are increased or decreased.

In still other embodiments, a hairpin loop can be deleted.

In some embodiments, the ncRNA with the 5' end and the 3' end of the ncRNA can be circularized by being connected either directly, or via a spacer sequence.

In some embodiments, one or more hairpin loops (e.g. L1, L2, L3 and/or L4 of FIG. 2) are modified to have complement, reverse, or reverse complement sequences.

In certain embodiments, the branching guanosine (G) capable of initiating reverse transcription priming is repositioned. For example, the G can be placed further downstream of the end of the a1 sequence by, for example, 1, 2, 3, 4, or 5 additional nucleotides.

In certain embodiments, immunogenicity of the retron ncRNA is reduced by, e.g., adding or removing the 5' a1 nucleotides and/or the 3' a2 nucleotides.

In certain embodiments, the one or more heterologous nucleic acid sequences (inserted into the subject engineered retron) comprise: a) a heterologous nucleic acid (such as the coding sequence for an RNA aptamer or a ribozyme) inserted into the msr locus or the msd locus (such as in an S region (e.g., S1, S2, S3 and/or S4 in FIG. 2, or any of the S regions in any one of FIGS. 2-27), or the tip of an L region (e.g., L1, L2, L3 and/or L4 in FIG. 2, or any of the L regions in any one of FIGS. 2-27), or upstream or downstream of either the msr locus or the msd locus; or b) a first heterologous nucleic acid inserted into the msd locus, and a second heterologous nucleic acid inserted either upstream of the msr locus or downstream of the msd locus, wherein the second heterologous nucleic acid encodes a CRISPR/Cas guide RNA (gRNA).

In certain embodiments, an antisense sequence complementary to a CRISPR/Cas guide RNA (gRNA) sequence encoded by the heterologous nucleic acid can be included, wherein the antisense sequence hybridizes to and inhibits the gRNA in the encoded retron ncRNA, and wherein the antisense sequence is removed upon reverse transcription of the msDNA.

In certain embodiments, said heterologous nucleic acid encodes a protein or peptide of interest, or wherein said heterologous nucleic acid comprises or encodes a donor/ template sequence (e.g., a donor that corrects/repairs/removes a mutation at the target genome site, such as a mutated exon in a disease gene; a functional DNA element (such as a promoter, an enhancer, a protein binding sequence, a methylation site, a homology region for assisting gene editing, etc.); or a coding sequence for a functional RNA element (ncRNAs, etc.)).

In certain embodiments, the protein or peptide of interest comprises a therapeutic protein (such as a wildtype protein defective in a disease cell, or a therapeutic antibody or antigen-binding fragment thereof) useful in treating a disease.

Other heterologous nucleic acids of the invention are described in other section of the specification, all incorporated herein by reference.

In some embodiments, the template/wild-type retron for the engineered retron encodes a wild-type or consensus retron ncRNA polynucleotide having a consensus secondary structure shown in any one of FIGS. 2-27 (SEQ ID NO:19191-19216), which are described individually below:

Variants of this template, which can also be used in the engineered retron of the invention, include a variant having: A) up to 1, 2, or 3 (e.g., up to 1) nucleotide changes per 10 red lettered-nucleotides; B) up to 4, 5, or 6 (e.g., up to 1 or 2) nucleotide changes per 10 black lettered-nucleotides; and/or C) up to 7, 8, or 9 (e.g., up to 3 or 4) nucleotide changes per 10 grey lettered-nucleotides; and/or optionally further comprising: a) 7, 8, 9, or 10 (e.g., 9 or 10) nucleotides present per 10 red-circled nucleotides; b) 6, 7, 8, 9, or 10 (e.g., 8, 9 or 10) nucleotides present per 10 black-circled nucleotides; c) 4, 5, 6, 7, 8, 9, or 10 (e.g., 6, 7, 8, 9 or 10) nucleotides present per 10 grey-circled nucleotides; and/or d) 2, 3, 4, 5, 6, 7, 8, 9, or 10 (e.g., 4, 5, 6, 7, 8, 9, or 10) nucleotides present per 10 white-circled nucleotides.

In some embodiments, the engineered retron is entirely synthetically produced and having the conserved nucleotides as denoted by the colored letters as shown in SEQ ID NO. 19191-19216 and FIGS. 2-27.

In some embodiments, the non-coding RNA (ncRNA) portion of the engineered retron comprises a polynucleotide (e.g., a DNA molecule) encoding an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B. In some embodiments, the ncRNA does not comprise an ncRNA associated with the sequences of Table X.

Amplification of an engineered retron described herein may be performed, for example, before transfection of cells or ligation into vectors. Any method for amplifying the engineered retron may be used, including, but not limited to polymerase chain reaction (PCR), isothermal amplification, nucleic acid sequence-based amplification (NASBA), transcription mediated amplification (TMA), strand displacement amplification (SDA), and ligase chain reaction (LCR). In one embodiment, the engineered retron comprise common 5' and 3' priming sites to allow amplification of retron sequences in parallel with a set of universal primers. In another embodiment, a set of selective primers is used to selectively amplify a subset of retron sequences from a pooled mixture.

In some embodiments, the template/wild-type retron for the engineered retron encodes a wild-type or consensus retron ncRNA polynucleotide having a consensus secondary structure shown in FIG. 2-27 (SEQ ID NO:19191-19216), and as described individually below:

Type IA/IIA1 Retron (FIG. 2)

In some embodiments, the template/wt retron for the subject engineered retron encodes a wild-type retron ncRNA polynucleotide having a consensus secondary structure that can be described as:

a1-S1-L1-L2-S2-L3-S3-a2-S4-L4, wherein:
a1/a2 is a stem 8 bp in length;
L1 is a stem of 5 bps with a 10-nt tip;
L2 is a stem of 7 bps with a 5-nt tip, and a 1/1 bulge 3 nt from the tip;
L3 is a stem of 23 bps with a 22-nt tip, and a 2/2 bulge 21 bps from the tip;
L4 is a stem of 11 bps with a 5-nt tip;
S1 is a single-stranded spacer region between the a1/a2 stem and L1, with no spacer between L1 and L2;
S2 is a single-stranded spacer region between L2 and L3;
S3 is a single-stranded spacer region between L3 and the a1/a2 stem; and
S4 is a single-stranded spacer region between the a1/a2 stem and L4, and the conserved nucleotides are as shown in SEQ ID NO: 1 and FIG. 2 (SEQ ID NO:19191), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 2 (SEQ ID NO:19191).

Type IB1 Retron (FIG. 3)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 6 bps in length with a 2/2 bulge 3 bps from the tip, wherein a1 has a 2-nt overhang and a2 has a 6-nt overhang;
L1 is a stem of 14 bps with a 3-nt tip, a 1/0 bulge 4 bps from the tip, and a 0/6 bulge 10 bps from the tip;
L2 is a stem of 23 bps with a 5-nt tip, a 1/1 bulge 4 bps from the tip, and a 0/1 bulge 18 bps from the tip;
S1 is a single-stranded spacer region between a1/a2 and L1;
S2 is a single-stranded spacer region between L1 and L2;
S3 is a single-stranded spacer region between L2 and a1/a2, the conserved nucleotides are as shown in FIG. 3 (SEQ ID NO: 19192), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 3 (SEQ ID NO: 19192).

Type IB2 Retron (FIG. 4)

In some embodiments, the template/wt retron for the subject engineered retron encodes a wild-type retron ncRNA polynucleotide having a consensus secondary structure that can be described as:

a1-S1-L1-L2-S2-L3-S3-L4-S4-a2, wherein:
the a1/a2 stem is 16 bp in length, with a 17-base 5' overhang and a 16-base 3' overhang;
L1 is a stem of 6 bps with a 4-nt tip;
L2 is a stem of 4 bps with a 4-nt tip, with a 2/2 bulge 2 nts from the tip;
L3 is a stem of 3 bps with a 5-nt tip;
L4 is a stem of 9 bps with a 5-nt tip, and a 1/1 bulge 4 nts from the tip;
S1, S2, S3, and S4 are single-stranded spacer regions between the a1/a2 stem and L1, L2 and L3, L3 and L4, and L4 and the a1/a2 stem, respectively, with no spacer between L1 and L2; wherein the last 5 nts of S1 and the $5^{th}$-$9^{th}$ nts of S2 form a 5-bp stem, and,
the conserved nucleotides are as shown in FIG. 4 (SEQ ID NO: 19193), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 4 (SEQ ID NO: 19193).

Type 1C Retron (FIG. 5)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 13 bps in length;
L1 is a stem of 9 bps with a 3-nt tip;
L2 is a stem of 10 bps with a 5-nt tip;
S1 is a single-stranded spacer region between a1/a2 and L1;
S2 is a single-stranded spacer region between L1 and L2;
S3 is a single-stranded spacer region between L2 and a1/a2,
the conserved nucleotides are as shown in FIG. 5 (SEQ ID NO: 19194), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 5 (SEQ ID NO: 19194).

Type IIA1 Retron (FIG. 6)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
a1/a2 is a stem 10 bps in length with a 1-nt overhang on a2;
L1 is a stem of 10 bps with a 3-nt tip;
L2 is a stem of 7 bps with a 5-nt tip;
L3 is a stem of 27 bps with a 8-nt tip and a 0/2 bulge 26 bps from the tip;
S1 is a single-stranded spacer region between a1/a2 and L1;
S2 is a single-stranded spacer region between L1 and L2;
S3 is a single-stranded spacer region between L2 and L3;
S4 is a single-stranded spacer region between L3 and a1/a2,
the conserved nucleotides are as shown in FIG. 6 (SEQ ID NO: 19195), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 6 (SEQ ID NO: 19195).

Type IIA2 Retron (FIG. 7)

In some embodiments, the template/wt retron for the subject engineered retron encodes a wild-type retron ncRNA polynucleotide having a consensus secondary structure that can be described as:

a1-S1-L1-S2-L2-L3-S3-a2, wherein:
a1/a2 is a stem 7 bp in length with no overhangs;
L1 is a stem of 8 bps with a 3-nt tip;
L2 is a stem of 30 bps with a 8-nt tip, a 1/1 bulge 2 bps from the tip, and a 1/1 bulge 27 bps from the tip;
L3 is a stem of 8 bps with a 5-nt tip, and a 0/1 bulge 3 nt from the tip;
S1 is a single-stranded spacer region between the a1/a2 stem and L1;
S2 is a single-stranded spacer region between L1 and L2; and,
S3 is a single-stranded spacer region between L3 and the a1/a2 stem;
the conserved nucleotides are as shown in FIG. 7, (SEQ ID NO: 19196) and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 7 (SEQ ID NO: 19196).

Type IIA3 Retron (FIG. 8)

In some embodiments, the template/wt retron for the subject engineered retron encodes a wild-type retron ncRNA polynucleotide having a consensus secondary structure that can be described as:

a1-S1-L1-L2-S2-L3-S3-a2, wherein:
- a1/a2 is a stem 6 bps in length;
- L1 is a stem of 8 bps with a 9-nt tip;
- L2 is a stem of 8 bps with a 3-nt tip;
- S1 is a single-stranded spacer region between a1/a2 and L1;
- S2 is a single-stranded spacer region between L2 and L3;
- S3 is a single-stranded spacer region between L3 and a1/a2,
- the conserved nucleotides are as shown in FIG. 8 (SEQ ID NO: 19197), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 8 (SEQ ID NO: 19197).

Type IIA4 Retron (FIG. 9)

In some embodiments, the template/wt retron for the subject engineered retron encodes a wild-type retron ncRNA polynucleotide having a consensus secondary structure that can be described as:

a1-a2-L1-S1-L2-L3-S2-L4-S3, wherein:
- a1/a2 is a stem 3 bp in length with no overhangs and a 7-nt tip;
- L1 is a stem of 7 bps with a 3-nt tip;
- L2 is a stem of 6 bps with a 4-nt tip;
- L3 is a stem of 40 bps with a 5-nt tip, and a 2/2 bulge 3 bps from the tip, a 5/4 bulge 10 bps from the tip, and a 12/15 bulge 30 bps from the tip;
- L4 is a stem of 4 bps with a 9-nt tip;
- S1 is a single-stranded spacer region between L1 and L2/L3;
- S2 is a single-stranded spacer region between L2/L3 and L4;
- S3 is a single-stranded spacer region between L4 and the 3' end of the ncRNA; and
- the conserved nucleotides are as shown in FIG. 9 (SEQ ID NO: 19198), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 9 (SEQ ID NO: 19198).

Type IIA5 Novel Retron (FIG. 10)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
- a1/a2 is a stem 15 bps in length with a 1-nt overhang on a1, a 13-nt overhang on a2, and a 7/5 bulge 13-nt from the tip;
- L1 is a stem of 10 bps with a 3-nt tip;
- L2 is a stem of 35 bps with a 3-nt tip;
- L3 is a stem of 6 bps with a 5-nt tip;
- S1 is a single-stranded spacer region between a1/a2 and L1;
- S2 is a single-stranded spacer region between L1 and L2;
- S3 is a single-stranded spacer region between L2 and L3;
- S4 is a single-stranded spacer region between L3 and a1/a2,
- the conserved nucleotides are as shown in FIG. 10 (SEQ ID NO: 19199), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 10 (SEQ ID NO: 19199).

Type IIIA1 Retron (FIG. 11)

In some embodiments, the template/wt retron for the subject engineered retron encodes a wild-type retron ncRNA polynucleotide having a consensus secondary structure that can be described as:

a1-S1-L1-L2-S2-L3-S3-a2, wherein:
- a1/a2 is a stem 2 bps in length with a 1-nt overhang on a2;
- L1 is a stem of 8 bps with a 4-nt tip;
- L2 is a stem of 9 bps with a 3-nt tip and a 1/1 bulge 3 bps from the tip;
- L3 is a stem of 20 bps with a 3-nt tip and a 1/2 bulge 3 bps from the tip;
- S1 is a single-stranded spacer region between a1/a2 and L1;
- S2 is a single-stranded spacer region between L2 and L3;
- S3 is a single-stranded spacer region between L3 and a1/a2,
- the conserved nucleotides are as shown in FIG. 11 (SEQ ID NO: 19200), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 11 (SEQ ID NO: 19200).

Type IIIA2 Retron (FIG. 12)

In some embodiments, the template/wt retron for the subject engineered retron encodes a wild-type retron ncRNA polynucleotide having a consensus secondary structure that can be described as:

a1-S1-L1-S2-L2-S3-L3-S4-L4-S5-a2, wherein:
- a1/a2 is a stem 15 bp in length;
- L1 is a stem of 6 bps with a 4-nt tip;
- L2 is a stem of 13 bps with a 5-nt tip;

L3 is a stem of 4 bps with a 8-nt tip;
L4 is a stem of 20 bps with a 4-nt tip and a 2/2 bulge 6 bp from the tip;
S1 is a single-stranded spacer region between a1/a2 and L1;
S2 is a single-stranded spacer region between L1 and L2;
S3 is a single-stranded spacer region between L2 and L3;
S4 is a single-stranded spacer region between L3 and L4;
S5 is a single-stranded spacer region between L4 and a1/a2;
the conserved nucleotides are as shown in FIG. 12 (SEQ ID NO: 19201), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 12 (SEQ ID NO: 19201).

Type IIIA3 Retron (FIG. 13)

In some embodiments, the template/wt retron for the subject engineered retron encodes a wild-type retron ncRNA polynucleotide having a consensus secondary structure that can be described as:

a1-S1-L1-S2-L2-S3-L3-S4-L4-L5-L6-S5-a2, wherein:
a1/a2 is a stem 24 bps in length and having a 1/0 bulge 15 bps from the tip, and a 1/1 bulge 19 bps from the tip;
L1 is a stem of 7 bps with a 4-nt tip;
L2 is a stem of 9 bps with a 8-nt tip;
L3 is a stem of 8 bps with a 4-nt tip;
L4 is a stem of 4 bps with a 9-nt tip, and a 2/2 bulge 3 bps from the tip;
L5 is a stem of 19 bps with a 18-nt tip;
L6 is a stem of 5 bps with a 3-nt tip;
S1 is a single-stranded spacer region between a1/a2 and L1;
S2 is a single-stranded spacer region between L1 and L2;
S3 is a single-stranded spacer region between L2 and L3;
S4 is a single-stranded spacer region between L3 and L4;
S5 is a single-stranded spacer region between L6 and a1/a2;
the conserved nucleotides are as shown in FIG. 13 (SEQ ID NO: 19202), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 13 (SEQ ID NO: 19202).

Type IIIA4 Retron (FIG. 14)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
a1/a2 is a stem 5 bps in length with a 1/2 bulge 2 bps from the tip;
L1 is a stem of 8 bps with a 6-nt tip;
L2 is a stem of 8 bps with a 5-nt tip;
L3 is a stem of 13 bps with a 14-nt tip and a 1/0 bulge 2 bps from the tip;
S1 is a single-stranded spacer region between a1/a2 and L1;
S2 is a single-stranded spacer region between L1 and L2;
S3 is a single-stranded spacer region between L2 and L3:
S4 is a single-stranded spacer region between L3 and a1/a2,
the conserved nucleotides are as shown in SEQ ID NO: 19 and FIG. 20 (SEQ ID NO: 19209), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 14 (SEQ ID NO: 19203).

Type IIIA5 Retron (FIG. 15)

In some embodiments, the template/wt retron for the subject engineered retron encodes a wild-type retron ncRNA polynucleotide having a consensus secondary structure that can be described as:

a1-S1-L1-S2-L2-L3-L4-S3-a2, wherein:
the a1/a2 stem is 11 bp in length with no overhang;
L1 is a stem of 9 bps with a 3-nt tip;
L2 is a stem of 14 bps with a 5-nt tip;
L3 is a stem of 9 bps with a 7-nt tip;
L4 is a stem of 15 bps with a 7-nt tip;
S1, S2, and S3 are single-stranded spacer regions between the a1/a2 stem and L1, L2 and L3, and L4 and the a1/a2 stem, respectively, with no spacer between L1 and L2, and no spacer between L2 and L3; wherein the $5^{th}$-$2^{nd}$ last nts of S2 and the $3^{rd}$-$6^{th}$ nts of S3 forms a 4-bp stem, and, the conserved nucleotides are as shown in FIG. 15 (SEQ ID NO: 19204), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 15 (SEQ ID NO: 19204).

Type IIIunk Retron (FIG. 16)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
a1/a2 is a stem 11 bps in length;
L1 is a stem of 12 bps with a 2-nt tip;
L2 is a stem of 21 bps with a 1-nt tip;
L3 is a stem of 20 bps with a 4-nt tip;

S1 is a single-stranded spacer region between a1/a2 and L1;
S2 is a single-stranded spacer region between L1 and L2;
S3 is a single-stranded spacer region between L2 and L3;
S4 is a single-stranded spacer region between L3 and a1/a2, the conserved nucleotides are as shown in FIG. 16 (SEQ ID NO: 19205), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 16 (SEQ ID NO: 19205).

Type IV Retron (FIG. 17)

In some embodiments, the template/wt retron for the subject engineered retron encodes a wild-type retron ncRNA polynucleotide having a consensus secondary structure that can be described as:

a1-S1-L1-L2-S2-L3-S3-a2, wherein:
a1/a2 is a stem 9 bp in length with no overhang;
L1 is a stem of 5 bps with a 6-nt tip;
L2 is a stem of 9 bps with a 4-nt tip;
L3 is a stem of 26 bps with a 5-nt tip, a 0/1 bulge 7 bps from the tip, and a 0/1 bulge 9 bps from the tip;
S1 is a single-stranded spacer region between the a1/a2 stem and L1, with no spacer region between L1 and L2;
S2 is a single-stranded spacer region between L2 and L3; and,
S3 is a single-stranded spacer region between L3 and the a1/a2 stem;

the conserved nucleotides are as shown in FIG. 17 (SEQ ID NO: 19206), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 17 (SEQ ID NO: 19206).

Type IX Retron (FIG. 18)

In some embodiments, the template/wt retron for the subject engineered retron encodes a wild-type retron ncRNA polynucleotide having a consensus secondary structure that can be described as:

a1-L1-S1-L2-S2-a2, wherein:
a1/a2 is a stem 12 bp in length, wherein a1 has a 14-nt overhang and a2 has a 2-nt overhang;
L1 is a stem of 11 bps with a 3-nt tip and a 1/3 bulge 7 bp from the tip;
L2 is a stem of 25 bps with a 7-nt tip;
S1 is a single-stranded spacer region between L1 and L2;
S2 is a single-stranded spacer region between L2 and a1/a2;

the conserved nucleotides are as shown in FIG. 18 (SEQ ID NO: 19207), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 18.

Type V Retron (FIG. 19)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 13 bps in length;
L1 is a stem of 20 bps with a 4-nt tip and a 6/4 bulge 6 bps from the tip;
L2 is a stem of 14 bps with a 4-nt tip and a 1/0 bulge 5 bps from the tip;
S1 is a single-stranded spacer region between a1/a2 and L1;
S2 is a single-stranded spacer region between L1 and L2;
S3 is a single-stranded spacer region between L2 and a1/a2, the conserved nucleotides are as shown in FIG. 19 (SEQ ID NO: 19208), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 19 (SEQ ID NO: 19208).

Type VI Retron (FIG. 20)

In some embodiments, the template/wt retron for the subject engineered retron encodes a wild-type retron ncRNA polynucleotide having a consensus secondary structure that can be described as:

a1-S1-L1-S2-L2-S3-L3-L4-S4-a2, wherein:
a1/a2 is a stem 4 bp in length with a 1 bp 5' overhang;
L1 is a stem of 7 bps with a 4-nt tip;
L2 is a stem of 8 bps with a 4-nt tip;
L3 is a stem of 16 bps with a 6-nt tip, a 3/4 bulge 3 bps from the tip, a 2/3 bulge 5 bps from the tip, and a 3/1 bulge 8 bps from the tip;
S1 is a single-stranded spacer region between the a1/a2 stem and L1;
S2 is a single-stranded spacer region between L1 and L2;
S3 is a single-stranded spacer region between L2 and L3, with no spacer region between L3 and L4;
S4 is a single-stranded spacer region between L4 and the a1/a2 stem; and, the conserved nucleotides are as shown in FIG. 20 (SEQ ID NO: 19209), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 20 (SEQ ID NO: 19209).

Type XI Group 1 Retron (FIG. 21)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 16 bps in length with a 5-nt overhang on a1, and a 3-nt overhang on a2;
L1 is a stem of 9 bps with a 3-nt tip;
L2 is a stem of 7 bps with a 13-nt tip;
S1 is a single-stranded spacer region between a1/a2 and L1;
S2 is a single-stranded spacer region between L1 and L2;
S3 is a single-stranded spacer region between L2 and a1/a2,
the conserved nucleotides are as shown in FIG. 21 (SEQ ID NO: 19210), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 21 (SEQ ID NO: 19210).

Type XI Group 2 Retron (FIG. 22)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 13 bps in length with a 1-nt overhang on a2;
L1 is a stem of 7 bps with a 3-nt tip and a 2/2 bulge 1 bp from the tip;
L2 is a stem of 8 bps with a 20-nt tip;
S1 is a single-stranded spacer region between a1/a2 and L1;
S2 is a single-stranded spacer region between L1 and L2;
S3 is a single-stranded spacer region between L2 and a1/a2,
the conserved nucleotides are as shown in FIG. 22 (SEQ ID NO: 19211), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 22 (SEQ ID NO: 19211).

Type XII Retron (FIG. 23)

In some embodiments, the template/wt retron for the subject engineered retron encodes a wild-type retron ncRNA polynucleotide having a consensus secondary structure that can be described as:

a1-S1-L1-S2-L2-S3-a2, wherein:
a1/a2 is a stem 13 bps in length with a 1-nt overhang on a2;
L1 is a stem of 7 bps with a 3-nt tip, and a 2/2 bulge 1 bp from the tip;
L2 is a stem of 8 bps with a 19-nt tip;
S1 is a single-stranded spacer region between a1/a2 and L1;
S2 is a single-stranded spacer region between L1 and L2;
S3 is a single-stranded spacer region between L2 and a1/a2,
the conserved nucleotides are as shown in FIG. 23 (SEQ ID NO: 19212), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 23 (SEQ ID NO: 19212).

Type XIII Retron (FIG. 24)

In some embodiments, the template/wt retron for the subject engineered retron encodes a wild-type retron ncRNA polynucleotide having a consensus secondary structure that can be described as:

a1-S1-L1-S2-L2-L3-S3-a2, wherein:
a1/a2 is a stem 7 bp in length with no overhangs;
L1 is a stem of 8 bps with a 3-nt tip;
L2 is a stem of 30 bps with a 8-nt tip, a 1/1 bulge 2 bps from the tip, and a 1/1 bulge 27 bps from the tip;
L3 is a stem of 8 bps with a 5-nt tip, and a 0/1 bulge 3 nt from the tip;
S1 is a single-stranded spacer region between the a1/a2 stem and L1;
S2 is a single-stranded spacer region between L1 and L2; and,
S3 is a single-stranded spacer region between L3 and the a1/a2 stem;
the conserved nucleotides are as shown in FIG. 24 (SEQ ID NO: 19213), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 24 (SEQ ID NO: 19213).

Type XIV Retron (FIG. 25)

In some embodiments, the template/wt retron for the subject engineered retron encodes a wild-type retron ncRNA polynucleotide having a consensus secondary structure that can be described as:

a1-S1-L1-L2-S2-L3-S3-a2, wherein:
the a1/a2 stem is 15 bp in length with no overhang, and a 4/2 bulge 7 bps from the 5' end of a1;
L1 is a stem of 8 bps with a 5-nt tip;
L2 is a stem of 7 bps with a 5-nt tip;
L3 is a stem of 13 bps with a 2-nt tip, a 5/9 bulge 5 bps from the tip, and a 5/5 bulge 8 bps from the tip;
S1, S2, and S3 are single-stranded spacer regions between the a1/a2 stem and L1, L2 and L3, and L3 and the a1/a2 stem, respectively, with no spacer between L1 and L2; and wherein the 5th-3rd last nts of S1 and the 2nd-5th 4 nts of S2 forms a 3-bp stem; and,
the conserved nucleotides are as shown in FIG. 25 (SEQ ID NO: 19214), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 25 (SEQ ID NO: 19214).

Ec107-Like Retron (FIG. 26)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
a1/a2 is a stem 12 bp in length;
L1 is a stem of 4 bps with a 8-nt tip;
L2 is a stem of 8 bps with a 3-nt tip;
L3 is a stem of 22 bps with a 3-nt tip, a 4/6 bulge 6 bp from the tip, a 3/3 bulge 13 bp from the tip, and a 1/1 bulge 18 bp from the tip;
S1 is a single-stranded spacer region between a1/a2 and L1;
S2 is a single-stranded spacer region between L1 and L2;
S3 is a single-stranded spacer region between L2 and L3; and
S4 is a single-stranded spacer region between L3 and a1/a2,
the conserved nucleotides are as shown in FIG. 26 (SEQ ID NO: 19215), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 26 (SEQ ID NO: 19215).

Outgroup A Retron (FIG. 27)

In some embodiments, the template/wt retron for the subject engineered retron encodes a wild-type retron ncRNA polynucleotide having a consensus secondary structure that can be described as:

a1-S1-L1-S2-L2-S3-L3-S4-a2, wherein:
a1/a2 is a stem 5 bps in length with a 2-nt overhang on a2;
L1 is a stem of 11 bps with a 4-nt tip;
L2 is a stem of 8 bps with a 3-nt tip;
L3 is a stem of 18 bps with a 3-nt tip;
S1 is a single-stranded spacer region between a1/a2 and L1;
S2 is a single-stranded spacer region between L1 and L2;
S3 is a single-stranded spacer region between L2 and L3;
S4 is a single-stranded spacer region between L3 and a1/a2,
the conserved nucleotides are as shown in FIG. 27 (SEQ ID NO: 19216), and wherein the colored circled nucleotides are present at the respective levels of certainty (e.g., at least about 97% of the red-circled nucleotides, at least about 90-97% of the black-circled nucleotides, at least about 75-90% of the grey-circled nucleotides, and at least about 50% of the white-circled nucleotides are present).

In some embodiments, the engineered retron is entirely synthetically produced and having the conserved nucleotides as denoted by the colored letters as shown in FIG. 27 (SEQ ID NO: 19216).

Amplification of an engineered retron described herein (e.g., in FIGS. 2-27 (SEQ ID NO:19191-19216)) may be performed, for example, before transfection of cells or ligation into vectors. Any method for amplifying the engineered retron may be used, including, but not limited to polymerase chain reaction (PCR), isothermal amplification, nucleic acid sequence-based amplification (NASBA), transcription mediated amplification (TMA), strand displacement amplification (SDA), and ligase chain reaction (LCR). In one embodiment, the engineered retron comprise common 5' and 3' priming sites to allow amplification of retron sequences in parallel with a set of universal primers. In another embodiment, a set of selective primers is used to selectively amplify a subset of retron sequences from a pooled mixture.

Variants of these templates, which can also be used in the engineered retron of the invention, include a variant having: A) up to 1, 2, or 3 (e.g., up to 1) nucleotide changes per 10 red lettered-nucleotides; B) up to 4, 5, or 6 (e.g., up to 1 or 2) nucleotide changes per 10 black lettered-nucleotides; and/or C) up to 7, 8, or 9 (e.g., up to 3 or 4) nucleotide changes per 10 grey lettered-nucleotides; and/or optionally further comprising: a) 7, 8, 9, or 10 (e.g., 9 or 10) nucleotides present per 10 red-circled nucleotides; b) 6, 7, 8, 9, or 10 (e.g., 8, 9 or 10) nucleotides present per 10 black-circled nucleotides; c) 4, 5, 6, 7, 8, 9, or 10 (e.g., 6, 7, 8, 9 or 10) nucleotides present per 10 grey-circled nucleotides; and/or d) 2, 3, 4, 5, 6, 7, 8, 9, or 10 (e.g., 4, 5, 6, 7, 8, 9, or 10) nucleotides present per 10 white-circled nucleotides.

In some embodiments, the non-coding RNA (ncRNA) portion of the engineered retron comprises a polynucleotide (e.g., a DNA molecule) encoding an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B. In some embodiments, the ncRNA does not comprise an ncRNA associated with the RT sequences of Table X.

B. Heterologous Nucleotide Sequence (HNS)

The engineered retron may comprise or encodes a heterologous nucleic acid (e.g., DNA or RNA) within the msr locus or the msd locus (such as in an S region or the tip of an L region in the consensus structure in any one of FIGS.

2-27 (SEQ ID NO:19191-19216), and variants thereof), or upstream or downstream of either the msr locus or the msd locus. In some embodiments, the heterologous nucleic acid is inserted within the msd locus. In some embodiments, the heterologous nucleic acid is inserted upstream of the msr locus. In some embodiments, the heterologous nucleic acid is inserted upstream or downstream of the msd locus. In other embodiments, the heterologous nucleic acid is inserted in spacer sequences (e.g., S1, S2, S3 and/or S4 as depicted in FIG. 2) between hairpin loops and/or within hairpin loops (e.g., L1, L2, L3 and/or L4 as depicted in FIG. 2), e.g., the tip or loop region, or within a bulge. In some embodiments, the heterologous nucleic acid sequence can be inserted in the tip of an L region or hairpin loop (e.g., L1, L2, L3 and/or L4 as depicted in FIG. 2). In some embodiments, one or more heterologous nucleic acids are inserted into the msd locus. In some embodiments, a first heterologous nucleic acid is inserted into the msd locus, and a second heterologous nucleic acid is inserted either upstream of the msr locus or upstream or downstream of the msd locus.

In some embodiments, the heterologous nucleic acid comprises flanking contiguous nucleotides (also referred to as homologous arms) that are substantially complementary to a target site genomic sequence of a cell to facilitate insertion of at least part of the heterologous nucleic acid into the genome of the cell at the target site via homology directed repair (HDR). In some embodiments, the heterologous nucleic acid is between >20 nucleotides and 10,000 nucleotides (e.g., including the flanking homologous arms).

In some embodiments, one or both of the homology arm(s) on the heterologous nucleic acid are 100% identical to a target genomic sequence. In some embodiments, one or both of the homology arm(s) on the heterologous nucleic acid are less than 100% complementary to the target genomic sequence, for example, 99%, 98%, 97%, 96%, 95%, 94%, 93%, 92%, 91%, or 90% identical to a target genomic sequence.

The part of the heterologous nucleic acid to be inserted into the target genome sequence is sometimes referred to as a donor sequence. The donor sequence may be partially identical to the full length or portions thereof of a target genomic sequence, or may be unrelated to the target genomic sequence. The donor sequence may be used, for example, to introduce modifications (e.g., substitutions, deletions, insertions, or a combination thereof) such as mutations or other genetic changes (e.g., genetic elements such as stop codons or a shift in an open reading frame on the target polynucleotide) into its target sequence.

In some embodiments, the heterologous nucleic acid sequence is or encodes a biologically active molecule such as, but not limited to, a therapeutic protein.

Any therapeutic proteins may be encoded by the heterologous nucleic acid.

In some embodiments, the heterologous nucleic acid sequences encodes one or more prophylactically- or therapeutically-active proteins, polypeptides, or other factors.

As a non-limiting example, the heterologous sequences may be or encode an agent that enhances tumor killing activity such as, but not limited to, TRAIL or tumor necrosis factor (TNF), in a cancer. As another non-limiting example, the heterologous sequences may be or encode an agent suitable for the treatment of conditions such as muscular dystrophy (e.g., heterologous sequences are or encode dystrophin or a functional fragment or variant thereof such as the numerous dystrophin minigenes or microdystrophine coding sequences known in the art), cardiovascular disease (e.g., heterologous sequences are or encode SERCA2a, GATA4, Tbx5, Mef2C, Hand2, Myocd, etc.), neurodegenerative disease (e.g., heterologous sequences is or encodes NGF, BDNF, GDNF, NT-3, etc.).

As additional non-limiting example, the heterologous nucleic acid sequence may be or encode an agent that enhances tumor killing activity such as, but not limited to, TRAIL or tumor necrosis factor (TNF), in a cancer. As another non-limiting example, the heterologous nucleic acid sequence may be or encode an agent suitable for the treatment of conditions such as muscular dystrophy (e.g., heterologous nucleic acid sequence is or encodes Dystrophin), cardiovascular disease (e.g., heterologous nucleic acid sequence is or encodes SERCA2a, GATA4, Tbx5, Mef2C, Hand2, Myocd, etc.), neurodegenerative disease (e.g., heterologous nucleic acid sequence is or encodes NGF, BDNF, GDNF, NT-3, etc.), chronic pain (e.g., heterologous nucleic acid sequence is or encodes GlyRal), an enkephalin, or a glutamate decarboxylase (e.g., heterologous nucleic acid sequence is or encodes GAD65, GAD67, or another isoform), lung disease (e.g., heterologous nucleic acid sequence is or encodes CFTR), hemophilia (e.g., heterologous nucleic acid sequence is or encodes Factor VIII or Factor IX), neoplasia (e.g., heterologous nucleic acid sequence is or encodes PTEN, ATM, ATR, EGFR, ERBB2, ERBB3, ERBB4, Notch1, Notch2, Notch3, Notch4, AKT, AKT2, AKT3, HIF, HI Fla, HIF3a, Met, HRG, Bcl2, PPARalpha, PPAR gamma, WT1 (Wilms Tumor), FGF Receptor Family members (5 members: 1, 2, 3, 4, 5), CDKN2a, APC, RB (retinoblastoma), MEN1, VHL, BRCA1, BRCA2, AR (Androgen Receptor), TSG101, IGF, IGF Receptor, Igf1 (4 variants), Igf2 (3 variants), Igf1 Receptor, Igf2 Receptor, Bax, Bcl2, caspases family (9 members: 1, 2, 3, 4, 6, 7, 8, 9, 12), Kras, Ape), age-related macular degeneration (e.g., heterologous nucleic acid sequence is or encodes Aber, Ccl2, Cc2, cp (ceruloplasmin), Timp3, cathepsin D, Vldlr), schizophrenia (e.g., Neuregulin (Nrgl), Erb4 (receptor for Neuregulin), Complexin-1 (Cplx1), Tph1 Tryptophan hydroxylase, Tph2 Tryptophan hydroxylase 2, Neurexin 1, GSK3, GSK3a, GSK3b, 5-HIT (Slc6a4), COMT, DRD (Drdla), SLC6A3, DAOA, DTNBPI, Dao (Daol)), trinucleotide repeat disorders (e.g., HTT (Huntington's Dx), SBMA/SMAXI/AR (Kennedy's Dx), FXN/X25 (Friedrich's Ataxia), ATX3 (Machado-Joseph's Dx), ATXNI and ATXN2 (spinocerebellar ataxias), DMPK (myotonic dystrophy), Atrophin-1 and Atnl (DRPLA Dx), CBP (Creb-BP-global instability), VLDLR (Alzheimer's), Atxn7, Atxn10), fragile X syndrome (e.g., heterologous nucleic acid sequence is or encodes FMR2, FXRI, FXR2, mGLUR5), secretase related disorders (e.g., heterologous nucleic acid sequence is or encodes APH-1 (alpha and beta), Presenilin (Psenl), nicastrin (Ncstn), PEN-2), ALS (e.g., heterologous nucleic acid sequence is or encodes SOD1, ALS2, STEX, FUS, TARD BP, VEGF (VEGF-a, VEGF-b, VEGF-c)), autism (e.g., heterologous nucleic acid sequence is or encodes Mecp2, BZRAP1, MDGA2, Sema5A, Neurexin 1), Alzheimer's disease (e.g., heterologous nucleic acid sequence is or encodes E1, CHIP, UCH, UBB, Tau, LRP, PICALM, Clusterin, PSi, SORL1, CR1, Vldlr, Uba1, Uba3, CHIP28 (Aqp1, Aquaporin 1), Uchl1, Uchl3, APP), inflammation (e.g., heterologous nucleic acid sequence is or encodes IL-10, IL-1 (IL-Ia, IL-Ib), IL-13, IL-17 (IL-17a (CTLA8), IL-17b, IL-17c, IL-17d, IL-171), 11-23, Cx3crl, ptpn22, TNFa, NOD2/CARD15 for IBD, IL-6, IL-12 (IL-12a, IL-12b), CTLA4, Cx3cll), Parkinson's Disease (e.g., x-Synuclein, DJ-1, LRRK2, Parkin, PINK1), blood and coagulation disorders, such as, e.g., anemia, bare lymphocyte syndrome, bleeding disorders, hemophagocytic lymphohistiocytosis disorders, hemophilia A, hemophilia B, hemorrhagic disorders, leukocyte deficiencies and disorders, sickle cell anemia, and thalassemia (e.g., heterologous nucleic acid sequence is or encodes CRAN1, CDA1, RPS19, DBA, PKLR, PK1, NT5C3, UMPH1, PSNI, RHAG, RH50A, NRAMP2, SPTB, ALAS2, ANH1, ASB, ABCB7, ABC7, ASAT, TAPBP, TPSN, TAP2, ABCB3, PSF2, RING11, MHC2TA, C2TA, RFX5, RFXAP, RFX5, TBXA2R, P2RX1, P2X1, HF1, CFH, HUS, MCFD2, FANCA, FAC A, FA1, FA, FA A, FAAP95, FAAP90, FLJ34064, FANCB, FANCC, FACC, BRCA2, FANCDI, FANCD2, FANCD, FACD, FAD, FANCE, FACE, FANCF, XRCC9, FANCG, BR1PI, BACH1, FANCJ, PHF9, FANCL, FANCM, KIAA1596, PRF1, HPLH2, UNC13D, MUNC13-4, HPLH3, HLH3, FHL3, F8, FSC, PI, ATT, F5, ITGB2, CD18, LCAMB, LAD, EIF2B1, EIF2BA, EIF2B2, EIF2B3, EIF2B5, LVWM, CACH, CLE, EIF2B4, HBB, HBA2, HBB, HBD, LCRB, HBA1), B-cell non-Hodgkin lymphoma or leukemia (e.g., heterologous nucleic acid sequence is or encodes BCL7A, BCL7, ALI, TCL5, SCL, TAL2, FLT3, NBS1, NBS, ZNFN1AI, 1KI, LYF1, HOXD4, HOX4B, BCR, CML, PHL, ALL, ARNT, KRAS2, RASK2, GMPS, AFIO, ARHGEF12, LARG, KIAA0382, CALM, CLTH, CEBPA, CEBP, CHIC2, BTL, FLT3, KIT, PBT, LPP, NPMI, NUP214, D9S46E, CAN, CAIN, RUNXI, CBFA2, AML1, WHSCILI, NSD3, FLT3, AF1Q, NPMI, NUMA1, ZNF145, PLZF, PML, MYL, STAT5B, AFlQ, CALM, CLTH, ARL11, ARLTS1, P2RX7, P2X7, BCR, CML, PHL, ALL, GRAF, NF1, VRNF, WSS, NFNS, PTPNII, PTP2C, SHP2, NS1, BCL2, CCND1, PRAD1, BCL1, TCRA, GATA1, GF1, ERYF1, NFE1, ABLI, NQO1, DIA4, NMOR1, NUP214, D9S46E, CAN, CAIN), inflammation and immune related diseases and disorders (e.g., heterologous nucleic acid sequence is or encodes KIR3DL1, NKAT3, NKB1, AMB11, K1R3DS1, IFNG, CXCL12, TNFRSF6, APT1, FAS, CD95, ALPS1A, IL2RG, SCIDX1, SCIDX, IMD4, CCL5, SCYA5, D17S136E, TCP228, IL10, CSIF, CMKBR2, CCR2, CMKBR5, CCCKR5 (CCR5), CD3E, CD3G, AICDA, AID, HIGM2, TNFRSF5, CD40, UNG, DGU, HIGM4, TNFSFS, CD40LG, HIGM1, IGM, FOXP3, IPEX, AIID, XPID, PIDX, TNFRSF14B, TACI), inflammation (e.g., heterologous nucleic acid sequence is or encodes IL-10, IL-1 (IL-IA, IL-IB), IL-13, IL-17 (IL-17a (CTLA8), IL-17b, IL-17c, IL-17d, IL-171), 11-23, Cx3crl, ptpn22, TNFa, NOD2/CARD15 for IBD, IL-6, IL-12 (IL-12a, IL-12b), CTLA4, Cx3cII), JAK3, JAKL, DCLREIC, ARTEMIS, SCIDA, RAG1, RAG2, ADA, PTPRC, CD45, LCA, IL7R, CD3D, T3D, IL2RG, SCIDXI, SCIDX, IMD4), metabolic, liver, kidney and protein diseases and disorders (e.g., heterologous nucleic acid sequence is or encodes TTR, PALB, APOA1, APP, AAA, CVAP, ADI, GSN, FGA, LYZ, TTR, PALB, KRT18, KRT8, CIRH1A, NAIC, TEX292, KIAA1988, CFTR, ABCC7, CF, MRP7, SLC2A2, GLUT2, G6PC, G6PT, G6PT1, GAA, LAMP2, LAMPB, AGL, GDE, GBE1, GYS2, PYGL, PFKM, TCF1, HNF1A, MODY3, SCOD1, SCO1, CTNNB1, PDGFRL, PDGRL, PRLTS, AX1NI, AXIN, CTNNB1, TP53, P53, LFS1, IGF2R, MPRI, MET, CASP8, MCH5, UMOD, HNFJ, FJHN, MCKD2, ADMCKD2, PAH, PKU1, QDPR, DHPR, PTS, FCYT, PKHD1, ARPKD, PKD1, PKD2, PKD4, PKDTS, PRKCSH, G19P1, PCLD, SEC63), muscular/skeletal diseases and disorders (e.g., heterologous nucleic acid sequence is or encodes DMD, BMD, MYF6, LMNA, LMN1, EMD2, FPLD, CMDIA, HGPS, LGMDIB, LMNA, LMNI, EMD2, FPLD, CMDIA, FSHMD1A, FSSHD1A, FKRP, MDC1C, LGMD2I, *LAMA2*, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDCIC, LGMD21, TTN, CMD1G, TMD, LGMD2J, POMT1, CAV3, LGMD1C, SEPN1, SELN, RSMD1, PLEC1, PLTN, EBS1, LRP5, BMND1, LRP7, LR3, OPPG, VBCH2, CLCN7, CLC7, OPTA2, OSTMI, GL, TCIRG1, TIRC7, OC116, OPTB1, VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARDI), neurological and neuronal diseases and disorders (e.g., heterologous nucleic acid sequence is or encodes SOD1, ALS2, STEX, FUS, TARDBP, VEGF (VEGF-a, VEGF-b, VEGF-c), APP, AAA, CVAP, ADI, APOE, AD2, PSEN2, AD4, STM2, APBB2, FE65LI, NOS3, PLAU, URK, ACE, DCPI, ACEI, MPO, PACIPI, PAXIPIL, PTIP, A2M, BLMH, BMH, PSEN1, AD3, Mecp2, BZRAP1, MDGA2, Sema5A, Neurexin 1, GLOl, MECP2, RTT, PPMX, MRX16, MRX79, NLGN3, NLGN4, KIAA1260, AUTSX2, FMR2, FXR1, FXR2, mGLUR5, HD, IT15, PRNP, PRIP, JPH3, JP3, HDL2, TBP, SCA17, NR4A2, NURR1, NOT, TINUR, SNCAIP, TBP, SCA17, SNCA, NACP, PARK1, PARK4, DJI, PARK7, LRRK2, PARK8, PINK1, PARK6, UCHL1, PARK5, SNCA, NACP, PARK1, PARK4, PRKN, PARK2, PDJ, DBH, NDUFV2, MECP2, RTT, PPMX, MRX16, MRX79, CDKL5, STK9, MECP2, RTT, PPMX, MRX16, MRX79, x-Synuclein, DJ-1, Neuregulin-1 (Nrgl), Erb4 (receptor for Neuregulin), Complexin-1 (Cplxl), Tph1 Tryptophan hydroxylase, Tph2, Tryptophan hydroxylase 2, Neurexin 1, GSK3, GSK3a, GSK3b, 5-HTT (Slc6a4), CONT, DRD (Drdla), SLC6A, DAOA, DTNBP1, Dao (Daol), APH-1 (alpha and beta), Presenilin (Psenl), Nicastrin, (Ncstn), PEN-2, Nos1, Parp1, Nat1, Nat2, HTT, SBMA/SMAX1/AR, FXN/X25, ATX3, TXN, ATXN2, DMPK, Atrophin-1, Atnl, CBP, VLDLR, Atxn7, and Atxn1O), and ocular diseases and disorders (e.g., Aber, Ccl2, Cc2, cp (ceruloplasmin), Timp3, cathepsin-D, Vldlr, Ccr2, CRYAA, CRYA1, CRYBB2, CRYB2, PITX3, BFSP2, CP49, CP47, CRYAA, CRYAI, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQPO, CRYAB, CRYA2, CTPP2, CRYBB1, CRYGD, CRYG4, CRYBB2, CRYB2, CRYGC, CRYG3, CCL, CRYAA, CRYAI, GJA8, CX50, CAE1, GJA3, CX46, CZP3, CAE3, CCM1, CAM, KRIT1, APOA1, TGFBI, CSD2, CDGG1, CSD, BIGH3, CDG2, TACSTD2, TROP2, MISI, VSX1, RINX, PPCD, PPD, KTCN, COL8A2, FECD, PPCD2, PIP5K3, CFD, KERA, CNA2, MYOC, TIGR, GLCIA, JO AG, GPOA, OPTN, GLC1E, FIP2, HYPL, NRP, CYPIBI, GLC3A, OPAl, NTG, NPG, CYP1BI, GLC3A, CRB1, RP12, CRX, CORD2, CRD, RPGRIPI, LCA6, CORD9, RPE65, RP20, AIPL1, LCA4, GUCY2D, GUC2D, LCA1, CORD6, RDH12, LCA3, ELOVL4, ADMD, STGD2, STGD3, RDS, RP7, PRPH2, PRPH, AVMD, AOFMD, and VMD2).

In some embodiments, the heterologous nucleic acid sequence is or encodes a factor that can affect the differentiation of a cell. As a non-limiting example, the expression of one or more of Oct4, Klf4, Sox2, c-Myc, L-Myc, dominant-negative p53, Nanog, Glis1, Lin28, TFIID, mir-302/367, or other miRNAs can cause the cell to become an induced pluripotent stem (iPS) cell.

In some embodiments, the heterologous nucleic acid sequence is or encodes a factor for transdifferentiating cells. Non-limiting examples of factors include: one or more of GATA4, Tbx5, Mef2C, Myocd, Hand2, SRF, Mesp1, SMARCD3 for cardiomyocytes; Ascii, Nurr1, Lmx1A, Bm2, Mytll, NeuroD1, FoxA2 for neural cells; and Hnf4a, Foxa1, Foxa2 or Foxa3 for hepatic cells.

In certain embodiments, the heterologous nucleic acid encodes a therapeutic antibody, or an antigen-binding fragment thereof.

In certain embodiments, the heterologous nucleic acid encodes a protein for replacement therapy. The protein may be defective in a disease cell or a disease organism/individual, and the wild-type protein or a functional fragment or variant thereof, when delivered by the heterologous nucleic acid to the disease cell/tissue/organism/individual, at least partially or fully restores the lost function of the protein the disease cell/tissue/organism/individual.

HNS=Donor DNA Template

In some embodiments, the heterologous nucleic acid sequence is a donor DNA template that can be integrated into a host genome via HDR.

In some embodiments, the heterologous nucleic acid sequence is a donor DNA that can serve as a template or primer for recombineering during replication.

In certain embodiments, the heterologous nucleic acid comprises or encodes a donor/template sequence, wherein the donor/template corrects/repairs/removes a mutation at the target genome site. For example, the mutation may be a mutated exon in a disease gene.

In certain embodiments, the donor/template may encode or comprises a functional DNA element, such as a promoter, an enhancer, a protein binding sequence, a methylation site, or a homology region for assisting gene editing, etc.

By "donor DNA" or "donor DNA template" it is meant a single-stranded DNA to be inserted at a site cleaved by a gene-editing nuclease (e.g., a CRISPR/Cas effector protein; a TALEN; a ZFN) (e.g., after dsDNA cleavage, after nicking a target DNA, after dual nicking a target DNA, and the like). The donor DNA template can contain sufficient homology to a genomic sequence at the target site, e.g., 70%, 80%, 85%, 90%, 95%, or 100% homology with the nucleotide sequences flanking the target site, e.g. within about 50 bases or less of the target site, e.g. within about 30 bases, within about 15 bases, within about 10 bases, within about 5 bases, or immediately flanking the target site, to support homology-directed repair between it and the genomic sequence to which it bears homology.

Approximately 25, 50, 100, or 200 nucleotides, or more than 200 nucleotides, of sequence homology between a donor DNA template and a genomic sequence (or any integral value between 10 and 200 nucleotides, or more) can support homology-directed repair. Donor DNA template can be of any length, e.g., 50 nucleotides or more, 100 nucleotides or more, 250 nucleotides or more, 500 nucleotides or more, 1000 nucleotides or more, 5000 nucleotides or more, etc. A suitable donor DNA template can be from 50 nucleotides to 100 nucleotides, from 100 nucleotides to 500 nucleotides, from 500 nucleotides to 1000 nucleotides, from 1000 nucleotides to 5000 nucleotides, or from 5000 nucleotides to 10,000 nucleotides, or more than 10,000 nucleotides, in length.

As noted above, the donor DNA template comprises a first homology arm and a second homology arm. The first homology arm is at or near the 5' end of the donor DNA; and comprises a nucleotide sequence that is at least partially complementary to a first nucleotide sequence in a target nucleic acid. The second homology arm is at or near the 3' end of the donor DNA; and comprises a nucleotide sequence that is at least partially complementary to a second nucleotide sequence in the target nucleic acid. The first and second homology arms can each independently have a length of from about 10 nucleotides to 400 nucleotides; e.g., from 10 nucleotides (nt) to 15 nt, from 15 nt to 20 nt, from 20 nt to 25 nt, from 25 nt to 30 nt, from 30 nt to 35 nt, from 35 nt to 40 nt, from 40 nt to 45 nt, from 45 nt to 50 nt, from 50 nt to 75 nt, from 75 nt to 100 nt, from 100 nt to 125 nt, from 125 nt to 150 nt, from 150 nt to 175 nt, from 175 nt to 200 nt, from 200 nt to 225 nt, from 225 nt to 250 nt, from 250 nt to 275 nt, from 275 nt to 300 nt, from 325 nt to 350 nt, from 350 nt to 375 nt, or from 375 nt to 400 nt.

In certain embodiments, the donor DNA template is used for editing the target nucleotide sequence. In certain embodiments, the donor DNA template comprises one or more mutations to be introduced into the target polynucleotide. Examples of such mutations include substitutions, deletions, insertions, or a combination thereof. In certain embodiments, the mutation causes a shift in an open reading frame on the target polynucleotide. In certain embodiments, the donor polynucleotide alters a stop codon in the target polynucleotide. In certain embodiments, the donor polynucleotide corrects a premature stop codon. The correction can be achieved by deleting the stop codon, or by introducing one or more sequence changes to alter the stop codon to a codon. In certain embodiments, the donor polynucleotide addresses loss of function mutations, deletions, or translocations that may occur, for example, in certain disease contexts by inserting or restoring a functional copy of a gene, or functional fragment thereof, or a functional regulatory sequence or functional fragment of a regulatory sequence. A functional fragment includes a fragment less than the entire copy of a gene but otherwise provides sufficient nucleotide sequence to restore the functionality of a wild type gene or non-coding regulatory sequence (e.g., sequences encoding long non-coding RNA).

In certain embodiments, the donor DNA template may be used to replace a single allele of a defective gene or defective fragment thereof. In another embodiment, the donor DNA template is used to replace both alleles of a defective gene or defective gene fragment. A "defective gene" or "defective gene fragment" is a gene or portion of a gene that when expressed, fails to generate a functioning protein or non-coding RNA with functionality of the corresponding wild-type gene.

In certain example embodiments, these defective genes may be associated with one or more disease phenotypes. In certain example embodiments, the defective gene or gene fragment is not replaced but the heterologous nucleic acid is used to insert donor polynucleotides that encode gene or gene fragments that compensate for or override defective gene expression such that cell phenotypes associated with defective gene expression are eliminated or changed to a different or desired cellular phenotype. This can be achieved by including the coding sequence of a therapeutic protein, such as a therapeutic antibody or functional fragment thereof, or a wild-type version of a defective protein associated with one or more disease phenotypes.

In certain embodiments, the donor may include, but not be limited to, genes or gene fragments, encoding proteins or RNA transcripts to be expressed, regulatory elements, repair templates, and the like. According to the invention, the donor polynucleotides may comprise left end and right end sequence elements that function with transposition components that mediate insertion.

In certain embodiments, the donor DNA template manipulates a splicing site on the target polynucleotide. In certain embodiments, the donor DNA template disrupts a splicing site. The disruption may be achieved by inserting the polynucleotide to a splicing site and/or introducing one or more mutations to the splicing site. In certain embodiments, the donor polynucleotide may restore a splicing site. For example, the polynucleotide may comprise a splicing site sequence.

In certain embodiments, the donor DNA template to be inserted has a size from 10 bp to 50 kb in length, e.g., from 50 bp to ~40 kb, from 100 bp to ~30 kb, from 100 bp to ~10 kb, from 100 bp to 300 bp, from 200 bp to 400 bp, from 300 bp to 500 bp, from 400 bp to 600 bp, from 500 bp to 700 bp, from 600 bp to 800 bp, from 700 bp to 900 bp, from 800 bp to 1000 bp, from 900 bp to 1100 bp, from 1000 bp to 1200 bp, from 1100 bp to 1300 bp, from 1200 bp to 1400 bp, from 1300 bp to 1500 bp, from 1400 bp to 1600 bp, from 1500 bp to 1700 bp, from 1600 bp to 1800 bp, from 1700 bp to 1900 bp, from 1800 bp to 2000 bp nucleotides in length.

In certain embodiments, the homologous arm on one or both ends of the sequence to be inserted is independently about 20 bp, 40 bp, 60 bp, 80 bp, 100 bp, 120 bp, or 150 bp.

The first homology arm and the second homology arm of the donor DNA flank a nucleotide sequence ("a nucleotide sequence of interest" or "an intervening nucleotide sequence") that is to be introduced into a target nucleic acid. The nucleotide sequence of interest can comprise: i) a nucleotide sequence encoding a polypeptide of interest; ii) a nucleotide sequence encoding an exon of a gene; iii) a promoter sequence; iv) an enhancer sequence; v) a nucleotide sequence encoding a non-coding RNA; or vi) any combination of the foregoing.

The donor DNA can provide for gene correction, gene replacement, gene tagging, transgene insertion, nucleotide deletion, gene disruption, gene mutation, etc. For example, the donor DNA can be used to add, e.g., insert or replace, nucleic acid material to a target DNA (e.g. to "knock in" a nucleic acid that encodes a protein, an siRNA, an miRNA, etc.), to add a tag (e.g., 6×His, a fluorescent protein (e.g., a green fluorescent protein; a yellow fluorescent protein, etc.), hemagglutinin (HA), FLAG, etc.), to add a regulatory sequence to a gene (e.g. promoter, polyadenylation signal, internal ribosome entry sequence (IRES), 2A peptide, start codon, stop codon, splice signal, localization signal, enhancer, etc.), to modify a nucleic acid sequence (e.g., introduce a mutation), and the like. For example, the donor DNA can be used to modify DNA in a site-specific, i.e. "targeted", way; for example gene knock-out, gene knock-in, gene editing, gene tagging, etc., as used in, for example, gene therapy, e.g. to treat a disease; or as an antiviral, antipathogenic, or anticancer therapeutic, the production of genetically modified organisms in agriculture, the large scale production of proteins by cells for therapeutic, diagnostic, or research purposes, the induction of pluripotent stem cells, biological research, the targeting of genes of pathogens for deletion or replacement, etc.

In some cases, the donor DNA comprises a nucleotide sequence encoding a polypeptide of interest. Polypeptides of interest include, e.g., a) functional versions of a polypeptide that comprises one or more amino acid substitutions, insertions, and/or deletions and that exhibits reduced function, e.g., where the reduced function is associated with or causes a pathological condition; b) fluorescent polypeptides; c) hormones; d) receptors for ligands; e) ion channels; f) neurotransmitters; g) and the like.

In some cases, the donor DNA comprises a nucleotide sequence that encodes a wild-type protein that is lacking in the recipient cell. In some cases, the donor DNA encodes a wild type factor (e.g. Factor VII, Factor VIII, Factor IX and the like) involved in coagulation. In some cases, the donor DNA comprises a nucleotide sequence that encodes a therapeutic antibody. In some cases, the donor DNA comprises a nucleotide sequence that encodes an engineered protein or receptor. In some cases, the engineered receptor is a T cell receptor (TCR), a natural killer (NK) receptor (NKR), or a B cell receptor (BCR). In some cases, the engineered TCR or NKR targets a cancer marker (e.g., a polypeptide that is expressed (e.g., over-expressed) on the surface of a cancer cell). In some cases, the donor DNA comprises a nucleotide sequence that encodes a chimeric antigen receptor (CAR). In some cases, the CAR targets a cancer marker. Donor DNAs encoding CAR, TCR, and/or NCR proteins may be folded into DNA origami structures (DNA nanostructures) and delivered into T cells or NK cells in vitro or in vivo.

Non-limiting examples of polypeptides that can be encoded by a donor DNA include, e.g., IL1B (interleukin 1, beta), XDH (xanthine dehydrogenase), TP53 (tumor protein p53), PTGIS (prostaglandin I2 (prostacyclin) synthase), MB (myoglobin), IL4 (interleukin 4), ANGPT1 (angiopoietin 1), ABCG8 (ATP-binding cassette, sub-family G (WHITE), member 8), CTSK (cathepsin K), PTGIR (prostaglandin I2 (prostacyclin) receptor (IP)), KCNJ11 (potassium inwardly-rectifying channel, subfamily J, member 11), INS (insulin), CRP (C-reactive protein, pentraxin-related), PDGFRB (platelet-derived growth factor receptor, beta polypeptide), CCNA2 (cyclin A2), PDGFB (platelet-derived growth factor beta polypeptide (simian sarcoma viral (v-sis) oncogene homolog)), KCNJ5 (potassium inwardly-rectifying channel, subfamily J, member 5), KCNN3 (potassium intermediate/ small conductance calcium-activated channel, subfamily N, member 3), CAPN10 (calpain 10), PTGES (prostaglandin E synthase), ADRA2B (adrenergic, alpha-2B-, receptor), ABCG5 (ATP-binding cassette, sub-family G (WHITE), member 5), PRDX2 (peroxiredoxin 2), CAPN5 (calpain 5), PARP14 (poly (ADP-ribose) polymerase family, member 14), MEX3C (mex-3 homolog C (*C. elegans*)), ACE angiotensin I converting enzyme (peptidyl-dipeptidase A) 1), TNF (tumor necrosis factor (TNF superfamily, member 2)), IL6 (interleukin 6 (interferon, beta 2)), STN (statin), SERPINE1 (serpin peptidase inhibitor, clade E (nexin, plasminogen activator inhibitor type 1), member 1), ALB (albumin), ADIPOQ (adiponectin, C1Q and collagen domain containing), APOB (apolipoprotein B (including Ag(x) antigen)), APOE (apolipoprotein E), LEP (leptin), MTHFR (5,10-methylenetetrahydrofolate reductase (NADPH)), APOA1 (apolipoprotein A-I), EDN1 (endothelin 1), NPPB (natriuretic peptide precursor B), NOS3 (nitric oxide synthase 3 (endothelial cell)), PPARG (peroxisome proliferator-activated receptor gamma), PLAT (plasminogen activator, tissue), PTGS2 (prostaglandin-endoperoxide synthase 2 (prostaglandin G/H synthase and cyclooxygenase)), CETP (cholesteryl ester transfer protein, plasma), AGTR1 (angiotensin II receptor, type 1), HMGCR (3-hydroxy-3-methylglutaryl-Coenzyme A reductase), IGF1 (insulin-like growth factor 1 (somatomedin C)), SELE (selectin E), REN (renin), PPARA (peroxisome proliferator-activated receptor alpha), PON1 (paraoxonase 1), KNG1 (kininogen 1), CCL2 (chemokine (C-C motif) ligand 2), LPL (lipoprotein lipase), vWF (von Willebrand factor), F2 (coagulation factor II (thrombin)), ICAM1 (intercellular adhesion molecule 1), TGFB1 (transforming growth factor, beta 1), NPPA (natriuretic peptide precursor A), IL10 (interleukin 10), EPO (erythropoietin), SOD1 (superoxide dismutase 1, soluble), VCAM1 (vascular cell adhesion molecule 1), IFNG (interferon, gamma), LPA (lipoprotein, Lp(a)), MPO (myeloperoxidase), ESR1 (estrogen receptor 1), MAPK1 (mitogen-activated protein kinase 1), HP (haptoglobin), F3

(coagulation factor III (thromboplastin, tissue factor)), CST3 (cystatin C), COG2 (component of oligomeric Golgi complex 2), MMP9 (matrix metallopeptidase 9 (gelatinase B, 92 kDa gelatinase, 92 kDa type IV collagenase)), SERPINC1 (serpin peptidase inhibitor, clade C (antithrombin), member 1), F8 (coagulation factor VIII, procoagulant component), HMOX1 (heme oxygenase (decycling) 1), APOC3 (apolipoprotein C-III), IL8 (interleukin 8), PROK1 (prokineticin 1), CBS (cystathionine-beta-synthase), NOS2 (nitric oxide synthase 2, inducible), TLR4 (toll-like receptor 4), SELP (selectin P (granule membrane protein 140 kDa, antigen CD62)), ABCA1 (ATP-binding cassette, sub-family A (ABC1), member 1), AGT (angiotensinogen (serpin peptidase inhibitor, clade A, member 8)), LDLR (low density lipoprotein receptor), GPT (glutamic-pyruvate transaminase (alanine aminotransferase)), VEGFA (vascular endothelial growth factor A), NR3C2 (nuclear receptor subfamily 3, group C, member 2), IL18 (interleukin 18 (interferon-gamma-inducing factor)), NOS1 (nitric oxide synthase 1 (neuronal)), NR3C1 (nuclear receptor subfamily 3, group C, member 1 (glucocorticoid receptor)), FGB (fibrinogen beta chain), HGF (hepatocyte growth factor (hepapoietin A; scatter factor)), IL1A (interleukin 1, alpha), RETN (resistin), AKT1 (v-akt murine thymoma viral oncogene homolog 1), LIPC (lipase, hepatic), HSPD1 (heat shock 60 kDa protein 1 (chaperonin)), MAPK14 (mitogen-activated protein kinase 14), SPP1 (secreted phosphoprotein 1), ITGB3 (integrin, beta 3 (platelet glycoprotein 111a, antigen CD61)), CAT (catalase), UTS2 (urotensin 2), THBD (thrombomodulin), F10 (coagulation factor X), CP (ceruloplasmin (ferroxidase)), TNFRSF11B (tumor necrosis factor receptor superfamily, member lib), EDNRA (endothelin receptor type A), EGFR (epidermal growth factor receptor (erythroblastic leukemia viral (v-erb-b) oncogene homolog, avian)), MMP2 (matrix metallopeptidase 2 (gelatinase A, 72 kDa gelatinase, 72 kDa type IV collagenase)), PLG (plasminogen), NPY (neuropeptide Y), RHOD (ras homolog gene family, member D), MAPK8 (mitogen-activated protein kinase 8), MYC (v-myc myelocytomatosis viral oncogene homolog (avian)), FN1 (fibronectin 1), CMA1 (chymase 1, mast cell), PLAU (plasminogen activator, urokinase), GNB3 (guanine nucleotide binding protein (G protein), beta polypeptide 3), ADRB2 (adrenergic, beta-2-, receptor, surface), APOA5 (apolipoprotein A-V), SOD2 (superoxide dismutase 2, mitochondrial), F5 (coagulation factor V (proaccelerin, labile factor)), VDR (vitamin D (1,25-dihydroxyvitamin D3) receptor), ALOX5 (arachidonate 5-lipoxygenase), HLA-DRB1 (major histocompatibility complex, class II, DR beta 1), PARP1 (poly (ADP-ribose) polymerase 1), CD40LG (CD40 ligand), PON2 (paraoxonase 2), AGER (advanced glycosylation end product-specific receptor), IRS1 (insulin receptor substrate 1), PTGS1 (prostaglandin-endoperoxide synthase 1 (prostaglandin G/H synthase and cyclooxygenase)), ECE1 (endothelin converting enzyme 1), F7 (coagulation factor VII (serum prothrombin conversion accelerator)), URN (interleukin 1 receptor antagonist), EPHX2 (epoxide hydrolase 2, cytoplasmic), IGFBP1 (insulin-like growth factor binding protein 1), MAPK10 (mitogen-activated protein kinase 10), FAS (Fas (TNF receptor superfamily, member 6)), ABCB1 (ATP-binding cassette, subfamily B (MDR/TAP), member 1), JUN (jun oncogene), IGFBP3 (insulin-like growth factor binding protein 3), CD14 (CD14 molecule), PDE5A (phosphodiesterase 5A, cGMP-specific), AGTR2 (angiotensin II receptor, type 2), CD40 (CD40 molecule, TNF receptor superfamily member 5), LCAT (lecithin-cholesterol acyltransferase), CCR5 (chemokine (C-C motif) receptor 5), MMP1 (matrix metallopeptidase 1 (interstitial collagenase)), TIMP1 (TIMP metallopeptidase inhibitor 1), ADM (adrenomedullin), DYT10 (dystonia 10), STAT3 (signal transducer and activator of transcription 3 (acute-phase response factor)), MMP3 (matrix metallopeptidase 3 (stromelysin 1, progelatinase)), ELN (elastin), USF1 (upstream transcription factor 1), CFH (complement factor H), HSPA4 (heat shock 70 kDa protein 4), MMPP12 (matrix metallopeptidase 12 (macrophage elastase)), MME (membrane metallo-endopeptidase), F2R (coagulation factor II (thrombin) receptor), SELL (selectin L), CTSB (cathepsin B), ANXA5 (annexin A5), ADRB1 (adrenergic, beta-1-, receptor), CYBA (cytochrome b-245, alpha polypeptide), FGA (fibrinogen alpha chain), GGT1 (gamma-glutamyltransferase 1), LIPG (lipase, endothelial), HIF1A (hypoxia inducible factor 1, alpha subunit (basic helix-loop-helix transcription factor)), CXCR4 (chemokine (C-X-C motif) receptor 4), PROC (protein C (inactivator of coagulation factors Va and Villa)), SCARB1 (scavenger receptor class B, member 1), CD79A (CD79a molecule, immunoglobulin-associated alpha), PLTP (phospholipid transfer protein), ADD1 (adducin 1 (alpha)), FGG (fibrinogen gamma chain), SAA1 (serum amyloid A1), KCNH2 (potassium voltage-gated channel, subfamily H (eag-related), member 2), DPP4 (dipeptidyl-peptidase 4), G6PD (glucose-6-phosphate dehydrogenase), NPR1 (natriuretic peptide receptor A/guanylate cyclase A (atrionatriuretic peptide receptor A)), VTN (vitronectin), KIAA0101 (KIAA0101), FOS (FBJ murine osteosarcoma viral oncogene homolog), TLR2 (toll-like receptor 2), PPIG (peptidylprolyl isomerase G (cyclophilin G)), IL1R1 (interleukin 1 receptor, type I), AR (androgen receptor), CYP1A1 (cytochrome P450, family 1, subfamily A, polypeptide 1), SERPINA1 (serpin peptidase inhibitor, clade A (alpha-1 antiproteinase, antitrypsin), member 1), MTR (5-methyltetrahydrofolate-homocysteine methyltransferase), RBP4 (retinol binding protein 4, plasma), APOA4 (apolipoprotein A-IV), CDKN2A (cyclin-dependent kinase inhibitor 2A (melanoma, p16, inhibits CDK4)), FGF2 (fibroblast growth factor 2 (basic)), EDNRB (endothelin receptor type B), ITGA2 (integrin, alpha 2 (CD49B, alpha 2 subunit of VLA-2 receptor)), CAB INI (calcineurin binding protein 1), SHBG (sex hormone-binding globulin), HMGB1 (high-mobility group box 1), HSP90B2P (heat shock protein 90 kDa beta (Grp94), member 2 (pseudogene)), CYP3A4 (cytochrome P450, family 3, subfamily A, polypeptide 4), GJA1 (gap junction protein, alpha 1, 43 kDa), CAV1 (caveolin 1, caveolae protein, 22 kDa), ESR2 (estrogen receptor 2 (ER beta)), LTA (lymphotoxin alpha (TNF superfamily, member 1)), GDF15 (growth differentiation factor 15), BDNF (brain-derived neurotrophic factor), CYP2D6 (cytochrome P450, family 2, subfamily D, polypeptide 6), NGF (nerve growth factor (beta polypeptide)), SP1 (Sp 1 transcription factor), TGIF1 (TGFB-induced factor homeobox 1), SRC (v-src sarcoma (Schmidt-Ruppin A-2) viral oncogene homolog (avian)), EGF (epidermal growth factor (beta-urogastrone)), PIK3CG (phosphoinositide-3-kinase, catalytic, gamma polypeptide), HLA-A (major histocompatibility complex, class I, A), KCNQ1 (potassium voltage-gated channel, KQT-like subfamily, member 1), CNR1 (cannabinoid receptor 1 (brain)), FBN1 (fibrillin 1), CHKA (choline kinase alpha), BEST1 (bestrophin 1), APP (amyloid beta (A4) precursor protein), CTNNB1 (catenin (cadherin-associated protein), beta 1, 88 kDa), IL2 (interleukin 2), CD36 (CD36 molecule (thrombospondin receptor)), PRKAB1 (protein kinase, AMP-activated, beta 1 non-catalytic subunit), TPO (thyroid peroxidase), ALDH7A1 (aldehyde dehydrogenase 7 family, member A1), CX3CR1 (chemokine (C-X3-C motif) receptor 1), TH (tyrosine hydroxylase), F9 (coagulation factor IX), GH1 (growth hormone 1), TF (transferrin), HFE (hemochromatosis), IE17A (interleukin 17A), PTEN (phosphatase and tensin homolog), GSTM1 (glutathione S-transferase mu 1), DMD (dystrophin), GATA4 (GATA binding protein 4), F13A1 (coagulation factor XIII, A1 polypeptide), TTR (transthyretin), FABP4 (fatty acid binding protein 4, adipocyte), PON3 (paraoxonase 3), APOC1 (apolipoprotein C-I), INSR (insulin receptor), TNFRSF1B (tumor necrosis factor receptor superfamily, member IB), HTR2A (5-hydroxytryptamine (serotonin) receptor 2A), CSF3 (colony stimulating factor 3 (granulocyte)), CYP2C9 (cytochrome P450, family 2, subfamily C, polypeptide 9), TXN (thioredoxin), CYP11B2 (cytochrome P450, family 11, subfamily B, polypeptide 2), PTH (parathyroid hormone), CSF2 (colony stimulating factor 2 (granulocyte-macrophage)), KDR (kinase insert domain receptor (a type III receptor tyrosine kinase)), PLA2G2A (phospholipase A2, group IIA (platelets, synovial fluid)), B2M (beta-2-microglobulin), THBS1 (thrombospondin 1), GCG (glucagon), RHOA (ras homolog gene family, member A), ALDH2 (aldehyde dehydrogenase 2 family (mitochondrial)), TCF7L2 (transcription factor 7-like 2 (T-cell specific, HMG-box)), BDKRB2 (bradykinin receptor B2), NFE2L2 (nuclear factor (erythroid-derived 2)-like 2), NOTCH1 (Notch homolog 1, translocation-associated (*Drosophila*)), UGT1A1 (UDP glucuronosyltransferase 1 family, polypeptide A1), IFNA1 (interferon, alpha 1), PPARD (peroxisome proliferator-activated receptor delta), SIRT1 (sirtuin (silent mating type information regulation 2 homolog) 1 (*S. cerevisiae*)), GNRH1 (gonadotropin-releasing hormone 1 (luteinizing-releasing hormone)), PAPPA (pregnancy-associated plasma protein A, pappalysin 1), ARR3 (arrestin 3, retinal (X-arrestin)), NPPC (natriuretic peptide precursor C), AHSP (alpha hemoglobin stabilizing protein), PTK2 (PTK2 protein tyrosine kinase 2), IL13 (interleukin 13), MTOR (mechanistic target of rapamycin (serine/threonine kinase)), ITGB2 (integrin, beta 2 (complement component 3 receptor 3 and 4 subunit)), GSTT1 (glutathione S-transferase theta 1), IL6ST (interleukin 6 signal transducer (gp130, oncostatin M receptor)), CPB2 (carboxypeptidase B2 (plasma)), CYP1A2 (cytochrome P450, family 1, subfamily A, polypeptide 2), HNF4A (hepatocyte nuclear factor 4, alpha), SLC6A4 (solute carrier family 6 (neurotransmitter transporter, serotonin), member 4), PLA2G6 (phospholipase A2, group VI (cytosolic, calcium-independent)), TNFSF11 (tumor necrosis factor (ligand) superfamily, member 11), SLC8A1 (solute carrier family 8 (sodium/calcium exchanger), member 1), F2RL1 (coagulation factor II (thrombin) receptor-like 1), AKR1A1 (aldo-keto reductase family 1, member A1 (aldehyde reductase)), ALDH9A1 (aldehyde dehydrogenase 9 family, member A1), BGLAP (bone gamma-carboxyglutamate (gla) protein), MTTP (microsomal triglyceride transfer protein), MTRR (5-methyltetrahydrofolate-homocysteine methyltransferase reductase), SULT1A3 (sulfotransferase family, cytosolic, 1A, phenol-preferring, member 3), RAGE (renal tumor antigen), C4B (complement component 4B (Chido blood group), P2RY12 (purinergic receptor P2Y, G-protein coupled, 12), RNLS (renalase, FAD-dependent amine oxidase), CREB1 (cAMP responsive element binding protein 1), POMC (proopiomelanocortin), RAC1 (ras-related C3 botulinum toxin substrate 1 (rho family, small GTP binding protein Rac1)), LMNA (lamin NC), CD59 (CD59 molecule, complement regulatory protein), SCN5A (sodium channel, voltage-gated, type V, alpha subunit), CYP1B1 (cytochrome P450, family 1, subfamily B, polypeptide 1), MIF (macrophage migration inhibitory factor (glycosylation-inhibiting factor)), MMP13 (matrix metallopeptidase 13 (collagenase 3)), TIMP2 (TIMP metallopeptidase inhibitor 2), CYP19A1 (cytochrome P450, family 19, subfamily A, polypeptide 1), CYP21A2 (cytochrome P450, family 21, subfamily A, polypeptide 2), PTPN22 (protein tyrosine phosphatase, non-receptor type 22 (lymphoid)), MYH14 (myosin, heavy chain 14, non-muscle), MBL2 (mannose-binding lectin (protein C) 2, soluble (opsonic defect)), SELPLG (selectin P ligand), AOC3 (amine oxidase, copper containing 3 (vascular adhesion protein 1)), CTSL1 (cathepsin L1), PCNA (proliferating cell nuclear antigen), IGF2 (insulin like growth factor 2 (somatomedin A)), ITGB1 (integrin, beta 1 (fibronectin receptor, beta polypeptide, antigen CD29 includes MDF2, MSK12)), CAST (calpastatin), CXCL12 (chemokine (C-X-C motif) ligand 12 (stromal cell-derived factor 1)), IGHE (immunoglobulin heavy constant epsilon), KCNE1 (potassium voltage-gated channel, Isk-related family, member 1), TFRC (transferrin receptor (p90, CD71)), COL1A1 (collagen, type I, alpha 1), COL1A2 (collagen, type I, alpha 2), IL2RB (interleukin 2 receptor, beta), PLA2G10 (phospholipase A2, group X), ANGPT2 (angiopoietin 2), PROCR (protein C receptor, endothelial (EPCR)), NOX4 (NADPH oxidase 4), HAMP (hepcidin antimicrobial peptide), PTPN11 (protein tyrosine phosphatase, non-receptor type 11), SLC2A1 (solute carrier family 2 (facilitated glucose transporter), member 1), IL2RA (interleukin 2 receptor, alpha), CCL5 (chemokine (C-C motif) ligand 5), IRF1 (interferon regulatory factor 1), CFLAR (CASP8 and FADD-like apoptosis regulator), CALC A (calcitonin-related polypeptide alpha), EIF4E (eukaryotic translation initiation factor 4E), GSTP1 (glutathione S-transferase pi 1), JAK2 (Janus kinase 2), CYP3A5 (cytochrome P450, family 3, subfamily A, polypeptide 5), HSPG2 (heparan sulfate proteoglycan 2), CCL3 (chemokine (C-C motif) ligand 3), MYD88 (myeloid differentiation primary response gene (88)), VIP (vasoactive intestinal peptide), SOAT1 (sterol O-acyltransferase 1), ADRBK1 (adrenergic, beta, receptor kinase 1), NR4A2 (nuclear receptor subfamily 4, group A, member 2), MMP8 (matrix metallopeptidase 8 (neutrophil collagenase)), NPR2 (natriuretic peptide receptor B/guanylate cyclase B (atrionatriuretic peptide receptor B)), GCH1 (GTP cyclohydrolase 1), EPRS (glutamyl-prolyl-tRNA synthetase), PPARGC1A (peroxisome proliferator-activated receptor gamma, coactivator 1 alpha), F12 (coagulation factor XII (Hageman factor)), PEC AMI (platelet/endothelial cell adhesion molecule), CCL4 (chemokine (C-C motif) ligand 4), SERPINA3 (serpin peptidase inhibitor, clade A (alpha-1 antiproteinase, antitrypsin), member 3), CASR (calcium-sensing receptor), GJA5 (gap junction protein, alpha 5, 40 kDa), FABP2 (fatty acid binding protein 2, intestinal), TTF2 (transcription termination factor, RNA polymerase II), PROS1 (protein S (alpha)), CTF1 (cardiotrophin 1), SGCB (sarcoglycan, beta (43 kDa dystrophin-associated glycoprotein)), YME1L1 (YME1-like 1 (*S. cerevisiae*)), CAMP (cathelicidin antimicrobial peptide), ZC3H12A (zinc finger CCCH-type containing 12A), AKR1B1 (aldo-keto reductase family 1, member B1 (aldose reductase)), DES (desmin), MMP7 (matrix metallopeptidase 7 (matrilysin, uterine)), AHR (aryl hydrocarbon receptor), CSF1 (colony stimulating factor 1 (macrophage)), HDAC9 (histone deacetylase 9), CTGF (connective tissue growth factor), KCNMA1 (potassium large conductance calcium-activated channel, subfamily M, alpha member 1), UGT1A (UDP glucuronosyltransferase 1 family, polypeptide A complex locus), PRKCA (protein kinase C, alpha), COMT (catechol-b-methyltransferase), S100B (S100 calcium binding protein B), EGR1 (early growth response 1), PRL (prolactin), IL15 (interleukin 15), DRD4 (dopamine receptor D4), CAMK2G (calcium/calmodulin-dependent protein kinase II gamma), SLC22A2 (solute carrier family 22 (organic cation transporter), member 2), CCL11 (chemokine (C-C motif) ligand 11), PGF (placental growth factor), THPO (thrombopoietin), GP6 (glycoprotein VI (platelet)), TACR1 (tachykinin receptor 1), NTS (neurotensin), HNF1A (HNF1 homeobox A), SST (somatostatin), KCND1 (potassium voltage-gated channel, Shal-related subfamily, member 1), LOC646627 (phospholipase inhibitor), TBXAS1 (thromboxane A synthase 1 (platelet)), CYP2J2 (cytochrome P450, family 2, subfamily J, polypeptide 2), TBXA2R (thromboxane A2 receptor), ADH1C (alcohol dehydrogenase 1C (class I), gamma polypeptide), ALOX12 (arachidonate 12-lipoxygenase), AHSG (alpha-2-HS-glycoprotein), BHMT (betaine-homocysteine methyltransferase), GJA4 (gap junction protein, alpha 4, 37 kDa), SLC25A4 (solute carrier family 25 (mitochondrial carrier; adenine nucleotide translocator), member 4), ACLY (ATP citrate lyase), ALOX5AP (arachidonate 5-lipoxygenase-activating protein), NUMA1 (nuclear mitotic apparatus protein 1), CYP27B1 (cytochrome P450, family 27, subfamily B, polypeptide 1), CYSLTR2 (cysteinyl leukotriene receptor 2), SOD3 (superoxide dismutase 3, extracellular), LTC4S (leukotriene C4 synthase), UCN (urocortin), GHRL (ghrelin/obestatin prepropeptide), APOC2 (apolipoprotein C-II), CLEC4A (C-type lectin domain family 4, member A), KBTBD10 (kelch repeat and BTB (POZ) domain containing 10), TNC (tenascin C), TYMS (thymidylate synthetase), SHC1 (SHC (Src homology 2 domain containing) transforming protein 1), LRP1 (low density lipoprotein receptor-related protein 1), SOCS3 (suppressor of cytokine signaling 3), ADH1B (alcohol dehydrogenase IB (class I), beta polypeptide), KLK3 (kallikrein-related peptidase 3), HSD11B1 (hydroxysteroid (11-beta) dehydrogenase 1), VKORC1 (vitamin K epoxide reductase complex, subunit 1), SERPINB2 (serpin peptidase inhibitor, clade B (ovalbumin), member 2), TNS1 (tensin 1), RNF19A (ring finger protein 19A), EPOR (erythropoietin receptor), ITGAM (integrin, alpha M (complement component 3 receptor 3 subunit)), PITX2 (paired-like homeodomain 2), MAPK7 (mitogen-activated protein kinase 7), FCGR3A (Fc fragment of IgG, low affinity 111a, receptor (CD16a)), LEPR (leptin receptor), ENG (endoglin), GPX1 (glutathione peroxidase 1), GOT2 (glutamic-oxaloacetic transaminase 2, mitochondrial (aspartate aminotransferase 2)), HRH1 (histamine receptor HI), NR112 (nuclear receptor subfamily 1, group I, member 2), CRH (corticotropin releasing hormone), HTR1A (5-hydroxytryptamine (serotonin) receptor 1A), VDAC1 (voltage-dependent anion channel 1), HPSE (heparanase), SFTPD (surfactant protein D), TAP2 (transporter 2, ATP-binding cassette, sub-family B (MDR/TAP)), RNF123 (ring finger protein 123), PTK2B (PTK2B protein tyrosine kinase 2 beta), NTRK2 (neurotrophic tyrosine kinase, receptor, type 2), IL6R (interleukin 6 receptor), ACHE (acetylcholinesterase (Yt blood group)), GLP1R (glucagon-like peptide 1 receptor), GHR (growth hormone receptor), GSR (glutathione reductase), NQO1 (NAD(P)H dehydrogenase, quinone 1), NR5A1 (nuclear receptor subfamily 5, group A, member 1), GJB2 (gap junction protein, beta 2, 26 kDa), SLC9A1 (solute carrier family 9 (sodium/hydrogen exchanger), member 1), MAOA (monoamine oxidase A), PCSK9 (proprotein convertase subtilisin/kexin type 9), FCGR2A (Fc fragment of IgG, low affinity Ia, receptor (CD32)), SERPINF1 (serpin peptidase inhibitor, clade F (alpha-2 antiplasmin, pigment epithelium derived factor), member 1), EDN3 (endothelin 3), DHFR (dihydrofolate reductase), GAS6 (growth arrest-specific 6), SMPD1 (sphingomyelin phosphodiesterase 1, acid lysosomal), UCP2 (uncoupling protein 2 (mitochondrial, proton carrier)), TFAP2A (transcription factor AP-2 alpha (activating enhancer binding protein 2 alpha)), C4BPA (complement component 4 binding protein, alpha), SERPINF2 (serpin peptidase inhibitor, clade F (alpha-2 antiplasmin, pigment epithelium derived factor), member 2), TYMP (thymidine phosphorylase), ALPP (alkaline phosphatase, placental (Regan isozyme)), CXCR2 (chemokine (C-X-C motif) receptor 2), SLC39A3 (solute carrier family 39 (zinc transporter), member 3), ABCG2 (ATP-binding cassette, sub-family G (WHITE), member 2), ADA (adenosine deaminase), JAK3 (Janus kinase 3), HSPA1A (heat shock 70 kDa protein 1A), FASN (fatty acid synthase), FGF1 (fibroblast growth factor 1 (acidic)), F11 (coagulation factor XI), ATP7A (ATPase, Cu++ transporting, alpha polypeptide), CR1 (complement component (3b/4b) receptor 1 (Knops blood group)), GFAP (glial fibrillary acidic protein), ROCK1 (Rho-associated, coiled-coil containing protein kinase 1), MECP2 (methyl CpG binding protein 2 (Rett syndrome)), MYLK (myosin light chain kinase), BCF1E (butyrylcholinesterase), LIPE (lipase, hormone-sensitive), PRDX5 (peroxiredoxin 5), ADORA1 (adenosine A1 receptor), WRN (Werner syndrome, RecQ helicase-like), CXCR3 (chemokine (C-X-C motif) receptor 3), CD81 (CD81 molecule), SMAD7 (SMAD family member 7), LAMC2 (laminin, gamma 2), MAP3K5 (mitogen-activated protein kinase kinase kinase 5), CF1GA (chromogranin A (parathyroid secretory protein 1)), IAPP (islet amyloid polypeptide), RFIO (rhodopsin), ENPP1 (ectonucleotide pyrophosphatase/phosphodiesterase 1), PTF1LF1 (parathyroid hormone-like hormone), NRG1 (neuregulin 1), VEGFC (vascular endothelial growth factor C), ENPEP (glutamyl aminopeptidase (aminopeptidase A)), CEBPB (CCAAT/enhancer binding protein (C/EBP), beta), NAGLU (N-acetylglucosaminidase, alpha), F2RL3 (coagulation factor II (thrombin) receptor-like 3), CX3CL1 (chemokine (C-X3-C motif) ligand 1), BDKRB1 (bradykinin receptor B1), ADAMTS13 (ADAM metallopeptidase with thrombospondin type 1 motif, 13), ELANE (elastase, neutrophil expressed), ENPP2 (ectonucleotide pyrophosphatase/phosphodiesterase 2), CISF1 (cytokine inducible SF12-containing protein), GAST (gastrin), MYOC (myocilin, trabecular mesh work inducible glucocorticoid response), ATP1A2 (ATPase, Na+/K+ transporting, alpha 2 polypeptide), NF1 (neurofibromin 1), GJB1 (gap junction protein, beta 1, 32 kDa), MEF2A (myocyte enhancer factor 2A), VCL (vinculin), BMPR2 (bone morphogenetic protein receptor, type II (serine/threonine kinase)), TUBB (tubulin, beta), CDC42 (cell division cycle 42 (GTP binding protein, 25 kDa)), KRT18 (keratin 18), F1SF1 (heat shock transcription factor 1), MYB (v-myb myeloblastosis viral oncogene homolog (avian)), PRKAA2 (protein kinase, AMP-activated, alpha 2 catalytic subunit), ROCK2 (Rho-associated, coiled-coil containing protein kinase 2), TFPI (tissue factor pathway inhibitor (lipoprotein-associated coagulation inhibitor)), PRKG1 (protein kinase, cGMP-dependent, type I), BMP2 (bone morphogenetic protein 2), CTNND1 (catenin (cadherin-associated protein), delta 1), CTF1 (cystathionase (cystathionine gamma-lyase)), CTSS (cathepsin S), VAV2 (vav 2 guanine nucleotide exchange factor), NPY2R (neuropeptide Y receptor Y2), IGFBP2 (insulin-like growth factor binding protein 2, 36 kDa), CD28 (CD28 molecule), GSTA1 (glutathione S-transferase alpha 1), PPIA (peptidylprolyl isomerase A (cyclophilin A)), APOF1 (apolipoprotein FI (beta-2-glycoprotein I)), S100A8 (S100 calcium binding protein A8), IL11 (interleukin 11), ALOX15

(arachidonate 15-lipoxygenase), FBLN1 (fibulin 1), NR1F13 (nuclear receptor subfamily 1, group FI, member 3), SCD (stearoyl-CoA desaturase (delta-9-desaturase)), GIP (gastric inhibitory polypeptide), CF1 GB (chromogranin B (secretogranin 1)), PRKCB (protein kinase C, beta), SRD5A1 (steroid-5-alpha-reductase, alpha polypeptide 1 (3-oxo-5 alpha-steroid delta 4-dehydrogenase alpha 1)), F1SD11B2 (hydroxy steroid (11-beta) dehydrogenase 2), CALCRL (calcitonin receptor-like), GALNT2 (UDP-N-acetyl-alpha-D-galactosamine:polypeptide N-acetylgalactosaminyltransferase 2 (GalNAc-T2)), ANGPTL4 (angiopoietin-like 4), KCNN4 (potassium intermediate/small conductance calcium-activated channel, subfamily N, member 4), PIK3C2A (phosphoinositide-3-kinase, class 2, alpha polypeptide), HBEGF (heparin-binding EGF-like growth factor), CYP7A1 (cytochrome P450, family 7, subfamily A, polypeptide 1), HLA-DRB5 (major histocompatibility complex, class II, DR beta 5), BNIP3 (BCL2/adeno virus E1B 19 kDa interacting protein 3), GCKR (glucokinase (hexokinase 4) regulator), S100A12 (S100 calcium binding protein A 12), PADI4 (peptidyl arginine deaminase, type IV), HSPA14 (heat shock 70 kDa protein 14), CXCR1 (chemokine (C-X-C motif) receptor 1), H19 (H19, imprinted maternally expressed transcript (non-protein coding)), KRTAP19-3 (keratin associated protein 19-3), insulin, RAC2 (ras-related C3 botulinum toxin substrate 2 (rho family, small GTP binding protein Rac2)), RYR1 (ryanodine receptor 1 (skeletal)), CLOCK (clock homolog (mouse)), NGFR (nerve growth factor receptor (TNFR superfamily, member 16)), DBH (dopamine beta-hydroxylase (dopamine beta-monooxygenase)), CHRNA4 (cholinergic receptor, nicotinic, alpha 4), CACNA1C (calcium channel, voltage-dependent, L type, alpha 1C subunit), PRKAG2 (protein kinase, AMP-activated, gamma 2 non-catalytic subunit), CHAT (choline acetyltransferase), PTGDS (prostaglandin D2 synthase 21 kDa (brain)), NR1H2 (nuclear receptor subfamily 1, group H, member 2), TEK (TEK tyrosine kinase, endothelial), VEGFB (vascular endothelial growth factor B), MEF2C (myocyte enhancer factor 2C), MAPKAPK2 (mitogen-activated protein kinase-activated protein kinase 2), TNFRSF11 A (tumor necrosis factor receptor superfamily, member 11a, NFKB activator), HSPA9 (heat shock 70 kDa protein 9 (mortalin)), CYSLTR1 (cysteinyl leukotriene receptor 1), MAT1A (methionine adenosyltransferase I, alpha), OPRL1 (opiate receptor-like 1), IMPA1 (inositol(myo)-1(or 4)-monophosphatase 1), CLCN2 (chloride channel 2), DLD (dihydrolipoamide dehydrogenase), PSMA6 (proteasome (prosome, macropain) subunit, alpha type, 6), PSMB8 (proteasome (prosome, macropain) subunit, beta type, 8 (large multifunctional peptidase 7)), CHI3L1 (chitinase 3-like 1 (cartilage glycoprotein-39)), ALDH1B1 (aldehyde dehydrogenase 1 family, member B1), PARP2 (poly (ADP-ribose) polymerase 2), STAR (steroidogenic acute regulatory protein), LBP (lipopolysaccharide binding protein), ABCC6 (ATP-binding cassette, sub-family C(CFTR/MRP), member 6), RGS2 (regulator of G-protein signaling 2, 24 kDa), EFNB2 (ephrin-B2), cystic fibrosis transmembrane conductance regulator (CFTR), GJB6 (gap junction protein, beta 6, 30 kDa), APOA2 (apolipoprotein A-II), AMPD1 (adenosine monophosphate deaminase 1), DYSF (dysferlin, limb girdle muscular dystrophy 2B (autosomal recessive)), FDFT1 (farnesyl-diphosphate farnesyltransferase 1), EDN2 (endothelin 2), CCR6 (chemokine (C-C motif) receptor 6), GJB3 (gap junction protein, beta 3, 31 kDa), IL1RL1 (interleukin 1 receptor-like 1), ENTPD1 (ectonucleoside triphosphate diphosphohydrolase 1), BBS4 (Bardet-Biedl syndrome 4), CELSR2 (cadherin, EGF LAG seven-pass G-type receptor 2 (flamingo homolog, *Drosophila*)), F11R (F11 receptor), RAPGEF3 (Rap guanine nucleotide exchange factor (GEF) 3), HYAL1 (hyaluronoglucosaminidase 1), ZNF259 (zinc finger protein 259), ATOX1 (ATX1 antioxidant protein 1 homolog (yeast)), ATF6 (activating transcription factor 6), K'HK (ketohexokinase (fructokinase)), SAT1 (spermidine/spermine N1-acetyltransferase 1), GGFI (gamma-glutamyl hydrolase (conjugate, folylpolygammaglutamyl hydrolase)), TIMP4 (TIMP metallopeptidase inhibitor 4), SLC4A4 (solute carrier family 4, sodium bicarbonate cotransporter, member 4), PDE2A (phosphodiesterase 2 A, cGMP-stimulated), PDE3B (phosphodiesterase 3B, cGMP-inhibited), FADS1 (fatty acid desaturase 1), FADS2 (fatty acid desaturase 2), TMSB4X (thymosin beta 4, X-linked), TXNIP (thioredoxin interacting protein), LIMS1 (LIM and senescent cell antigen-like domains 1), RFIOB (ras homolog gene family, member B), LY96 (lymphocyte antigen 96), FOXO1 (forkhead box 01), PNPLA2 (patatin-like phospholipase domain containing 2), TRH (thyrotropin-releasing hormone), GJC1 (gap junction protein, gamma 1, 45 kDa), SLC17A5 (solute carrier family 17 (anion/sugar transporter), member 5), FTO (fat mass and obesity associated), GJD2 (gap junction protein, delta 2, 36 kDa), PSRC1 (proline/serine-rich coiled-coil 1), CASP12 (caspase 12 (gene/pseudogene)), GPBAR1 (G protein-coupled bile acid receptor 1), PXK (PX domain containing serine/threonine kinase), IL33 (interleukin 33), TRIB1 (tribbles homolog 1 (*Drosophila*)), PBX4 (pre-B-cell leukemia homeobox 4), NUPR1 (nuclear protein, transcriptional regulator, 1), 15-Sep (15 kDa selenoprotein), CTLP2 (cartilage intermediate layer protein 2), TERC (telomerase RNA component), GGT2 (gamma-glutamyltransferase 2), MT-CO1 (mitochondrially encoded cytochrome c oxidase I), UOX (urate oxidase, pseudogene), a CRISPR/Cas effector polypeptide, an enzymatically active CRISPR/Cas effector polypeptide (e.g., is capable of cleaving a target nucleic acid) and a CRISPR/Cas effector polypeptide that is not enzymatically active (e.g., does not cleave a target nucleic acid, but retains binding to the target nucleic acid). In some cases, the donor DNA encodes a wild-type version of any of the foregoing polypeptides; i.e., the donor DNA can encode a "normal" version that does not include a mutation(s) that results in reduced function, lack of function, or pathogenesis.

In some cases, the donor DNA comprises a nucleotide sequence encoding a fluorescent polypeptide. Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilized EGFP (dEGFP), destabilized ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2 (12), mRFPl, pocilloporin, *Renilla* GFP, Monster GFP, paGFP, Kaede protein and kindling protein, Phycobiliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrape1, mRaspberry, mGrape2, m PI urn (Shaner et al. (2005) Nat. Methods 2:905-909), and the like. Any of a variety of fluorescent and colored proteins from Anthozoan species, as described in, e.g., Matz et al. (1999) Nature Biotechnol. 17:969-973, can be encoded.

In some cases, the donor DNA encodes an RNA, e.g., an siRNA, a microRNA, a short hairpin RNA (shRNA), an anti-sense RNA, a riboswitch, a ribozyme, an aptamer, a ribosomal RNA, a transfer RNA, and the like.

A donor DNA can include, in addition to a nucleotide sequence encoding one or more gene products (e.g., an RNA and/or a polypeptide), one or more transcriptional control elements, e.g., a promoter, an enhancer, and the like. In some cases, the transcriptional control element is inducible. In some cases, the promoter is reversible. In some cases, the transcriptional control element is constitutive. In some cases, the promoter is functional in a eukaryotic cell. In some cases, the promoter is a cell type-specific promoter. In some cases, the promoter is a tissue-specific promoter.

The nucleotide sequence of the donor DNA is typically not identical to the target nucleic acid (e.g., genomic sequence) that it replaces. Rather, the donor DNA may contain at least one or more single base changes, insertions, deletions, inversions or rearrangements with respect to the target nucleic acid (e.g., genomic sequence), so long as sufficient homology is present to support homology-directed repair (e.g., for gene correction, e.g., to convert a disease-causing base pair or a non-disease-causing base pair). In some cases, the donor DNA comprises a nonhomologous sequence flanked by two regions of homology, such that homology-directed repair between the target DNA region and the two flanking sequences results in insertion of the nonhomologous sequence at the target region. Donor DNA may also comprise a vector backbone containing sequences that are not homologous to the DNA region of interest (the target nucleic acid) and that are not intended for insertion into the DNA region of interest (the target nucleic acid). Generally, the homologous region(s) of a donor sequence will have at least 50% sequence identity to a target nucleic acid (e.g., a genomic sequence) with which recombination is desired. In certain cases, 60%, 70%, 80%, 90%, 95%, 98%, 99%, or 99.9% sequence identity is present. Any value between 1% and 100% sequence identity can be present, depending upon the length of the donor polynucleotide.

The donor DNA may comprise certain nucleotide sequence differences as compared to the target nucleic acid (e.g., genomic sequence), where such difference include, e.g. restriction sites, nucleotide polymorphisms, selectable markers (e.g., drug resistance genes, fluorescent proteins, enzymes etc.), etc., which may be used to assess for successful insertion of the donor DNA at the cleavage site or in some cases may be used for other purposes (e.g., to signify expression at the targeted genomic locus). In some cases, if located in a coding region, such nucleotide sequence differences will not change the amino acid sequence, or will make silent amino acid changes (i.e., changes which do not affect the structure or function of the protein). Alternatively, these sequences differences may include flanking recombination sequences such as FLPs, loxP sequences, or the like, that can be activated at a later time for removal of the marker sequence. In some cases, the donor DNA will include one or more nucleotide sequences to aid in localization of the donor to the nucleus of the recipient cell or to aid in the integration of the donor DNA into the target nucleic acid. For example, in some case, the donor DNA may comprise one or more nucleotide sequences encoding one or more nuclear localization signals (e.g. PKKKRKV (SEQ ID NO: 19147), VSRKRPRP (SEQ ID NO: 19148), QRKRKQ (SEQ ID NO: 19149), and the like (Frietas et al (2009) Cun-Genomics 10:550-7). In some cases, the donor DNA will include nucleotide sequences to recruit DNA repair enzymes to increase insertion efficiency. Fiuman enzymes involved in homology directed repair include MRN-CtIP, BLM-DNA2, ExoI, ERCC1, Rad51, Rad52, Ligase 1, RoIQ, PARP1, Ligase 3, BRCA2, RecQ/BLM-ToroIIIa, RTEL, Roíd, and Roíh (Verma and Greenburg (2016) Genes Dev. 30 (10): 1138-1154). In some cases, the donor DNA is delivered as reconstituted chromatin (Cruz-Becerra and Kadonaga (2020) eLife 2020; 9:e55780 DOI: 10.7554/eLife.55780).

In some cases, the ends of the donor DNA are protected (e.g., from exonucleolytic degradation) by any convenient method and such methods are known to those of skill in the art. For example, one or more dideoxynucleotide residues can be added to the 3' terminus of a linear molecule and/or self complementary oligonucleotides can be ligated to one or both ends. See, for example, Chang et al. (1987) Proc. Natl. Acad Sci USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues. As an alternative to protecting the termini of a linear donor DNA, additional lengths of sequence may be included outside of the regions of homology that can be degraded without impacting recombination.

HNS=Functional RNA Element

In certain embodiments, the donor/template comprises a coding sequence for a functional RNA element (ncRNAs, siRNA, shRNA, sgRNA, etc.).

In some embodiments, the heterologous nucleic acid sequences encode a functional non-translated RNA. In some embodiments, the functional non-translated RNA is an RNA aptamer or a ribozyme.

In some embodiments, the heterologous nucleic acid of the engineered retrons further includes a unique barcode to facilitate multiplexing. Barcodes may include one or more nucleotide sequences that are used to identify a nucleic acid or cell with which the barcode is associated. Such barcodes may be inserted for example, into the tip/loop region of the msd-encoded DNA. Barcodes can be 3-1000 or more nucleotides in length, 10-250 nucleotides in length, or 10-30 nucleotides in length, including any length within these ranges, such as 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 200, 300, 400, 500, 600, 700, 800, 900, or 1000 nucleotides in length.

In some embodiments, barcodes are also used to identify the position (viz., positional barcode) of a cell, colony, or sample from which a retron originated, such as the position of a colony in a cellular array, the position of a well in a multi-well plate, the position of a tube in a rack, or the location of a sample in a laboratory. In particular, a barcode may be used to identify the position of a genetically modified cell containing a retron. The use of barcodes allows retrons from different cells to be pooled in a single reaction mixture for sequencing while still being able to trace a particular retron back to the colony from which it originated.

In addition, adapter sequences can be added to engineered retron to facilitate high-throughput amplification or sequencing. For example, a pair of adapter sequences can be added at the 5' and 3' ends of a retron construct to allow amplification or sequencing of multiple engineered retron simultaneously by the same set of primers.

HNS=Guide RNA

Figure 1G:
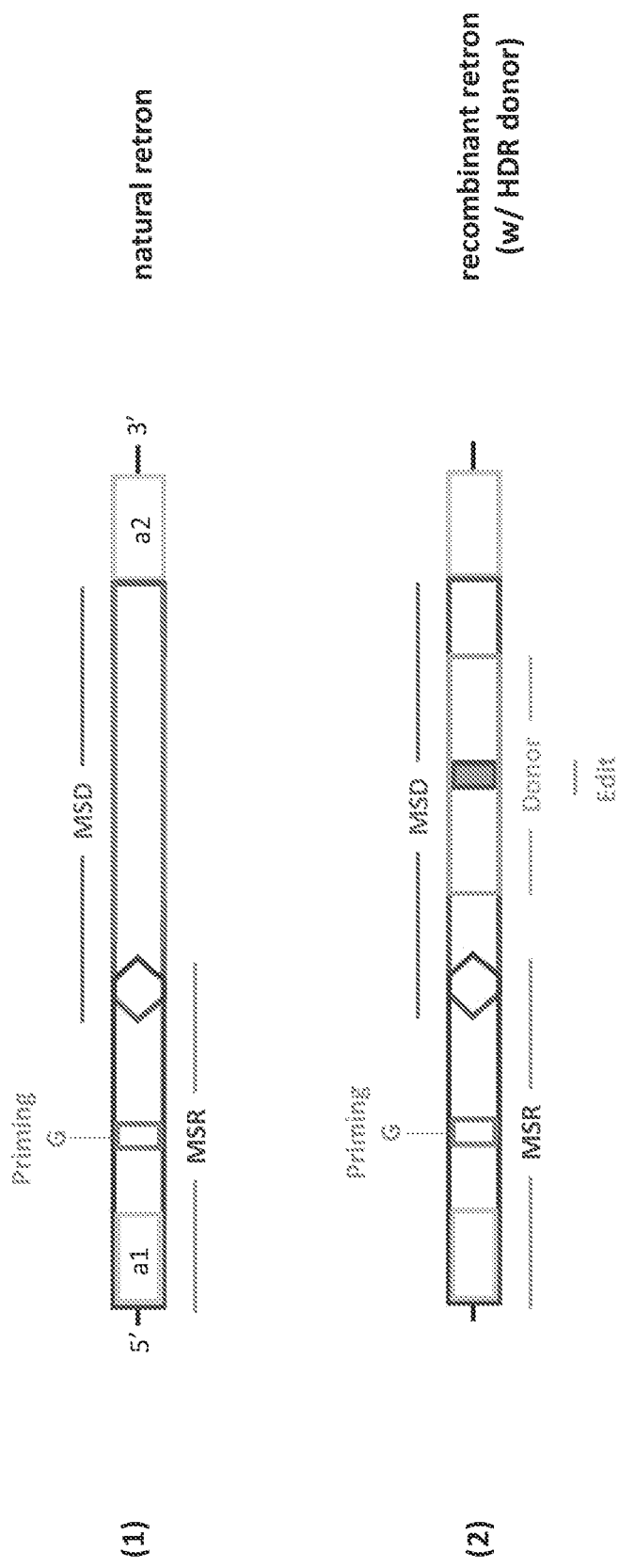
FIG. 1G is a schematic depicting various configurations contemplated for the recombinant retron disclosed herein. (1) shows the operonic structure of a wild type retron; (2) shows the operonic structure of a recombinant retron configured to encode an HDR donor template in the final msDNA molecule; (3) shows (2) but further modified to encode a guide RNA at the 3' end of the retron; (4) shows (2) but further modified to encode a guide RNA at the end of the retron; (5) shows (2) but further modified to encode a guide RNA.
Figure 1G:
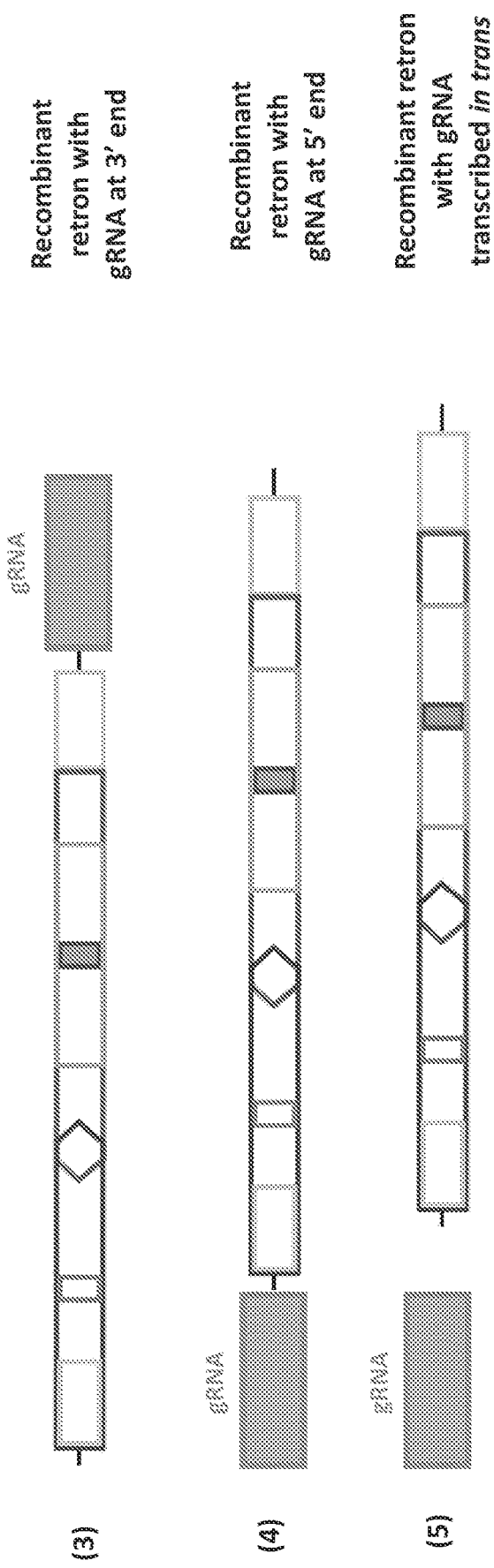
Figure 1H:
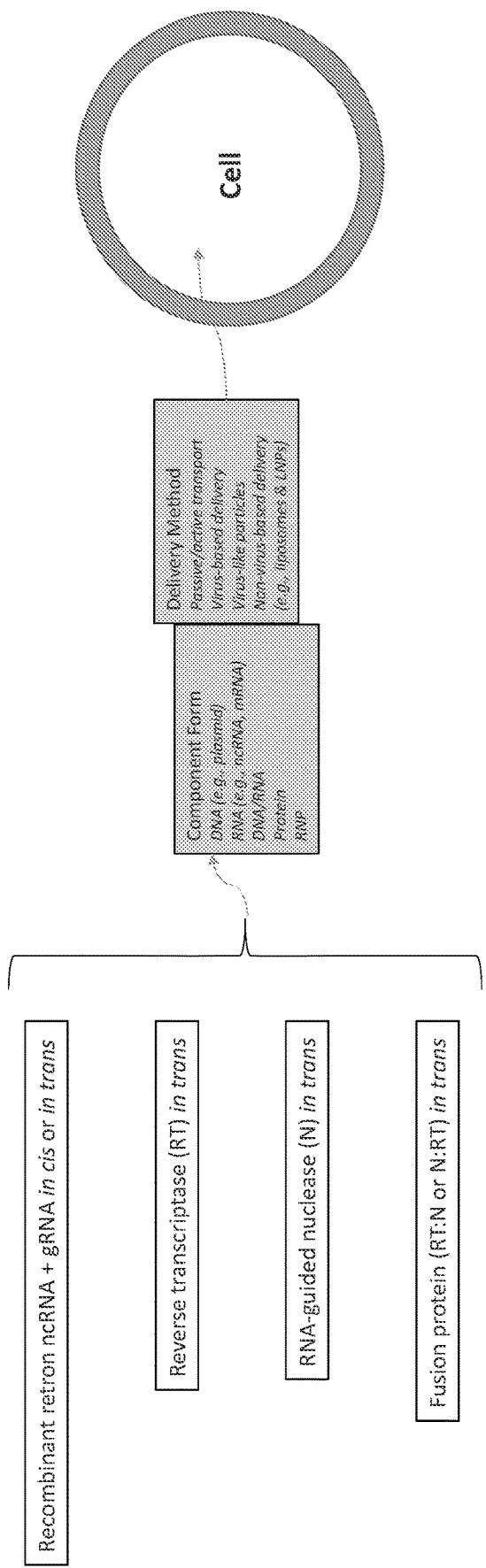
FIG. 1H is a schematic that emphasizes that any suitable configuration for presenting the components of the recombinant retron-based genome modification systems disclosed herein to a cell are contemplated, including where the RT and/or the programmable nuclease are provided in trans relative to the retron ncRNA. In some embodiments, the RT and the programmable nuclease may be provided as a fusion protein.
Figure 1I:
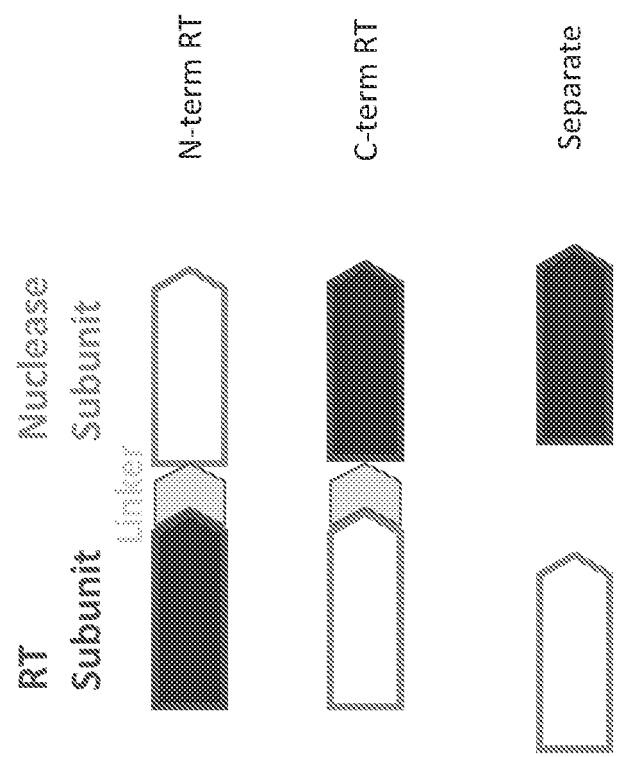
FIG. 1I depicts that the RT and programmable nuclease may be provided as fusion proteins (top, middle) or provided separate from one another.
Figure 1J:
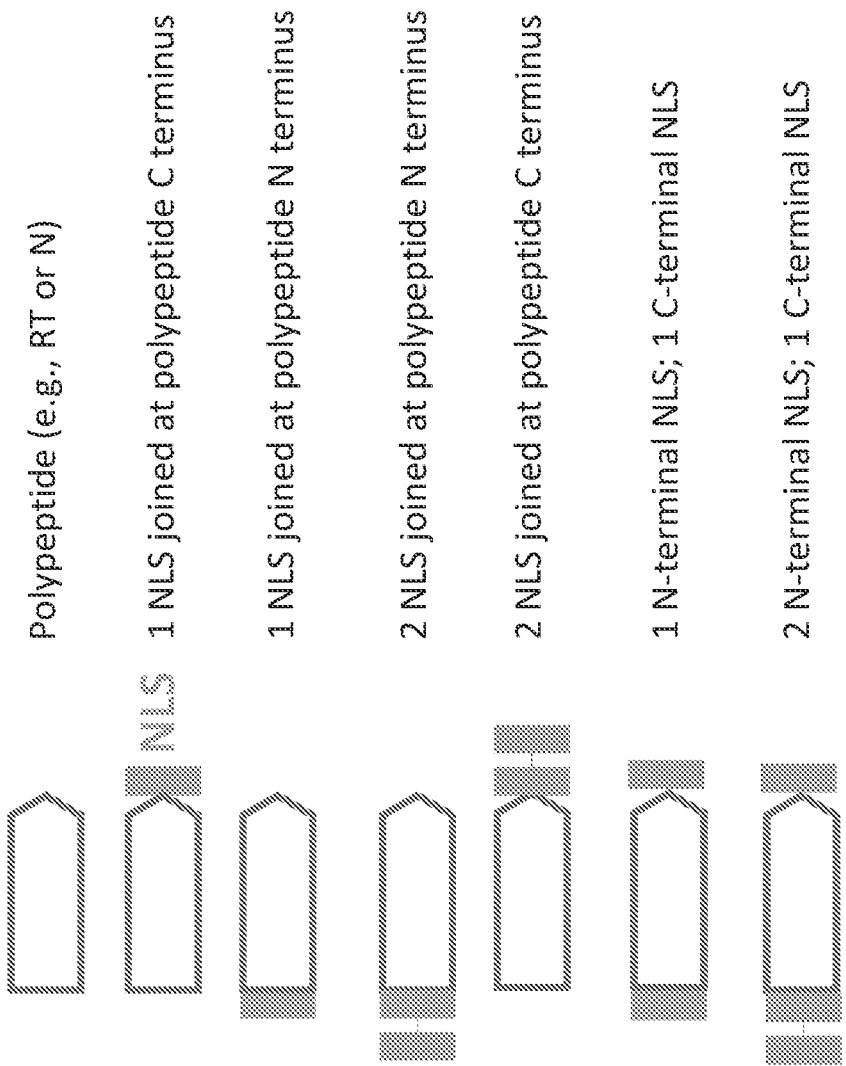
FIG. 1J depicts that nuclear localization signals may be engineered into the polypeptides of the disclosure (e.g., a RNA-guide nuclease) to facilitate translocation into the nuclease of cell where editing occurs.
Figure 1K:
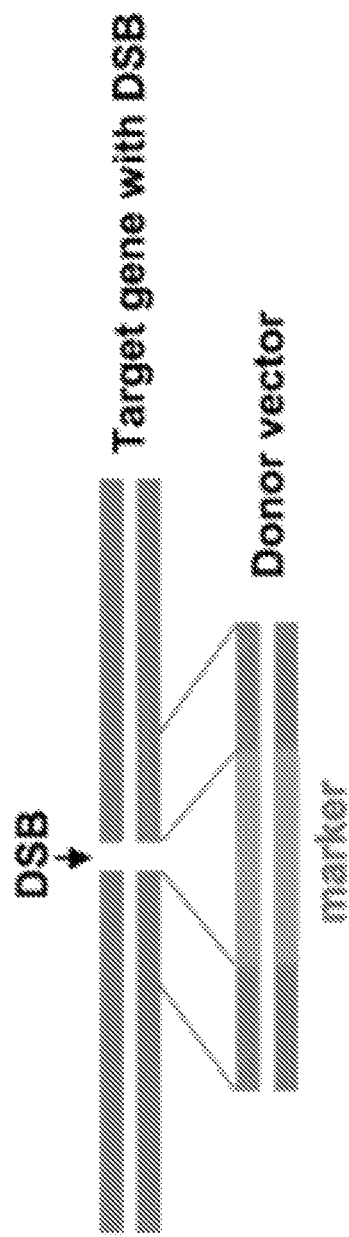
FIG. 1K is a schematic (not to scale) representation depicting an embodiment of genome editing, in which double-stranded break (DSB) created by a suitable nuclease (such as a CRISPR/Cas effector enzyme, a ZFN, TALEN, meganuclease, TnpB, IscB, or restriction enzymes (Res)) promotes the insertion of a donor or template sequence (shown here as a "marker" flanked by homologous sequences matching those flanking the DSB, provided on a "donor vector").

In some embodiments, the functional non-translated RNA is a CRISPR/Cas guide RNA (gRNA) specific for a target sequence in the mammalian cell. FIG. 1G depicts various configurations of a recombinant retron ncRNA which is modified by inserting a guide RNA at the 5' end or the 3' of the ncRNA. The guide RNA also may be provided in trans as a separate construct. In addition, guide RNAs may be placed at both ends of a recombinant retron ncRNA.

The skilled person will understand that selection of an appropriate guide RNA is informed by which RNA-guided nuclease is utilized.

A guide RNA provides target specificity to the complex (the RNP complex) by including a targeting segment, which includes a guide sequence (also referred to herein as a targeting sequence), which is a nucleotide sequence that is complementary to a sequence of a target nucleic acid. The term "guide RNA", as used herein, refers to an RNA that comprises: i) an "activator" nucleotide sequence that binds to a CRISPR/Cas effector polypeptide (e.g., a class 2 CRISPR/Cas effector polypeptide such as a type II, type V, or type VI CRISPR/Cas endonuclease) and activates the CRISPR/Cas effector polypeptide; and ii) a "targeter" nucleotide sequence that comprises a nucleotide sequence that hybridizes with a target nucleic acid. The "activator" nucleotide sequence and the "targeter" nucleotide sequence can be on separate RNA molecules (e.g., a "dual-guide RNA"); or can be on the same RNA molecule (a "single-guide RNA"). A guide nucleic acid in some cases includes only ribonucleotides. In some cases, a guide nucleic acid includes both ribonucleotides and deoxyribonucleotides.

In some cases, a CRISPR/Cas guide RNA comprises one or more modifications, e.g., a base modification, a backbone modification, a sugar modification, etc., to provide the nucleic acid with a new or enhanced feature (e.g., improved stability, such as improved in vivo stability). Suitable nucleic acid modifications include, but are not limited to: 2'O-methyl modified nucleotides, 2' fluoro modified nucleotides, locked nucleic acid (LNA) modified nucleotides, peptide nucleic acid (PNA) modified nucleotides, nucleotides with phosphorothioate linkages, and a 5' cap (e.g., a 7-methylguanylate cap (m7G)). Suitable modified nucleic acid backbones containing a phosphorus atom therein include, for example, phosphorothioates, chiral phosphorothioates, phosphorodithioates, phosphotriesters, aminoalkylphosphotriesters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, phosphorodiamidates, thionophosphoramidates, thionoalkylphosphonates, thionoalkylphosphotriesters, selenophosphates and boranophosphates having normal 3'-5' linkages, 2'-5' linked analogs of these, and those having inverted polarity wherein one or more internucleotide linkages is a 3' to 3', 5' to 5' or 2' to 2' linkage. Suitable oligonucleotides having inverted polarity comprise a single 3' to 3' linkage at the 3'-most internucleotide linkage i.e. a single inverted nucleoside residue which may be a basic (the nucleobase is missing or has a hydroxyl group in place thereof). Various salts (such as, for example, potassium or sodium), mixed salts and free acid forms are also included. A CRISPR-Cas guide RNA can also include one or more substituted sugar moieties. Suitable polynucleotides comprise a sugar substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_i$ to $C_{io}$ alkyl or $C_2$ to $C_{10}$ alkenyl and alkynyl. Particularly suitable are $O((CH_2)_nO)_mCH_3$, $O(CH_2)_nOCH_3$, $O(CH_2)_nNH_2$, $O(CH_2)_nCH_3$, $O(CH_2)_aONH_2$, and $O(CH_2)_nON((CH_2)_nCH_3)_2$, where n and m are from 1 to about 10. Other suitable polynucleotides comprise a sugar substituent group selected from: $C_i$ to $C_{io}$ lower alkyl, substituted lower alkyl, alkenyl, alkynyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. A suitable modification includes 2'-methoxy ethoxy (2'-O—$CH_2CH_2OCH_3$, also known as 2'-O-(2-methoxyethyl) or 2'-MOE) (Martin et al., Helv. Chim. Acta, 1995, 78, 486-504) i.e., an alkoxyalkoxy group. A further suitable modification includes 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethyl-amino-ethoxy-ethyl or 2'-DMAEOE), i.e., 2'-O—$CH_2$—O—$CH_2$—$N(CH_3)_2$.

Examples of various CRISPR/Cas effector proteins and CRISPR/Cas guide RNAs (as well as information regarding requirements related to protospacer adjacent motif (PAM) sequences present in targeted nucleic acids) can be found in the art, for example, see Jinek et al., Science. 2012 Aug. 17; 337(6096):816-21; Chylinski et al., RNA Biol. 2013 May; 10(5):726-37; Ma et al., Biomed Res Int. 2013; 2013: 270805; Hou et al., Proc Natl Acad Sci USA. 2013 Sep. 24; 110(39):15644-9; Jinek et al., Elife. 2013; 2:e00471; Patanayak et al., Nat Biotechnol. 2013 September; 31(9):839-43; Qi et al., Cell. 2013 Feb. 28; 152(5): 1173-83; Wang et al., Cell. 2013 May 9; 153(4):910-8; Auer et al., Genome Res. 2013 Oct. 31; Chen et al., Nucleic Acids Res. 2013 Nov. 1; 41(20):e19; Cheng et al., Cell Res. 2013 October; 23(10):1163-71; Cho et al., Genetics. 2013 November; 195 (3):1177-80; DiCarlo et al., Nucleic Acids Res. 2013 April; 41(7):4336-43; Dickinson et al., Nat Methods. 2013 October; 10(10):1028-34; Ebina et al., Sci Rep. 2013; 3:2510; Fujii et al., Nucleic Acids Res. 2013 Nov. 1; 41(20):e187; Hu et al., Cell Res. 2013 November; 23(11):1322-5; Jiang et al., Nucleic Acids Res. 2013 Nov. 1; 41(20):e188; Larson et al., Nat Protoc. 2013 November; 8(11):2180-96; Mali et al., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6):1380-9; Upadhyay et al., G3 (Bethesda). 2013 Dec. 9; 3(12):2233-8; Walsh et al., Proc Natl Acad Sci USA. 2013 Sep. 24; 110(39):15514-5; Xie et al., Mol Plant. 2013 Oct. 9; Yang et al., Cell. 2013 Sep. 12; 154(6):1370-9; Briner et al., Mol Cell. 2014 Oct. 23; 56(2): 333-9; and U.S. patents and patent applications: U.S. Pat. Nos. 8,906,616; 8,895,308; 8,889,418; 8,889,356; 8,871, 445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356756; 20140356956; 20140356958; 20140356959; 20140357523; 20140357530; 20140364333; and 20140377868; all of which are hereby incorporated by reference in their entirety.

Examples and guidance related to type V or type VI CRISPR/Cas endonucleases and guide RNAs (as well as information regarding requirements related to protospacer adjacent motif (PAM) sequences present in targeted nucleic acids) can be found in the art, for example, see Zetsche et al., Cell. 2015 Oct. 22; 163(3):759-71; Makarova et al., Nat Rev Microbiol. 2015 November; 13(11):722-36; and Shmakov et al., Mol Cell. 2015 Nov. 5; 60(3):385-97.

C. Reverse Transcriptases (RTs)

Reverse transcriptases (RTs, also known as RNA-directed DNA polymerases) are enzymes present in all three domains of life, which are DNA polymerase using RNA as a template. Reverse transcriptases of the present disclosure are used to reverse transcribe template msd RNA into single-stranded msDNA.

The reverse transcriptase or a functional domain thereof that may be used in the instant invention includes prokaryotic and eukaryotic RT, provided that the RT functions within the host to generate a donor polynucleotide sequence from the RNA template (e.g., an RNA template from the retron transcript ncRNA).

In certain embodiments, suitable RT sequences (including amino acid sequences and the encoding polynucleotide sequences) are provided in Table A.

In certain embodiments, the nucleotide sequence of a native or wild-type RT is modified, for example, using known codon optimization techniques, so that expression within the desired host is optimized.

In certain embodiments, the RT domain of a reverse transcriptase is used in the present invention, so long as it is compatible with the engineered retron of the invention. The domain may include only the RNA-dependent DNA polymerase activity. In certain embodiments, the RT domain is non-mutagenic, i.e., does not cause mutation in the donor polynucleotide (e.g., during the reverse transcriptase process). In certain embodiments, the RT domain may be non-retron RT in origin, e.g., a viral RT or a human endogenous RTs. In certain embodiments, the RT domain is retron RT or DGRs RT. In certain embodiments, the RT may be less mutagenic than a counterpart wildtype RT. In certain embodiments, the RT is not mutagenic.

In some embodiments, a reverse transcriptase is encoded by a retron ret gene, which may accompany the cognate msr and msd loci and specifically recognize the secondary structure of the cognate ncRNA transcript.

In some embodiments, the RT may be obtained from prokaryotic or eukaryotic cells. Most reverse transcriptases (80%) can be phylogenetically clustered into three major lineages: group II introns, diversity-generating retroelements (DGRs), and retrons. Other clades of RTs include abortive infection (Abi) RTs, CRISPR-Cas-associated RTs, Group II-like (G2L), the unknown groups (UG), and rvt elements.

In some embodiments, the RT gene is a cognate RT, a retron RT from a species within the same species or clade of the cognate RT, or a retron RT not within the same clade of the cognate RT such as an unrelated RT or an engineered RT. In some embodiments, the non-retron related RT are RTs from group II introns, diversity-generating retroelements (DGRs), abortive infection (Abi) RTs, CRISPR-Cas-associated RTs, Group II-like (G2L), the unknown groups (UG), and rvt elements. See Mestre et al., Nucleic Acids Research, Volume 48, Issue 22, 16 Dec. 2020, Pages 12632-12647; and Mestere et al., *UG/Abi: "A Highly Diverse Family of Prokaryotic Reverse Transcriptases Associated With Defense Functions,"* doi.org/10.1101/2021.12.02.470933 (incorporated herein by reference).

In some embodiments, the RT are from clades related to retron/retron-like sequences. In some embodiments, the RT are selected from RTs provided in Table A. In some embodiments, the RT is not an RT associated with the sequences identified in Table X.

In prokaryotic retron systems, the RT gene is typically located downstream from the ncRNA (msr and msd) locus. In the engineered retron, the RT position can differ from the natural or wild type retrons. In some embodiments, the RT gene can be provided in cis, such as either upstream or downstream of the msr locus or the msd locus. In certain embodiments, the RT gene is provided in trans, such as provided separately in a vector of the vector system described herein, wherein the ncRNA coding msr and msd sequences are provided in a different vector of the vector system described herein.

In some embodiments, the RT is modified (e.g., insertion, deletion, and/or substitution of one or more nucleotide(s)) or codon optimized to enhance activity or processivity.

In certain embodiments, a cryptic stop signal is removed from the RT thereby allowing generation of longer ssDNAs.

In certain embodiments, the RT is from a retron which encodes msDNA as described in U.S. Pat. Nos. 6,017,737; 5,849,563; 5,780,269; 5,436,141; 5,405,775; 5,320,958; CA2,075,515; all of which are incorporated by reference herein in their entireties.

In some embodiments, the engineered retron further comprises a polynucleotide (e.g., a DNA molecule) encoding a reverse transcriptase (RT) or a portion thereof. In some embodiments, the encoded RT or portion thereof is capable of synthesizing a DNA copy of at least a portion of the msd locus encoding the msDNA.

In some embodiments, the polynucleotide (e.g., a DNA molecule) encoding the RT comprises a polynucleotide listed in Table A, or a polynucleotide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polynucleotide listed in Table A.

In some embodiments, the polynucleotide encoding the RT encodes a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or a polypeptide of Table C.

In some embodiments, the polynucleotide encoding the RT does not comprise a polynucleotide listed in Table X.

Once translated, the RT binds the ncRNA template downstream from the msd locus, forming an RT-RNA complex, and initiating reverse transcription of the RNA towards its 5' end. Accordingly, in certain aspects the disclosure relates to an engineered nucleic acid-enzyme construct comprising: a. a non-coding RNA (ncRNA) comprising: i) an msr locus encoding the msr RNA portion of a multi-copy single-stranded DNA (msDNA); and ii) an msd locus encoding the msd RNA portion of the msDNA; b. a heterologous nucleic acid inserted at or within a location selected from: the msd locus, upstream of the msr locus, upstream of the msd locus, and downstream of the msd locus; and c. a reverse transcriptase (RT), or a domain thereof comprising: i) a polypeptide listed in Table A, or a polypeptide having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to a polypeptide listed in Table A; and/or ii) a polypeptide listed in Table C. In some embodiments, the RT does not comprise a polypeptide listed in Table X.

In certain aspects, the disclosure relates to an engineered nucleic acid-enzyme construct comprising: a) a non-coding RNA (ncRNA) comprising: i) an msr locus encoding the msr RNA portion of a multi-copy single-stranded DNA (msDNA); and ii) an msd locus encoding the msd RNA portion of the msDNA, b) a heterologous nucleic acid inserted at or within a location selected from: the msd locus; upstream of the msr locus; upstream of the msd locus; and downstream of the msd locus; and c) a reverse transcriptase (RT), or a portion thereof, wherein the RT is capable of synthesizing a DNA copy of at least a portion of the msd locus encoding the msDNA, and wherein the ncRNA and/or the RT is any one of the invention described herein.

In certain aspects, the disclosure relates to an engineered nucleic acid-enzyme construct comprising: a) a non-coding RNA (ncRNA) comprising: i) an msr locus encoding the msr RNA portion of a multi-copy single-stranded DNA (msDNA); and ii) an msd locus encoding the msd RNA portion of the msDNA; b) a heterologous nucleic acid inserted at or within a location selected from: the msd locus, upstream of the msr locus, upstream of the msd locus, and downstream of the msd locus; and c) a reverse transcriptase (RT) or a domain thereof: wherein the RT comprises: i) an RT listed in Table A, or an RT having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an RT listed in Table A; and/or ii) a consensus sequence listed in Table C; and wherein, the RT does not comprise a sequence from Table X.

In some embodiments of the nucleic-acid enzyme constructs described herein, the ncRNA comprises: i) an ncRNA listed in Table B, or an ncRNA having at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%%, at least 99.1%, at least 99.2%, at least 99.3%, at least 99.4%, at least 99.5%, at least 99.6%, at least 99.7%, at least 99.8% or at least 99.9% sequence identity to an ncRNA listed in Table B; and/or optionally wherein the ncRNA is not an ncRNA from the retons of Table X.

In some embodiments, the RT is linked to components such as RNA-guided and non-RNA guided nucleases. The linked maybe via s peptide bond or a short linker peptide in a fusion protein. Suitable linker peptides include flexible linkers such as those comprising G or S repeats, such as $G_4S$ (SEQ ID NO:19143) repeat units or GS repeat units, with 1-20 repeats, e.g., 1, 2, 3, 4, 5, 6, 7, or 8 repeats.

In certain embodiments, the RT is chemically linked or conjugated to the RNA-guided and non-RNA guided nucleases via non-peptide bonds. Such protein conjugates may be delivered directly to a host cell, either together with the nucleic acid component of the engineered retron described herein, or separately.

In some embodiments, the RT is linked to a DNA-repair modulating biomolecule (e.g., NHEJ peptide inhibitors).

D. Programmable Nucleases (RNA-Guided Nucleases)

In certain embodiments, the engineered retron (e.g., an engineered nucleic acid construct or engineered nucleic acid-enzyme construct as described herein) may comprise or encode, as one heterologous nucleic acid, a guide RNA (gRNA) suitable for guiding a nuclease to target a particular genomic sequence to be modified. The gRNA includes sequences complementary to a genomic sequence, and therefore can mediate binding of the nuclease-gRNA complex to the genomic target site by hybridization between the guide sequence and the target site sequence.

In certain embodiments, the gRNA can be linked to the ncRNA and/or the msDNA encoded by the engineered retron described herein at the 5' end of the ncRNA and/or the msDNA. In certain embodiments, the gRNA can be linked to the ncRNA and/or the msDNA encoded by the engineered retron described herein at the 3' end of the RNA of the ncRNA and/or the msDNA after reverse transcription.

In some embodiments, the nuclease that can form a complex with the gRNA can be any one of the art-recognized clustered regularly interspersed short palindromic repeats (CRISPR) system Cas effector enzymes, which are useful for, e.g., genome editing, including genome editing in mammalian cells or human cells.

For example, a gRNA that can be loaded into a Cas9 or variant thereof may be encoded by the engineered retron, such that the gRNA is transcribed as part of the msDNA. In some embodiments, the gRNA may be linked to the 5' end of the a1 region of the msr-encoded sequence in the retron ncRNA, as well as the msDNA after reverse transcription. In some embodiments, the gRNA may be part of the modified msr-region present in the ncRNA and the msDNA produced after reverse transcription (viz., the encoded gRNA is not degraded by the synthesis of the msDNA through reverse transcription of the ncRNA).

Any art recognized CRISPR/Cas effector enzymes or variants thereof ("Cas enzymes") known to be useful for CRISPR-based genome editing can be used with the engineered retron, though such Cas enzymes may not necessarily be part of the engineered retron, and can (but is not required to) be provided separately. For example, the Cas enzymes can be provided as part of the vector system described herein. The coding sequence of the suitable Cas enzyme can be present on the same vector that provides the engineered retron, or on different vectors. When the engineered retron and the Cas enzymes are present on the same vector, they may be under the transcriptional control of the same promoter, enhancer, or other transcriptional regulatory elements, or may be separately regulated by different promoters, enhancers, and/or other transcriptional regulatory sequences in the vector system.

In some embodiments, the Cas enzyme is a Class 2, Type II CRISPR/Cas effector enzyme, such as Cas9. In some embodiments, the Cas9 is from *Streptococcus pyogenes* (SpCas9), and the gRNA encoded by the engineered retron comprises both the crisprRNA (crRNA) and the tracrRNA linked together as the single guide RNA (gRNA).

In some embodiments, the Cas9 is from *Staphylococcus aureus* Cas9 (SaCas9), or an engineered variant thereof such as SaCas9-HF (a high-fidelity variant with genome-wide activity), KKHSaCas9 (which recognizes a 5'-NNGRRT-3' PAM, and has a 2-4× broader range of target sites in the human genome than the wildtype SaCas9), and microABE1744 (an engineered SaCas9 variant adapted for use in adenine base editing (ABE), with significantly improved on-target editing compared to other nucleases, with a reduced RNA off-target footprint).

In some embodiments, the Cas9 is from *Streptococcus thermophilus* (StCas9), *Neisseria meningitidis* (NmCas9), *Francisella novicida* (FnCas9), or *Campylobacter jejuni* (CjCas9).

In some embodiments, the Cas9 is from *Streptococcus canis* (ScCas9), with a less stringent PAM sequence requirement of 5'-NNG-3' (instead of the more stringent 5'-NGG-3' for SpCas9).

In some embodiments, the Cas9 is from *Staphylococcus auricularis* (SauriCas9) (which recognizes a 5'-NNGG-3' PAM sequence, has high editing activity).

In some embodiments, the Cas enzyme is a Cas9 variant with mutated catalytic domain that retains cleavage specificity, but only nicks a single DNA strand at a desired target sequence instead of creating a double-strand break (DSB). Two such Cas9 nickase variants targeting different strands of the same target sequence may be used together to increase fidelity of creating the DSB, each using a different gRNA that can be provided by the engineered retron.

In some embodiments, the Cas enzyme is a high fidelity Cas9 variant with weakened DNA phosphate backbone interaction (such as SpCas9-HF1) that displays genome-wide specificity and undetectable off-target effects.

In some embodiments, the Cas enzyme is a Cas9 variant known as eSpCas9, which has weakened interactions between the eSpCas9 and its gRNAs with non-exact complementarity with the target DNA sequence, thus providing improved specificity and lower off-target editing rates.

In some embodiments, the Cas enzyme is a hyper-accurate Cas9 variant (HypaCas9), which improves proofreading before cleavage, and thus drastically reduces off-target cleavage.

In some embodiments, the Cas enzyme is a Cas9 variant (FokI-Fused dCas9), which combines the DNA recognition ability by dCas9 with the specificity of an active nuclease FokI. The resulting nuclease cuts the target sequence only after dimerization, which is more difficult to occur at off-target sites, thus resulting in enhanced specificity.

In some embodiments, the Cas enzyme is a Cas9 variant xCas9, which recognizes a broad range of PAM sequences, thus increasing the target sites to 1 in 4 in the genome. In addition, the xCas9 variant also exhibits lower off-target rates than the commonly used SpCas9.

In some embodiments, the Cas enzyme is a Cas9 variant with altered PAM sequence specificities, including the SpG variant with an expanded target range of PAM sequences, and the SpRY variant that can target almost all PAM sequences.

In some embodiments, the Cas enzyme is dCas9 having inactivated catalytic nuclease domains while maintaining the recognition domains that allow guide RNA-mediated targeting to specific DNA sequences. The dCas9 may be further linked to a functional domain with a distinct biological function, such as transcriptional activation/depression, DNA methylation, demethylation, endonuclease (such as FokI), or fluorescent dye. Representative (non-limiting) dCas9-linked functional domains include including dCas9-SAM, dCas9-SunTag, dCas9-VPR, and dCas9-KREB.

In some embodiments, the dCas9 is fused with a catalytic enzyme with cytidine deaminase activity, which converts GC basepair to AT basepair.

In some embodiments, the dCas9 is fused with an engineered RNA adenosine deaminase, which converts AT basepair to GC basepair.

In some embodiments, the Cas enzyme is a Class 2, Type V CRISPR/Cas effector enzyme, such as Cas12a (Cpf1) (Type V-A), Cas12b (C2c1) (Type V-B), Cas12c (C2c3) (Type V-C), Cas12d (CasY) (Type V-D), Cas12e (CasX) (Type V-E), Cas12f (Cas14, C2c10) (Type V-F), Cas12g (Type V-G), Cas12h (Type V-H), Cas12i (Type V-I), Cas12k (C2c5) (Type V-K), or C2c4/C2c8/C2c9 (Type V-U).

In some embodiments, the Cas enzyme is Cas12a or Cpf1 (CRISPR from *Prevotella* and *Francisella* 1). Unlike Cas9, Cas12a is well-suited for targeting AT-rich DNA sequences because of its AT-rich PAM sequences. In some embodiments, the Cas12a is FnCas12a (that recognizes PAM sequence 5'-TTN-3'), or AsCas12a or LbCas12a (that recognize 5'-TTTV-3' PAM sequence), where V is A, G, or C nucleotide. Further, Cas12a creates staggered double-stranded breaks in the target DNA, rather than the blunt-ends generated by SpCas9, thus rendering it more useful for HDR repair. In this embodiment, the subject engineered retron encodes a gRNA suitable for use for Cas12a, in that the gRNA does not require a tracer RNA, and only requires the crRNA.

In some embodiments, the Cas enzyme is a Cas12a variant from Acidaminococcus sp. (enAsCas12a), which has an expanded target range of PAM sequences and significantly higher editing activity compared to wild type Cas12a.

In some embodiments, the Cas enzyme is a high-fidelity Cas12a variant (enAsCas12a-HF1) that reduces off-target editing.

In some embodiments, the Cas enzyme is Cas12b or C2c1. In some embodiments, the Cas12b is form *Alicyclobacillus acidoterrestris* (AacCas12b), or from *Alicyclobacillus acidiphilus* Cas12b (AapCas12b).

In some embodiments, the Cas enzyme is a Cas12b variant that functions at 37° C., such as one form *Bacillus hisashii* (BhCas12b).

In some embodiments, the Cas enzyme is a BhCas12b variant with higher specificity than SpCas9.

In some embodiments, the Cas enzyme is CasX or Cas12d.

In some embodiments, the Cas enzyme is CasY or Cas12e, and the subject engineered retron encodes a short-complementarity untranslated RNA (scoutRNA) together with crRNA (rather than tracrRNA used in other CRISPR-Cas systems).

In some embodiments, the Cas enzyme is Cas14, from archaea bacteria. Cas14 targets single-stranded (ss) DNA target sequences, does not require PAM sequence for activation, and has collateral activity (i.e., cuts other non-target ssDNA strands non-specifically upon binding the target sequence). Unlike Cas12a, Cas14a requires high fidelity complementarity to the target ssDNA, and is very sensitive to internal seed region mismatches of the ssDNA target substrate.

In some embodiments, the gRNA nuclease is an engineered RNA-guided FokI nuclease. RNA-guided FokI nucleases comprise fusions of inactive Cas9 (dCas9) and the FokI endonuclease (FokI-dCas9), wherein the dCas9 portion confers guide RNA-dependent targeting on FokI. For a description of engineered RNA-guided FokI nucleases, see, e.g., Havlicek et al. (2017) Mol. Ther. 25(2):342-355, Pan et al. (2016) Sci Rep. 6:35794, Tsai et al. (2014) Nat Biotechnol. 32(6):569-576; herein incorporated by reference.

In other embodiments, the RNA-guided nuclease can be a non-CRISPER/Cas related nuclease such as transposon-encoded nucleases, IscBs, IscR, or TnpBs.

In some embodiments, the Cas enzyme is a Cas9

In some embodiments, the retron-based editing systems described herein can include any Cas9 equivalent. A Cas9 equivalent is a Cas9-like protein that provides the same or substantially the same function as Cas9. For instance, if Cas9 refers to a type II enzyme of the CRISPR-Cas system, a Cas9 equivalent can refer to a type V or type VI enzyme of the CRISPR-Cas system.

For example, Cas12e (CasX) is a Cas9 equivalent that reportedly has the same function as Cas9 but which evolved through convergent evolution. Thus, the Cas12e (CasX) protein is contemplated to be used with the retron-based editor systems described herein. In addition, any variant or modification of Cas12e (CasX) is conceivable and within the scope of the present disclosure.

In some embodiments, Cas9 equivalents may refer to Cas12e (CasX) or Cas12d (CasY), which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-Cas12e and CRISPR-Cas12d, which are among the most compact systems yet discovered. In some embodiments, Cas9 refers to Cas12e, or a variant of Cas12e. In some embodiments, Cas9 refers to a Cas12d, or a variant of Cas12d. It should be appreciated that other RNA-guided DNA binding proteins may be used as a nucleic acid programmable DNA binding protein (napDNAbp), and are within the scope of this disclosure.

In some embodiments, the Cas9 equivalent comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas12e (CasX) or Cas12d (CasY) protein. In some embodiments, the napDNAbp is a naturally-occurring Cas12e (CasX) or Cas12d (CasY) protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein.

In various embodiments, the nucleic acid programmable DNA binding proteins include, without limitation, Cas9 (e.g., dCas9 and nCas9), Cas12e (CasX), Cas12d (CasY), Cas12a (Cpf1), Cas12b1 (C2c1), Cas13a (C2c2), Cas12c (C2c3), Argonaute, and Cas12b1. One example of a nucleic acid programmable DNA-binding protein that has different PAM specificity than Cas9 is Clustered Regularly Interspaced Short Palindromic Repeats from *Prevotella* and *Francisella* 1 (i.e, Cas12a (Cpf1)). Similar to Cas9, Cas12a (Cpf1) is also a Class 2 CRISPR effector, but it is a member of type V subgroup of enzymes, rather than the type II subgroup. It has been shown that Cas12a (Cpf1) mediates robust DNA interference with features distinct from Cas9. Cas12a (Cpf1) is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

In still other embodiments, the Cas protein may include any CRISPR associated protein, including but not limited to, Cas12a, Cas12b1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof.

In various other embodiments, the RNA-guided nuclease can be any of the following proteins: a Cas9, a Cas12a (Cpf1), a Cas12e (CasX), a Cas12d (CasY), a Cas12b1 (C2c1), a Cas13a (C2c2), a Cas12c (C2c3), a GeoCas9, a CjCas9, a Cas12g, a Cas12h, a Cas12i, a Cas13b, a Cas13c, a Cas13d, a Cas14, a Csn2, an xCas9, an SpCas9-NG, or an Argonaute (Ago) domain, or a variant thereof.

Amino acid sequences of RNA-guided nucleases are readily available and known in the art. Exemplary RNA-guided nucleases and their amino acid sequences can be found, for example, in WO 2017/070633, US 2020/0010835, US 2022/0204975, U.S. Ser. No. 11/071,790, WO 2020/191233, U.S. Ser. No. 11/447,770, U.S. Ser. No. 10/858,639, and U.S. Ser. No. 10/947,530, each of which are incorporated herein by reference in their entireties.

E. Programmable Nucleases (Other)

In addition to the CRISPR/Cas system, the subject engineered retron can also be used in combination with sequence-specific nucleases that do not use a guide RNA to recognize a target sequence, such as non-CRISPR/Cas sequence-specific nucleases including TALENs, ZFNs, meganucleases, and restriction enzymes, as well as other sequence-specific nucleases that use other RNA guides, such as transposon-encoded IscBs, IscR, or TnpBs.

For example, the subject engineered retron may encode or provide a msDNA that can serve as a donor or template sequence for HDR-mediated genome editing. Optionally, the RT of the engineered retron is fused to such sequence-specific nuclease, such that the msDNA, by way of being generated by the RT close to the site of HDR-mediated genome editing, can be more efficiently participate in the HDR-mediated genome editing.

In some embodiments, the non-CRISPR/Cas sequence-specific nuclease is or comprises a TALE Nuclease, a TALE nickase, Zinc Finger (ZF) Nuclease, ZF Nickase, meganuclease, or a combination thereof. In some embodiments, the non-CRISPR/Cas sequence-specific nuclease is or includes two, three, four, or more of an independently selected TALE Nuclease, TALE nickase, Zinc Finger (ZF) Nuclease, ZF Nickase, Meganuclease, restriction enzymes or a combination thereof. In some embodiments, the combination is or comprises a TALE Nuclease/a ZF Nuclease; a TALE Nickase/a ZF nickase.

In some embodiments, the non-CRISPR/Cas sequence-specific nuclease is or comprises a TALE Nuclease (Transcription Activator-Like Effector Nucleases (TALEN)). TALENs are restriction enzymes engineered to cut specific target DNA sequences. TALENs comprise a TAL effector (TALE) DNA-binding domain (which binds at or close to the target DNA), fused to a DNA cleavage domain which cuts target DNA. TALEs are engineered to bind to practically any desired DNA sequence. Thus in some embodiments, the TALEN comprises an N-terminal capping region, a DNA binding domain which may comprise at least one or more TALE monomers or half-monomers specifically ordered to target the genomic locus of interest, and a C-terminal capping region, wherein these three parts are arranged in a predetermined N-terminus to C-terminus orientation. Optionally, the TALEN includes at least one or more regulatory or functional protein domains.

In some embodiments, the TALE monomers or half monomers may be variant TALE monomers derived from natural or wild type TALE monomers but with altered amino acids at positions usually highly conserved in nature, and in particular have a combination of amino acids as RVDs that do not occur in nature, and which may recognize a nucleotide with a higher activity, specificity, and/or affinity than a naturally occurring RVD. The variants may include deletions, insertions and substitutions at the amino acid level, and transversions, transitions and inversions at the nucleic acid level at one or more locations. The variants may also include truncations.

In some embodiments, the TALE monomer/half monomer variants include homologous and functional derivatives of the parent molecules. In some embodiments, the variants are encoded by polynucleotides capable of hybridizing under high stringency conditions to the parent molecule-encoding wild-type nucleotide sequences.

In some embodiments, the DNA binding domain of the TALE has at least 5 of more TALE monomers and at least one or more half-monomers specifically ordered or arranged to target a genomic locus of interest. The construction and generation of TALEs or polypeptides of the invention may involve any of the methods known in the art.

Naturally occurring TALEs or "wild type TALEs" are nucleic acid binding proteins secreted by numerous species of proteobacteria. TALEs contain a nucleic acid binding domain composed of tandem repeats of highly conserved monomer polypeptides that are predominantly 33, 34 or 35 amino acids in length and that differ from each other mainly in amino acid positions 12 and 13. A general representation of a TALE monomer which is comprised within the DNA binding domain is X1-11-(X12X13)-X14-33 or 34 or 35, where the subscript indicates the amino acid position and X represents any amino acid. X12X13 indicate the RVDs. In some polypeptide monomers, the variable amino acid at position 13 is missing or absent and in such monomers, the RVD consists of a single amino acid. In such cases the RVD may be alternatively represented as X*, where X represents X12 and (*) indicates that X13 is absent. The DNA binding domain may comprise several repeats of TALE monomers and this may be represented as (X1-11-(X12X13)-X14-33 or 34 or 35)z, where z is optionally at least 5-40, such as 10-26.

The TALE monomers have a nucleotide binding affinity that is determined by the identity of the amino acids in its RVD. Polypeptide monomers with an RVD of NI preferentially bind to adenine (A), monomers with an RVD of NG preferentially bind to thymine (T), monomers with an RVD of HD preferentially bind to cytosine (C), monomers with an RVD of NN preferentially bind to both adenine (A) and guanine (G), monomers with an RVD of IG preferentially bind to T, monomers with an RVD of NS recognize all four base pairs and may bind to A, T, G or C. Thus, the number and order of the polypeptide monomer repeats in the nucleic acid binding domain of a TALE determines its nucleic acid target specificity. The structure and function of TALEs is further described in, for example, Moscou et al., *Science* 326:1501 (2009); Boch et al., *Science* 326:1509-1512 (2009); and Zhang et al., *Nature Biotechnology* 29:149-153 (2011), each of which is incorporated by reference in its entirety.

In some embodiments, the TALE is a dTALE (or designerTALE), see Zhang et al., Nature Biotechnology 29:149-153 (2011), incorporated herein by reference.

In some embodiments, the TALE monomer comprises an RVD of HN or NH that preferentially binds to guanine, and the TALEs have high binding specificity for guanine containing target nucleic acid sequences. In come embodiments, polypeptide monomers having RVDs RN, NN, NK, SN, NH, KN, HN, NQ, HH, RG, KH, RH and SS preferentially bind to guanine. In some embodiments, polypeptide monomers having RVDs RN, NK, NQ, HH, KH, RH, SS and SN preferentially bind to guanine. In some embodiments, polypeptide monomers having RVDs HH, KH, NH, NK, NQ, RH, RN and SS preferentially bind to guanine. In some embodiments, the RVDs that have high binding specificity for guanine are RN, NH RH and KH. In some embodiments, polypeptide monomers having an RVD of NV preferentially bind to adenine and guanine as do monomers having the RVD HN. Monomers having an RVD of NC preferentially bind to adenine, guanine and cytosine, and monomers having an RVD of S (or S*), bind to adenine, guanine, cytosine and thymine with comparable affinity. In more embodiments, monomers having RVDs of H*, HA, KA, N*, NA, NC, NS, RA, and S* bind to adenine, guanine, cytosine and thymine with comparable affinity. Such polypeptide monomers allow for the generation of degenerative TALEs able to bind to a repertoire of related, but not identical, target nucleic acid sequences.

In certain embodiments, the TALE polypeptide has a nucleic acid binding domain containing polypeptide monomers arranged in a predetermined N-terminus to C-terminus order such that each polypeptide monomer binds to a nucleotide of a predetermined target nucleic acid sequence, and where at least one of the polypeptide monomers has an RVD of HN or NH and preferentially binds to guanine, an RVD of NV and preferentially binds to adenine and guanine, an RVD of NC and preferentially binds to adenine, guanine and cytosine or an RVD of S and binds to adenine, guanine, cytosine and thymine.

In some embodiments, each polypeptide monomer of the nucleic acid binding domain that binds to adenine has an RVD of NI, NN, NV, NC or S.

In certain embodiments, each polypeptide monomer of the nucleic acid binding domain that binds to guanine has an RVD of HN, NH, NN, NV, NC or S.

In certain embodiments, each polypeptide monomer of the nucleic acid binding domain that binds to cytosine has an RVD of HD, NC or S.

In some embodiments, each polypeptide monomer that binds to thymine has an RVD of NG or S.

In some embodiments, each polypeptide monomer of the nucleic acid binding domain that binds to adenine has an RVD of NI.

In certain embodiments, each polypeptide monomer of the nucleic acid binding domain that binds to guanine has an RVD of HN or NH.

In certain embodiments, each polypeptide monomer of the nucleic acid binding domain that binds to cytosine has an RVD of HD.

In some embodiments, each polypeptide monomer that binds to thymine has an RVD of NG.

In certain embodiments, the RVDs that have a specificity for adenine are NI, RI, KI, HI, and SI.

In certain embodiments, the RVDs that have a specificity for adenine are HN, SI and RI, most preferably the RVD for adenine specificity is SI.

In certain embodiments, the RVDs that have a specificity for thymine are NG, HG, RG and KG.

In certain embodiments, the RVDs that have a specificity for thymine are KG, HG and RG, most preferably the RVD for thymine specificity is KG or RG.

In certain embodiments, the RVDs that have a specificity for cytosine are HD, ND, KD, RD, HH, YG and SD.

In certain embodiments, the RVDs that have a specificity for cytosine are SD and RD.

FIG. 4B of WO 2012/067428 provides representative RVDs and the nucleotides they target, the entire content of which is hereby incorporated herein by reference.

In certain embodiments, the variant TALE monomers may comprise any of the RVDs that exhibit specificity for a nucleotide as depicted in FIG. 4A of WO2012/067428. All such TALE monomers allow for the generation of degenerative TALEs able to bind to a repertoire of related, but not identical, target nucleic acid sequences.

In certain embodiments, the RVD SH may have a specificity for G, the RVD IS may have a specificity for A, and the RVD IG may have a specificity for T.

In certain embodiments, the RVD NT may bind to G and A. In certain embodiments, the RVD NP may bind to A, T and C. In certain embodiments, at least one selected RVD may be NI, HD, NG, NN, KN, RN, NH, NQ, SS, SN, NK, KH, RH, HH, KI, HI, RI, SI, KG, HG, RG, SD, ND, KD, RD, YG, HN, NV, NS, HA, S*, N*, KA, H*, RA, NA or NC.

The predetermined N-terminal to C-terminal order of the one or more polypeptide monomers of the nucleic acid or DNA binding domain determines the corresponding predetermined target nucleic acid sequence to which the TALE or polypeptides of the invention may bind.

As used herein the monomers and at least one or more half monomers are "specifically ordered to target" the genomic locus or gene of interest. In plant genomes, the natural TALE-binding sites always begin with a thymine (T), which may be specified by a cryptic signal within the non-repetitive N-terminus of the TALE polypeptide; in some cases this region may be referred to as repeat 0. In animal genomes, TALE binding sites do not necessarily have to begin with a thymine (T) and polypeptides of the invention may target DNA sequences that begin with T, A, G or C. The tandem repeat of TALE monomers always ends with a half-length repeat or a stretch of sequence that may share identity with only the first 20 amino acids of a repetitive full length TALE monomer and this half repeat may be referred to as a half-monomer (FIG. 8 of WO 2012/067428). Therefore, it follows that the length of the nucleic acid or DNA being targeted is equal to the number of full monomers plus two (see FIG. 44 of WO 2012/067428).

In certain embodiments, nucleic acid binding domains are engineered to contain 5, 6, 7, 8, 9, 10, 11, 12, 13, 14, 15, 16, 17, 18, 19, 20, 21, 22, 23, 24, 25, or more polypeptide monomers arranged in a N-terminal to C-terminal direction to bind to a predetermined 5, 6, 7, 8, 9, 10, 11, 12, 13, 14, 15, 16, 17, 18, 19, 20, 21, 22, 23, 24, 25 nucleotide length nucleic acid sequence.

In certain embodiments, nucleic acid binding domains are engineered to contain 5, 6, 7, 8, 9, 10, 11, 12, 13, 14, 15, 16, 17, 18, 19, 20, 21, 22, 23, 24, 25, 26 or more full length polypeptide monomers that are specifically ordered or arranged to target nucleic acid sequences of length 7, 8, 9, 10, 11, 12, 13, 14, 15, 16, 17, 18, 19, 20, 21, 22, 23, 24, 25, 26, 27 and 28 nucleotides, respectively. In certain embodiments, the polypeptide monomers are contiguous. In some embodiments, half-monomers may be used in the place of one or more monomers, particularly if they are present at the C-terminus of the TALE.

Polypeptide monomers are generally 33, 34 or 35 amino acids in length. With the exception of the RVD, the amino acid sequences of polypeptide monomers are highly conserved or as described herein, the amino acids in a polypeptide monomer, with the exception of the RVD, exhibit patterns that effect TALE activity, the identification of which may be used in preferred embodiments of the invention.

In certain embodiments, when the DNA binding domain may comprise (X1-11-X12X13-X14-33 or 34 or 35)z, wherein X1-11 is a chain of 11 contiguous amino acids, wherein X12X13 is a repeat variable diresidue (RVD), wherein X14-33 or 34 or 35 is a chain of 21, 22 or 23 contiguous amino acids, wherein z is at least 5 to 26, then the preferred combinations of amino acids are LTLD or LTLA or LTQV at X1-4, or EQHG or RDHG at positions X30-33 or X31-34 or X32-35. Furthermore, other amino acid combinations of interest in the monomers are LTPD at X1-4 and NQALE at XI 6-20 and DHG at X32-34 when the monomer is 34 amino acids in length. When the monomer is 33 or 35 amino acids long, then the corresponding shift occurs in the positions of the contiguous amino acids NQALE and DHG. In certain embodiments, NQALE is at X15-19 or X17-21 and DHG is at X31-33 or X33-35.

In certain embodiments, amino acid combinations of interest in the monomers, are LTPD at X1-4 and KRALE at X16-20 and AHG at X32-34 or LTPE at X1-4 and KRALE at XI 6-20 and DHG at X32-34 when the monomer is 34 amino acids in length. When the monomer is 33 or 35 amino acids long, the corresponding shift occurs in the positions of the contiguous amino acids KRALE, AHG and DHG. In certain embodiments, the positions of the contiguous amino acids may be (LTPD at X1-4 and KRALE at X15-19 and AHG at X31-33) or (LTPE at X1-4 and KRALE at X15-19 and DHG at X31-33) or (LTPD at X1-4 and KRALE at X17-21 and AHG at X33-35) or (LTPE at X1-4 and KRALE at X17-21 and DHG at X33-35).

In certain embodiments, contiguous amino acids [NGKQALE] are present at positions X14-20 or X13-19 or X15-21. These representative positions put forward various embodiments of the invention and provide guidance to identify additional amino acids of interest or combinations of amino acids of interest in all the TALE monomers (see FIGS. 24A-24F, and 25 of WO 2012/067428).

Exemplary amino acid sequences of conserved portions of polypeptide monomers are provided below. The position of the RVD in each sequence is represented by XX or by X* (wherein (*) indicates that the RVD is a single amino acid and residue 13 (X13) is absent).

```
                                        (SEQ ID NO: 19176)
LTPAQVVAIASXXGGKQALETVQRLLPVLCQDHG (SEQ ID NO: 19177)
LTPAQVVAIASX*GGKQALETVQRLLPVLCQDHG (SEQ ID NO: 19178)
LTPDQVVAIANXXGGKQALATVQRLLPVLCQDHG (SEQ ID NO: 19179)
LTPDQVVAIANXXGGKQALETLQRLLPVLCQDHG (SEQ ID NO: 19180)
LTPDQVVAIANXXGGKQALETVQRLLPVLCQDHG
```

```
                                              (SEQ ID NO: 19181)
    LTPDQVVAIASXXGGKQALATVQRLLPVLCQDHG (SEQ ID NO: 19182)
    LTPDQVVAIASXXGGKQALETVQRLLPVLCQDHG (SEQ ID NO: 19183)
    LTPDQVVAIASXXGGKQALETVQRVLPVLCQDHG (SEQ ID NO: 19184)
    LTPEQVVAIASXXGGKQALETVQRLLPVLCQAHG (SEQ ID NO: 19185)
    LTPYQVVAIASXXGSKQALETVQRLLPVLCQDHG (SEQ ID NO: 19186)
    LTREQVVAIASXXGGKQALETVQRLLPVLCQDHG (SEQ ID NO: 19187)
    LSTAQVVAIASXXGGKQALEGIGEQLLKLRTAPYG (SEQ ID NO: 19188)
    LSTAQVVAVASXXGGKPALEAVRAQLLALRAAPYG
```

A further listing of TALE monomers excluding the RVDs which may be denoted in a sequence (X1-11-X14-34 or X1-11-X14-35), wherein X is any amino acid and the subscript is the amino acid position is provided in FIG. 24A-F of WO 2012/067428, which is incorporated herein by reference.

In certain embodiments, TALE polypeptide binding efficiency is increased by including amino acid sequences from the "capping regions" that are directly N-terminal or C-terminal of the DNA binding region of naturally occurring TALEs into the engineered TALEs at positions N-terminal or C-terminal of the engineered TALE DNA binding region. Thus, in certain embodiments, the TALE polypeptides described herein further comprise an N-terminal capping region and/or a C-terminal capping region.

An exemplary amino acid sequence of a N-terminal capping region is:

```
                                              (SEQ ID NO: 19150)
    MDPIRSRTPSPARELLSGPQPDGVQPTADRGVSPPAGGPL

DGLPARRTMSRTRLPSPPAPSPAFSADSFSDLLRQFDPSL

FNTSLFDSLPPFGAHHTEAATGEWDEVQSGLRAADAPPPT

MRVAVTAARPPRAKPAPRRRAAQPSDASPAAQVDLRTLGY

SQQQQEKIKPKVRSTVAQHHEALVGHGFTHAHIVALSQHP

AALGTVAVKYQDMIAALPEATHEAIVGVGKQWSGARALEA

LLTVAGELRGPPLQLDTGQLLKIAKRGGVTAVEAVHAWRN

ALTGAPLN
```

An exemplary amino acid sequence of a C-terminal capping region is:

```
                                              (SEQ ID NO: 19151)
    RPALESIVAQLSRPDPALAALTNDHLVALACLGGRPALDA

VKKGLPHAPALIKRTNRRIPERTSHRVADHAQVVRVLGFF

QCHSHPAQAFDDAMTQFGMSRHGLLQLFRRVGVTELEARS

GTLPPASQRWDRILQASGMKRAKPSPTSTQTPDQASLHAF

ADSLERDLDAPSPMHEGDQTRAS
```

As used herein the predetermined "N-terminus" to "C terminus" orientation of the N-terminal capping region, the DNA binding domain comprising the repeat TALE monomers and the C-terminal capping region provide structural basis for the organization of different domains in the d-TALEs or polypeptides of the invention.

The entire N-terminal and/or C-terminal capping regions are not necessary to enhance the binding activity of the DNA binding region. Therefore, in certain embodiments, fragments of the N-terminal and/or C-terminal capping regions are included in the TALE polypeptides described herein.

In certain embodiments, the TALE (including TALEs) polypeptides described herein contain a N-terminal capping region fragment that included at least 10, 20, 30, 40, 50, 54, 60, 70, 80, 87, 90, 94, 100, 102, 110, 117, 120, 130, 140, 147, 150, 160, 170, 180, 190, 200, 210, 220, 230, 240, 250, 260 or 270 amino acids of an N-terminal capping region. In certain embodiments, the N-terminal capping region fragment amino acids are of the C-terminus (the DNA-binding region proximal end) of an N-terminal capping region. N-terminal capping region fragments that include the C-terminal 240 amino acids enhance binding activity equal to the full length capping region, while fragments that include the C-terminal 147 amino acids retain greater than 80% of the efficacy of the full length capping region, and fragments that include the C-terminal 117 amino acids retain greater than 50% of the activity of the full-length capping region.

In some embodiments, the TALE polypeptides described herein contain a C-terminal capping region fragment that included at least 6, 10, 20, 30, 37, 40, 50, 60, 68, 70, 80, 90, 100, 110, 120, 127, 130, 140, 150, 155, 160, 170, 180 amino acids of a C-terminal capping region. In certain embodiments, the C-terminal capping region fragment amino acids are of the N-terminus (the DNA-binding region proximal end) of a C-terminal capping region. In certain embodiments, C-terminal capping region fragments that include the C-terminal 68 amino acids enhance binding activity equal to the full length capping region, while fragments that include the C-terminal 20 amino acids retain greater than 50% of the efficacy of the full length capping region.

In certain embodiments, the capping regions of the TALE polypeptides described herein do not need to have identical sequences to the capping region sequences provided herein. Thus, in some embodiments, the capping region of the TALE polypeptides described herein have sequences that are at least 50%, 60%, 70%, 80%, 85%, 90%, 91%, 92%, 93%, 94%, 95%, 96%, 97%, 98% or 99% identical or share identity to the capping region amino acid sequences provided herein. Sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. In some preferred embodiments, the capping region of the TALE polypeptides described herein have sequences that are at least 95% identical or share identity to the capping region amino acid sequences provided herein.

Sequence homologies may be generated by any of a number of computer programs known in the art, which include but are not limited to BLAST or FASTA. Suitable computer program for carrying out alignments like the GCG Wisconsin Bestfit package may also be used. Once the software has produced an optimal alignment, it is possible to calculate % homology, preferably % sequence identity. The software typically does this as part of the sequence comparison and generates a numerical result. % homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues.

Additional sequences for the conserved portions of polypeptide monomers and for N-terminal and C-terminal capping regions are included in the sequences with the following gene accession numbers: AAW59491.1, AAQ79773.2, YP_450163.1, YP_001912778.1, ZP_02242672.1, AAW59493.1, AAY54170.1, ZP_02245314.1, ZP_02243372.1, AAT46123.1, AAW59492.1, YP 451030.1, YP 001915105.1, ZP_02242534.1, AAW77510.1, ACD11364.1, ZP 02245056.1, ZP_02245055.1, ZP_02242539.1, ZP_02241531.1, ZP_02243779.1, AAN01357.1, ZP_02245177.1, ZP 02243366.1, ZP_02241530.1, AAS58130.3, ZP_02242537.1, YP_200918.1, YP 200770.1, YP_451187.1, YP_451156.1, AAS58127.2, YP_451027.1, UR_451025.1, AAA92974.1, UR_001913755.1, ABB70183.1, UR_451893.1, UR_450167.1, ABY60855.1, UR 200767.1, ZR_02245186.1, ZR_02242931.1, ZR_02242535.1, AAU54169.1, UR_450165.1, UR_001913452.1, AAS58129.3, ACM44927.1, ZR_02244836.1, AAT46125.1, UR_450161.1, ZR_02242546.1, AAT46122.1, UR_451897.1, AAF98343.1, UR_001913484.1, AAY54166.1, UR_001915093.1, UR_001913457.1, ZR_02242538.1, UR_200766.1, UR_453043.1, UR_001915089.1, UR_001912981.1, ZR_02242929.1, UR_001911730.1, UR_201654.1, UR_199877.1, ABB70129.1, UR 451696.1, UR_199876.1, AAS75145.1, AAT46124.1, UR_200914.1, UR 001915101.1, ZR_02242540.1, AAG02079.2, UR_451895.1, YP 451189.1, UR_200915.1, AAS46027.1, UR_001913759.1, UR_001912987.1, AAS58128.2, AAS46026.1, UR_201653.1, UR_202894.1, UR_001913480.1, ZR_02242666.1, R_001912775.1, ZR_02242662.1, AAS46025.1, AAC43587.1, BAA37119.1, NPJ544725.1, AB077779.1, BAA37120.1, ACZ62652.1, BAF46271.1, ACZ62653.1, NPJ544793.1, ABO77780.1, ZR_02243740.1, ZR_02242930.1, AAB69865.1, AAY54168.1, ZR_02245191.1, UR 001915097.1, ZR_02241539.1, UR_451158.1, BAA37121.1, UR_001913182.1, UR_200903.1, ZR_02242528.1, ZR_06705357.1, ZR_06706392.1, AD148328.1, ZR_06731493.1, ADI48327.1, AB077782.1, ZR_06731656.1, NR_942641.1, AAY43360.1, ZR_06730254.1, ACN39605.1, UR 451894.1, UR_201652.1, UR_001965982.1, BAF46269.1, NPJ544708.1, ACN82432.1, AB077781.1, P14727.2, BAF46272.1, AAY43359.1, BAF46270.1, NR_644743.1, ABG37631.1, AAB00675.1, YP 199878.1, ZR_02242536.1, CAA48680.1, ADM80412.1, AAA27592.1, ABG37632.1, ABP97430.1, ZR_06733167.1, AAY43358.1, 2KQ5_A, BAD42396.1, ABO27075.1, UR 002253357.1, UR_002252977.1, ABO27074.1, ABO27067.1, ABO27072.1, ABO27068.1, UR_003750492.1, ABO27073.1, NR_519936.1, ABO27071.1, ABO27070.1, and AB027069.1, each of which is hereby incorporated by reference.

In some embodiments, the TALEs described herein also include a nuclear localization signal and/or cellular uptake signal. Such signals are known in the art and may target a TALE to the nucleus and/or intracellular compartment of a cell. Such cellular uptake signals include, but are not limited to, the minimal Tat protein transduction domain which spans residues 47-57 of the human immunodeficiency virus Tat protein: YGRKKRRQRRR. (SEQ ID NO:19189).

In some embodiments, the TALEs described herein include a nucleic acid or DNA binding domain that is a non-TALE nucleic acid or a non-TALE DNA binding domain.

As used herein the term "non-TALE DNA binding domain" refers to a DNA binding domain that has a nucleic acid sequence corresponding to a nucleic acid sequence which is not substantially homologous to a nucleic acid that encodes for a TALE protein or fragment thereof, e.g., a nucleic acid sequence which is different from a nucleic acid that encodes for a TALE protein and which is derived from the same or a different organism.

In certain embodiments, the TALEs described herein include a nucleic acid or DNA binding domain that is linked to a non-TALE polypeptide.

A "non-TALE polypeptide" refers to a polypeptide having an amino acid sequence corresponding to a protein which is not substantially homologous to a TALE protein or fragment thereof, e.g., a protein which is different from a TALE protein and which is derived from the same or a different organism. In this context, the term "linked" is intended include any manner by which the nucleic acid binding domain and the non-TALE polypeptide could be connected to each other, including, for example, through peptide bonds by being part of the same polypeptide chain or through other covalent interactions, such as a chemical linker. The non-TALE polypeptide may be linked, for example to the N-terminus and/or C-terminus of the nucleic acid binding domain, may be linked to a C-terminal or N-terminal cap region, or may be connected to the nucleic acid binding domain indirectly.

In certain embodiments, the TALEs or polypeptides of the invention comprise chimeric DNA binding domains. Chimeric DNA binding domains may be generated by fusing a full TALE (including the N- and C-terminal capping regions) with another TALE or non-TALE DNA binding domain such as zinc finger (ZF), helix-loop-helix, or catalytically-inactivated DNA endonucleases (e.g., EcoRI, meganucleases, etc.), or parts of TALE may be fused to other DNA binding domains. The chimeric domain may have novel DNA binding specificity that combines the specificity of both domains.

In certain embodiments, the TALE polypeptides of the invention include a nucleic acid binding domain linked to the one or more effector domains. In certain embodiments, the effector domain is a nickase or nuclease.

In certain embodiments, the sequence-specific nuclease is a zinc finger nuclease (ZFN), such as an artificial zinc-finger nuclease having arrays of zinc-finger (ZF) modules to target new DNA-binding sites in a target sequence (e.g., target sequence or target site in the genome). Each zinc finger module in a ZF array targets three DNA bases. A customized array of individual zinc finger domains is assembled into a ZF protein (ZFP). The resulting ZFP can be linked to a functional domain such as a nuclease.

ZF nucleases (ZFN) may be used as alternative programmable nucleases for use in retron-based editing in place of RNA-guide nucleases. ZFN proteins have been extensively described in the art, for example, in Carroll et al., "Genome Engineering with Zinc-Finger Nucleases," Genetics, August 2011, Vol. 188: 773-782; Durai et al., "Zinc finger nucleases: custom-designed molecular scissors for genome engineering of plant and mammalian cells," Nucleic Acids Res, 2005, Vol. 33: 5978-90; and Gaj et al., "ZFN, TALEN, and CRISPR/Cas-based methods for genome engineering," Trends Biotechnol. 2013, Vol. 31: 397-405, each of which are incorporated herein by reference in their entireties.

In certain embodiments, the ZF-linked nuclease is a catalytic domain of the Type IIS restriction enzyme FokI (see Kim et al., *PNAS U.S.A.* 91:883-887, 1994; Kim et al., PNAS U.S.A. 93:1156-1160, 1996, both incorporated herein by reference).

In certain embodiments, the ZFN comprises paired ZFN heterodimers, resulting in increased cleavage specificity and/or decreased off-target activity. In this embodiment, each ZFN in the heterodimer targets different nucleotide sequences separated by a short spacer (see Doyon et al., Nat. Methods 8:74-79, 2011, incorporated herein by reference).

In certain embodiments, the ZFN comprises a polynucleotide-binding domain (comprising multiple sequence-specific ZF modules) and a polynucleotide cleavage nickase domain.

In certain embodiments, the ZFs are engineered using libraries of two finger modules.

In certain embodiments, strings of two-finger units are used in ZFNs to improve DNA binding specificity from polyzinc finger peptides (see PNAS USA 98: 1437-1441, incorporated herein by reference).

In certain embodiments, the ZFN has more than 3 fingers. In certain embodiments, the ZFN has 4, 5, or 6 fingers. In certain embodiments, the ZF modules in the ZFN are separated by one or more linkers to improve specificity.

In certain embodiments, the ZF of the ZFN includes substitutions in the dimer interface of the cleavage domain that prevent homodimerization between ZFs, but allow heterodimers to form.

In certain embodiments, the ZF of the ZFN has a design that retains activity while suppressing homodimerization.

In certain embodiments, the ZFN is any one of the ZF nucleases in Table 1 of Carroll et al., Genetics 188(4):773-782, 2011, incorporated herein by reference.

General principles and guidance for generating ZF, ZF arrays, and ZFN can be found in the art, such as the modular design (where the different modules can be rearranged and assembled into new combinations for new targets) of the ZF or ZF arrays in the ZFN as taught in Carroll et al., *Nat. Protoc.* 1: 1329-1341, 2006 (incorporated herein by reference); the new three-finger sets for engineered ZFs generated by using partially randomized libraries; profiling the DNA-binding specificities of engineered Cys2His2 zinc finger domains using a rapid cell-based method (see *Nucleic Acids Res.* 35: e81, incorporated by reference). ZFs for certain DNA triplets that work well in neighbor combination are described in Sander et al., 2011. Selection-free zinc-finger-nuclease engineering by context-dependent assembly (CoDA) is taught in *Nat. Methods* 8: 67-69). ToolGen describes the individual fingers in their collection that are best behaved in modular assembly (Kim et al., 2011). Preassembled zinc-finger arrays for rapid construction of ZFNs are taught in Nat. Methods 8:7.

Additional, non-limiting ZFs and AFNz that can be adapted for use in the instant invention include those described in WO2010/065123, WO2000/041566, WO2003/080809, WO2015/143046, WO2016/183298, WO2013/044008, WO2015/031619, WO2017/136049, WO2016/014794, WO2017/091512, WO1995/009233, WO2000/023464, WO2000/042219, WO2002/026960, WO2001/083793; U.S. Pat. Nos. 9,428,756, 9,145,565, 8,846,578, 8,524,874, 6,777,185, 6,599,692, 7,235,354, 6,503,717, 7,491,531, 7,943,553, 7,262,054, 8,680,021, 7,705,139, 7,273,923, 6,780,590, 6,785,613, 7,788,044, 7,177,766, 6,453,242, 6,794,136, 7,358,085, 8,383,766, 7,030,215, 7,013,219, 7,361,635, 7,939,327, 8,772,453, 9,163,245, 7,045,304, 8,313,925, 9,260,726, 6,689,558, 8,466,267, 7,253,273, 7,947,873, 9,388,426, 8,153,399, 8,569,253, 8,524,221, 7,951,925, 9,115,409, 8,772,008, 9,121,072, 9,624,498, 6,979,539, 9,491,934, 6,933,113, 9,567,609, 7,070,934, 9,624,509, 8,735,153, 9,567,573, 6,919,204, US2002-0081614, US2004-0203064, US2006-0166263, US2006-0292621, US2003-0134318, US2006-0294617, US2007-0287189, US2007-0065931, US2003-0105593, US2003-0108880, US2009-0305402, US2008-0209587, US2013-0123484, US2004-0091991, US2009-0305977, US2008-0233641, US2014-0287500, US2011-0287512, US2009-0258363, US2013-0244332, US2007-0134796, US2010-0256221, US2005-0267061, US2012-0204282, US2012-0252122, US2010-0311124, US2016-0215298, US2008-0031109, US2014-0017214, US2015-0267205, US2004-0235002, US2004-0204345, US2015-0064789, US2006-0063231, US2011-0265198, US2017-0218349, all incorporated herein by reference.

Polynucleotides and vectors capable of expressing one or more of the ZFNs are also provided herein, which can be part of the vector system of the invention. The polynucleotides and vectors can be expressed in a cell, such as a eukaryotic cell, a mammalian cell, or a human cell. Suitable vectors, cells and expression systems are described in greater detail elsewhere herein, and can be suitable for use with the TALEs, the meganucleases, and the CRISPR-Cas nucleases.

In certain embodiments, the sequence-specific nuclease is a meganuclease.

Meganucleases are a class of sequence-specific endonucleases that recognize large DNA target sites (>12 bp). These proteins can cleave a unique chromosomal sequence without affecting overall genome integrity. Meganucleases create site specific DNA DSBs, and, in the presence of donor DNA, such as one present in the heterologous nucleic acid encompassed by or encoded by the engineered retron of the invention, promotes the integration of the donor DNA at the cleavage site through homologous recombination (HR).

In certain embodiments, the meganuclease is a homing endonuclease, which is a widespread class of proteins found in eukaryotes, bacteria and archaea. In certain embodiments, the meganuclease is of the LAGLIDADG family of homing endonucleases.

In certain embodiments, the meganuclease is I-Scel, I-Cre-I, I-Dmol, or an engineered or a naturally occurring variant thereof. The hallmark of these proteins is a well conserved LAGLIDADG peptide motif, termed (do)decapeptide, found in one or two copies. Homing endonucleases with only one such motif, such as I-Crel or I-Ceul, function as homodimers. In contrast, larger proteins bearing two (do)decapeptide motifs, such as I-Scel, Pl-Scel and I-Dmol are single chain proteins.

Additional homing nucleases are found at the website of homingendonuclease.net, which provides a database listing basic properties of known LAGLIDADG homing endonucleases. See also Taylor et al., *Nucleic Acids Research* 40 (W1): W110-W116, 2012 (all incorporated herein by reference).

In certain embodiments, specificity (or polynucleotide recognition) of the meganuclease is modified by altering the amino acids within the meganuclease, and/or by fusing other effector domains with the meganuclease.

In certain embodiments, the meganuclease is a megaTAL, which includes a DNA binding domain from a TALE.

In certain embodiments, the meganuclease is engineered to have nickase activity.

Additional suitable natural and engineered meganucleases and megaTALs are described in WO2006/097853, WO2004/067736, WO2012/030747, WO2007/123636, WO2010/001189, WO2018/071565, WO2007/049095, WO2009/068937, WO2005/105989, WO2008/102198, WO2007/057781, WO2019/126558, WO2010/046786, US2010-0151556, US2014-0121115, US2011-0207199, US2012-0301456, US2013-0189759, US2011-0158974, US2010-0144012, US2014-0112904, US2013-0196320, US2010-0203031, US2010-0167357, US2012-0272348, US2012-0258537, US2011-0072527, US2013-0183282, US2014-0178942, US2012-0260356, US2013-0236946, US2010-0325745, US2011-0041194, US2014-0004608, US2011-0263028, US2011-0225664, US2013-0145487, US2013-0045539, US2012-0171191, US2015-0315557, US2014-0017731, US2011-0091441, US2014-0038239, US2010-0229252, US2009-0222937, US2010-0146651, US2013-0059387, US2011-0179507, US2013-0326644, US2006-0078552, US2004-0002092, US2012-0052582, US2009-0162937, US2010-0086533, US2009-0220476, U.S. Pat. Nos. 8,802,437, 7,842,489, 8,715,992, 8,426,177, 8,476,072, 9,365,864, 9,540,623, 9,273,296, 9,290,748, 8,163,514, 8,148,098, 8,143,016, 8,143,015, 8,133,697, 8,129,134, 8,124,369, 8,119,361, 7,897,372, 9,683,257, U.S. Ser. No. 10/287,626, U.S. Ser. No. 10/273,524, U.S. Ser. No. 10/000,746, U.S. Ser. No. 10/006,052, U.S. Pat. Nos. 7,919,605, 9,018,364, U.S. Ser. No. 10/407,672, U.S. Pat. Nos. 8,211,685, 9,365,864, 7,476,500, all incorporated herein by reference.

In certain embodiments, the sequence-specific nuclease is TnpB, which is a programmable RNA-guided DNA endonuclease. It is believed that TnpB is a functional progenitor of the CRISPR-Cas nucleases.

Transposons are mobile genetic elements that contain only the genes required for their transposition and its regulation. These elements encode the tnpA transposase, which is essential for mobilization, and often carry an accessory tnpB gene, which is dispensable for transposition. TnpB has been shown to be a nuclease that is guided by an RNA, derived from the right-end element of a transposon, to cleave DNA next to the 5'-TTGAT transposon-associated motif, and TnpB can be reprogrammed to cleave DNA target sites in human cells.

In certain embodiments, tnpB is from *D. radiodurans* ISDra2 of the IS200/IS605 family.

In certain embodiments, tnpB is from transposon PsiTn554.

In certain embodiments, the sequence-specific nuclease is a TnpB-like protein, such as Fanzor1 or Fanzor2. These proteins are widespread in diverse eukaryotic transposable elements (TEs), and in large double-stranded DNA (dsDNA) viruses infecting eukaryotes. Fanzor and TnpB proteins share the same conserved amino acid motif in their C-terminal half regions: D-X(125, 275)-[TS]-[TS]-X-X-[C4 zinc finger]-X(5,50)-RD, but are highly variable in their N-terminal regions. Fanzor1 proteins are frequently captured by DNA transposons from different superfamilies including Helitron, Mariner, IS4-like, Sola and MuDr. In contrast, Fanzor2 proteins appear only in some IS607-type elements.

In certain embodiments, the sequence-specific nuclease is IscB.

ISC (insertion sequences Cas9-like) is a novel group of bacterial and archaeal DNA transposons that encode Cas9 homologs. The ISC transposon-encoded two nuclease domain-containing proteins are the likely ancestors of the CRISPR-associated Cas9. The homology region includes the arginine-rich helix and the HNH nuclease domain that is inserted into the RuvC-like nuclease domain. ISC genes, however, are not linked to Cas genes or CRISPR. They represent a distinct group of nonautonomous transposons, with many diverse families of full-length ISC transposons. Their terminal sequences (particularly 3' termini) are similar to those of IS605 superfamily transposons that are mobilized by the Y1 tyrosine transposase encoded by the TnpA gene, and often also encode the TnpB protein containing the RuvC-like endonuclease domain. The terminal regions of the ISC and IS605 transposons contain palindromic structures that are likely recognized by the Y1 transposase. The transposons from these two groups are inserted either exactly in the middle or upstream of specific 4-bp target sites, without target site duplication.

In certain embodiments, the sequence-specific nuclease is a restriction endonuclease (RE), such as an RE with stringent/long recognition sequence of at least 8 nts.

In certain embodiments, the RE is a rare-cutter RE with seven and eight base pair recognition sequences. Exemplary rare-cutter RE enzyme include NotI, which cuts after the first GC of a 5'-GCGGCCGC-3' sequence.

In certain embodiments, the components of the system—e.g., the retron encoded ncRNA or msDNA in complex with the RT, the sequence-specific nuclease, and the DNA-repair modulating biomolecule, may form multiple complexes in a so-called split complex configuration. The multiple complexes may be brought together to form a functional complex.

For example, in some embodiments, a first component in the system may be a split protein or domain. A fragment of the split protein or domain may associate with a second component of the system, while another fragment of the split protein or domain may associate with a third component of the system. The two fragments of the split protein or domain may be brought together (e.g., along with the other components of the system) to form a functional complex.

In certain embodiments, the split protein or domain is the sequence-specific nuclease, e.g., a CRISPR/Cas effector enzyme (e.g., Cas protein such as Cas9 or Cas12), a ZFN, a TALEN, a meganuclease, TnpB, IscB, or a restriction endonuclease (RE).

In certain embodiments, the split protein or domain is the reverse transcriptase domain.

In certain embodiments, the split protein or domain is the DNA-repair modulating biomolecule.

For example a first fragment of the sequence-specific nuclease may associate with the reverse transcriptase domain and a second fragment of the sequence-specific nuclease may associate with the DNA-repair modulating biomolecule. The two fragments of the split protein or domain may be brought together (e.g., along with the reverse transcriptase domain and the DNA-repair modulating biomolecule) to form a functional complex. The associations between the parts of the split protein or domain may be through adaptor proteins or linkers described herein (e.g., those used for associating Cas proteins with function domains).

In certain embodiments, the split protein or domain is split in the sense that the two parts of the split protein or domain substantially comprise a functioning split protein or domain. Ideally, the split should always be so that the catalytic domain(s) are unaffected. That split protein or domain may function as a sequence-specific nuclease or it may be a dead-Cas which is essentially an RNA-binding protein with very little or no catalytic activity, due to typically mutation(s) in its catalytic domains.

Each fragment of the split protein or domain may be fused to a dimerization partner. For example, rapamycin sensitive dimerization domains enables a chemically inducible split protein or domain for temporal control of the split protein or domain's activity. The split protein or domain can thus be rendered chemically inducible by being split into two fragments and that rapamycin-sensitive dimerization domains may be used for controlled reassembly of the split protein or domain. The two parts of the split protein or domain can be thought of as the N' terminal part and the C' terminal part of the split protein or domain. The fusion is typically at the split point of the split protein or domain. In other words, the C' terminal of the N' terminal part of the split protein or domain is fused to one of the dimer halves, whilst the N' terminal of the C' terminal part is fused to the other dimer half.

The split protein or domain does not have to be split in the sense that the break is newly created. The split point is typically designed in silico and cloned into the constructs. Together, the two parts of the split protein or domain, the N' terminal and C' terminal parts, form a full split protein or domain, comprising preferably at least 70% or more of the wildtype amino acids (or nucleotides encoding them), at least 80% or more, at least 90% or more, at least 95% or more, and at least 99% or more of the wildtype amino acids (or nucleotides encoding them). When the two parts are brought together, the desired split protein or domain function is restored or reconstituted. The dimer may be a homodimer or a heterodimer.

In certain embodiments, the protein components of the system—e.g., the RT, the sequence-specific nuclease (a CRISPR/Cas effector enzyme, a ZFN, a TALEN, a meganuclease, TnpB, IscB, or a restriction endonuclease (RE)), and the DNA-repair modulating biomolecule, may further comprise one or more additional functional domains.

In certain embodiments, the functional domain comprises a nuclear localization signal (NLS). In certain embodiments, one or more C-terminal or N-terminal NLSs are attached. In certain embodiments, a C-terminal NLS is attached for expression and nuclear targeting in eukaryotic cells, e.g., human cells. In certain embodiments, the NLS(s) may be at a location that is not at the C-terminus or N-terminus, for example, the NLS(s) may be between two polypeptides.

Non-limiting examples of NLSs include an NLS sequence derived from: the NLS of the SV40 virus large T-antigen; the NLS from nucleoplasmin (e.g., the nucleoplasmin bipartite NLS); the c-myc NLS; the hRNPA1 M9 NLS; the NLS of the IBB domain from importin-alpha; the NLS of the myoma T protein; the NLS of human p53; the NLS of mouse c-abl IV; the NLS of the influenza virus NS1; the NLS of the Hepatitis virus delta antigen; the NLS of the mouse Mxl protein; the NLS of the human poly(ADP-ribose) polymerase; and the NLS of the steroid hormone receptors (human) glucocorticoid. Exemplary NLS sequences include those described in paragraph [00106] of Feng Zhang et al. (WO2016/106236), all incorporated herein by reference.

In certain embodiments, the functional domain comprises at least two NLS domains. The one or more NLS domain(s) may be positioned at or near or in proximity to a terminus of a polypeptide and, if two or more NLSs, each of the two may be positioned at or near or in proximity to a terminus of the polypeptide.

In any of the fusion proteins, the fusion between the two domains (such as the RT and Cas enzyme, or the Cas and the DNA-repair modulating biomolecule) may be linked through a linker.

A "linker" as used herein includes a peptide which joins two proteins or domains to form a fusion protein. Generally, such molecules have no specific biological activity other than to join or to preserve some minimum distance or other spatial relationship between the proteins/domains. However, in certain embodiments, the linker may be selected to influence some property of the linker and/or the fusion protein such as the folding, net charge, or hydrophobicity of the linker. Suitable linkers for use in the present disclosure are well-known to those of skill in the art and include, but are not limited to, straight or branched-chain carbon linkers, heterocyclic carbon linkers, or peptide linkers. However, as used herein, the linker may also be a covalent bond (carbon-carbon bond or carbon-heteroatom bond).

In particular embodiments, the linker is used to separate the sequence-specific nuclease (a CRISPR/Cas effector enzyme, a ZFN, a TALEN, a meganuclease, TnpB, IscB, or a restriction endonuclease (RE)) and the RT and/or the DNA-repair modulating biomolecule by a distance sufficient to ensure that each protein domain retains its required functional property.

Preferred peptide linker sequences adopt a flexible extended conformation and do not exhibit a propensity for developing an ordered secondary structure. In certain embodiments, the linker can be a chemical moiety which can be monomeric, dimeric, multimeric or polymeric. In certain embodiments, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence.

In certain embodiments, the linker comprises a GlySer-rich sequence, such as a $G_nS$ linker. (SEQ ID NO:19152) (n=1, 2, 3, 4, or 5, such as GS or $G_4S$), or repeats thereof (such as 1, 2, 3, 4, 5, 6, 7, 8, 9, 10, 11, 12, 13, 14, 15, 16, 17, 18, 19, or 20 repeats, optionally with an overall length of about 4-30 residues, 4-20 residues, or 4-10 residues).

In certain embodiments, the linker comprises a $G_4S$ linker with 3, 6, 9, or 12 repeats.

In certain embodiments, the linker is one disclosed in Maratea et al., Gene 40: 39-46, 1985; Murphy et al., PNAS USA 83: 8258-62, 1986; U.S. Pat. No. 4,935,233; or U.S. Pat. No. 4,751,180, all incorporated by reference.

In certain embodiments, the linker comprises a GlySer linker such as GGS, GGGS, GSG, GGGGS(SEQ ID NO:19143), optionally with repeats of 3 (such as $(GGS)_3$ (SEQ ID NO:19153), $(GGGGS)_3$) (SEQ ID NO:19154), 4, 5, 6, 7, 8, 9, 10, 11, or 12 or more, to provide suitable lengths.

In certain embodiments, the linker comprises $(GGGGS)_{3-15}$ (SEQ ID NO:19155), such as $(GGGGS)_{3-11}$ (SEQ ID NO:19155), e.g., GGGGS with 1, 2, 3, 4, 5, 6, 7, 8, 9, 10, or 11 repeats.

In certain embodiments, the linker comprises

```
                              (SEQ ID NO: 19156)
LEPGEKPYKCPECGKSFSQSGALTRHQR.

THTR.
```

In yet an additional embodiment, the linker is an XTEN linker.

In certain embodiments, N- and/or C-terminal NLSs also function as linker (e.g., PKKKRKVEASSPKKRKVEAS). (SEQ ID NO:19157)

The gRNA and the various nucleases and fusions thereof can be provided in the form of a protein, optionally where the nuclease is complexed with a gRNA, or provided by a nucleic acid encoding the RNA-guided nuclease, such as an RNA (e.g., messenger RNA) or DNA (expression vector). In some embodiments, the RNA-guided nuclease and the gRNA are both provided by vectors. Both can be expressed by a single vector or separately on different vectors. The vectors encoding the RNA-guided nuclease and gRNA may be included in the vector system comprising the engineered retron msr gene, msd gene and ret gene sequences.

Codon usage may be optimized to improve production of the engineered retron e.g., retron reverse transcriptase, ncRNA and/or RNA-guided nuclease in a particular cell or organism. For example, a nucleic acid encoding an ncRNA, RNA-guided nuclease or reverse transcriptase can be modified to substitute codons having a higher frequency of usage in a the particular cell such as a eukaryotic cell (e.g., yeast cell, a human cell, a non-human cell, a mammalian cell, a rodent cell, a mouse cell, a rat cell), or any other host cell of interest, as compared to the naturally occurring polynucleotide sequence. When a nucleic acid encoding the reverse transcriptase or ncRNA is introduced into cells, the protein can be transiently, conditionally, or constitutively expressed in the cell.

F. RT-PN Fusion Proteins

The recombinant retron-based editing system described herein contemplates fusion proteins comprising a programmable nuclease (PN) and a RT, optionally joined by a linker. The application contemplates any suitable programmable nuclease and RT (e.g., retron RTs of Table A) to be combined in a single fusion protein. In one embodiment, the RT is joined to the N-terminus of the PN. In another embodiment, the RT is joined to the C-terminus of the PN. The Examples of PNs and RTs are each defined herein.

In various embodiments, the fusion proteins may comprise any suitable structural configuration. For example, the fusion protein may comprise from the N-terminus to the C-terminus direction, a PN fused to a RT. In other embodiments, the fusion protein may comprise from the N-terminus to the C-terminus direction, a RT fused to a NP. The fused domain may optionally be joined by a linker, e.g., an amino acid sequence.

G. Nuclear Localization Signals

In various embodiments, any of the polypeptide components of the retron-based editing systems may be engineered with one or more nuclear localization signals, which help promote translocation of a protein into the cell nucleus. The polypeptides of the retron-based editing system may comprise any known NLS sequence, including any of those described in Cokol et al., "Finding nuclear localization signals," EMBO Rep., 2000, 1(5): 411-415 and Freitas et al., "Mechanisms and Signals for the Nuclear Import of Proteins," Current Genomics, 2009, 10(8): 550-7, each of which are incorporated herein by reference.

In various embodiments, the polypeptides disclosed herein may include one or more, preferably, at least two nuclear localization signals. The NLSs may be any known NLS sequence in the art. The NLSs may also be any future-discovered NLSs for nuclear localization. The NLSs also may be any naturally-occurring NLS, or any non-naturally occurring NLS (e.g., an NLS with one or more desired mutations). The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., International PCT application PCT/EP2000/011690, filed Nov. 23, 2000, published as WO/2001/038547 on May 31, 2001, the contents of which are incorporated herein by reference. In some embodiments, an NLS comprises the amino acid sequence PKKKRKV (SEQ ID NO: 19147).

A representative nuclear localization signal is a peptide sequence that directs the protein to the nucleus of the cell in which the sequence is expressed. A nuclear localization signal is predominantly basic, can be positioned almost anywhere in a protein's amino acid sequence, generally comprises a short sequence of four amino acids (Autieri & Agrawal, (1998) J. Biol. Chem. 273: 14731-37, incorporated herein by reference) to eight amino acids, and is typically rich in lysine and arginine residues (Magin et al., (2000) Virology 274: 11-16, incorporated herein by reference). Nuclear localization signals often comprise proline residues. A variety of nuclear localization signals have been identified and have been used to effect transport of biological molecules from the cytoplasm to the nucleus of a cell. See, e.g., Tinland et al., (1992) Proc. Natl. Acad. Sci. U.S.A. 89:7442-46; Moede et al., (1999) FEBS Lett. 461:229-34, which is incorporated by reference. Translocation is currently thought to involve nuclear pore proteins.

Most NLSs can be classified in three general groups: (i) a monopartite NLS exemplified by the SV40 large T antigen NLS (PKKKRKV) (SEQ ID NO: 19147); (ii) a bipartite motif consisting of two basic domains separated by a variable number of spacer amino acids and exemplified by the *Xenopus* nucleoplasmin NLS (KRXXXXXXXXXXKKKL) (SEQ ID NO:19190); and (iii) noncanonical sequences such as M9 of the hnRNP A1 protein, the influenza virus nucleoprotein NLS, and the yeast Gal4 protein NLS (Dingwall and Laskey 1991). Nuclear localization signals appear at various points in the amino acid sequences of proteins. NLS's have been identified at the N-terminus, the C-terminus and in the central region of proteins. Thus, the disclosure provides polypeptides that may be modified with one or more NLSs at the C-terminus, the N-terminus, as well as at in internal region of a polypeptide (including a fusion protein).

The present disclosure contemplates any suitable means by which to modify a polypeptide to include one or more NLSs. In one aspect, a polypeptide (e.g., a programmable nuclease) may be engineered to express with a translationally fused NLS at its N-terminus or its C-terminus (or both), i.e., to form a polypeptide-NLS fusion construct. In addition, the NLSs may include various amino acid linkers or spacer regions encoded between a polypeptide and the N-terminally, C-terminally, or internally-attached NLS amino acid sequence, e.g, and in the central region of proteins.

Thus, the present disclosure also provides for nucleotide constructs, vectors, and host cells for expressing fusion proteins that comprise a polypeptide and one or more NLSs.

H. DNA-Repair Modulating Biomolecules

In certain embodiments, the engineered retron described herein (e.g., an engineered nucleic acid construct or engineered nucleic acid-enzyme construct described herein) further comprises or encodes a DNA-repair modulating biomolecule, which may further enhance the efficiency of integration of a transgene on the heterologous nucleic acid by homology dependent repair (HDR).

In certain embodiments, the DNA-repair modulating biomolecule comprises a Nonhomologous end joining (NHEJ) inhibitor.

In certain embodiments, the DNA-repair modulating biomolecule comprises a homologous directed repair (HDR) promoter.

In certain embodiments, the DNA-repair modulating biomolecule comprises a NHEJ inhibitor and an HDR promoter.

In certain embodiments, the DNA-repair modulating biomolecule enhances or improves more precise genome editing and/or the efficiency of homologous recombination, compared to the otherwise identical embodiment without the DNA-repair modulating biomolecule.

HDR promoters and/or NHEJ inhibitors can, in some embodiments, comprise one or more small molecules. Systems bearing recombination enhancers such as small molecules that activate HDR and suppress NHEJ locally at the genomic site of the DNA damage can be tailored in their placement on the engineered systems to further enhance their efficiency. In general, the small molecule recombination enhancers can be synthesized to bear linkers and a functional group, such as maleimide for reacting with a thiol group on a Cys residue of a protein, for chemical conjugation to the engineered systems. Use of commercially available functionalized PEG linkers (alkyne, azide, cyclooctyne etc.) can also be employed for conjugation, and orthogonal conjugation chemistries can be utilized for the multivalent display.

Conjugation sites can be readily identified where modifications do not affect the potency of the recombination enhancers selected.

In certain embodiments, multivalent display of one or more DNA-repair modulating biomolecule can be affected, including multiple moieties of NHEJ inhibitors, HDR promoters, or a combination thereof. See, for example, "Genomic targeting of epigenetic probes using a chemically tailored Cas9 system" by Liszczak et al., *Proc Natl Acad Sci U.S.A.* 114: 681-686, 2017 (incorporated herein by reference). In certain embodiments, multivalent display of small molecule compounds can be achieved through sortase loop proteins used as a scaffold for their display.

In some embodiments, the DNA-repair modulating biomolecule may comprise an HDR promoter. The HDR promoter may comprise small molecules, such as RSI or analogs thereof. In certain embodiments, the HDR promoter stimulates RAD51 activity or RAD52 motif protein 1 (RDM1) activity. In certain embodiments, the HDR promoter comprises Nocodazole, which can result in higher HDR selection.

In certain embodiments, the HDR promoter may be administered prior to the delivery of the engineered retron described herein.

In certain embodiments, the HDR promoter locally enhances HDR without NHEJ inhibition. For example, RAD51 is a protein involved in strand exchange and the search for homology regions during HDR repair. In certain embodiments, the HDR promoter is phenylbenzamide RSI, identified as a small-molecule RAD51-stimulator (see WO2019/135816 at [0200]-[0204], specifically incorporated herein by reference).

In certain embodiments, the DNA-repair modulating biomolecule comprises C-terminal binding protein interacting protein (CtIP) or a functional fragment or homolog thereof. CtIP is a key protein in early steps of homologous recombination. According to this embodiment, the CtTP or the functional fragment or homolog thereof can be linked (e.g., fused) to the RT or the sequence-specific nuclease (e.g., a CRISPR/Cas effector enzyme, a ZFN, a TALEN, a meganuclease, TnpB, IscB, or a restriction endonuclease (RE)), and stimulates transgene integration by HDR.

In certain embodiments, the CtTP fragment is a minimal N-terminal fragment of the wild-type CtIP, such as the N-terminal fragment comprising residues 1-296 of the full-length CtIP (the HE for HDR enhancer), as described in Charpentier et al. (Nature Comm., DOI: 10.1038/s41467-018-03475-7, incorporated herein by reference), shown to be sufficient to stimulate HDR. The activity of the fragment depends on CDK phosphorylation sites (e.g., S233, T245, and S276) and the multimerization domain essential for CtIP activity in homologous recombination. Thus alternative fragments comprising the CDK phosphorylation sites and the multimerization domain essential for CtTP activity are also within the scope of the invention.

In certain embodiments, the DNA-repair modulating biomolecule comprises a dominant negative 53BP1.

In certain embodiments, the DNA-repair modulating biomolecule comprises a cell cycle-specific degradation tag, such as the degradation domain of the (human) Geminin, and the (murine) CyclinB2.

In certain embodiments, the DNA-repair modulating biomolecule comprises CyclinB2, a member of the B-type cyclins that associate with p34cdc2, and an essential component of the cell cycle regulatory machinery. CRISPR-mediated knock-in efficiency may be increased by promoting the relative increase in Cas9 activity in G2 phase of the cell cycle, when HDR is more active. In certain embodiments, the degradation domains of the (human) Geminin and (murine) CyclinB2 can be used as either N- or C-terminal fusion (e.g., fusions with a Cas, such as Cas9, or the retron RT) to serve as the DNA-repair modulating biomolecule. These domains are known to determine a cell-cycle specific profile of chimeric proteins, namely an increase in their relative concentration in S and G2 compared to G1, high-jacking the conventional CyclinB2 and Geminin degradation pathways. This produces active Geminin-Cas9 and CyclinB2-Cas9 chimeric proteins, which are degraded in a cell-cycle-dependent manner. Such chimeras shift the repair of the DSBs to the HDR repair pathway compared to the commonly used Cas9.

While not wishing to be bound by particular theory, it is believed that the application of such cell cycle-specific degradation tags permits/promotes more efficient/secure gene editing.

In certain embodiments, the DNA-repair modulating biomolecule comprises a Rad family member protein, such as Rad50, Rad51, Rad52, etc., which functions to promote foreign DNA integration into a host chromosome. Specifically, Rad52 is an important homologous recombinant protein, and its complex with Rad51 plays a key role in HDR, mainly involved in the regulation of foreign DNA in eukaryotes. Key steps in the process of HR include repair mediated by Rad51 and strand exchange. Co-expression of Rad52 as a DNA-repair modulating biomolecule significantly enhances the likelihood of HDR by, e.g., three-fold.

In certain embodiments, the DNA-repair modulating biomolecule comprises a RAD52 protein as, e.g., either an N- or a C-terminal fusion.

In certain embodiments, the DNA-repair modulating biomolecule comprises a RAD52 motif protein 1 (RDM1) that functions similarly as RAD52. RDM1 has been shown to be able to repair DSBs caused by DNA replication, prevent G2 or M cell cycle arrest, and improve HDR selection.

In certain embodiments, the DNA-repair modulating biomolecule comprises a dominant negative version of the tumor suppressor p53-binding protein 1 (53BP1). The wild-type protein 53BP1 is a key regulator of the choice between NHEJ and HDR—it is a pro-NHEJ factor which limits HDR by blocking DNA end resection, and also by inhibiting BRCA1 recruitment to DSB sites. It has been shown that global inhibition of 53BP1 by a ubiquitin variant significantly improves Cas9-mediated HDR frequency in non-hematopoietic and hematopoietic cells with single-strand oligonucleotide delivery or double-strand donor in AAV.

In certain embodiments, the dominant negative (DN) version of the 53BP1 comprises the minimal focus forming region, but lacks domains outside this region, e.g., towards the N-terminus and tandem C-terminal BRCT repeats that recruit key effectors involved in NHEJ, such as RIF1-PTIP and EXPAND, respectively. The 53BP1 adapter protein is recruited to specific histone marks at sites of DSBs via this minimal focus forming region, which comprises several conserved domains including an oligomerization domain (OD), a glycine-arginine rich (GAR) motif, a Tudor domain, and an adjacent ubiquitin-dependent recruitment (UDR) motif. The Tudor domain mediates interactions with histone H4 dimethylated at K2023.

In certain embodiments, a dominant negative version of 53BP1 (DN1S) suppresses the accumulation of endogenous 53BP1 and downstream NHEJ proteins at sites of DNA damage, while upregulating the recruitment of the BRCA1 HDR protein. Such a DN version of the 53BP1 can be used as the DNA-repair modulating biomolecule, either as an N- or a C-terminal fusion (such as a Cas9 fusion, to locally inhibit NHEJ at the Cas9-target site defined by its gRNA, while promoting an increase in HDR, and does not globally affect NHEJ, thereby improving cell viability).

In certain embodiments, the DNA-repair modulating biomolecule comprises an NHEJ inhibitor, such as an inhibitor of DNA ligase IV, a KU inhibitor (e.g., KU70 or KU80), a DNA-PKc inhibitor, or an artemis inhibitor.

In certain embodiments, the NHEJ inhibitor inhibits the NHEJ pathway, enhances HDR, or modulates both. In certain embodiments, the NHEJ inhibitor is a small molecule inhibitor.

In certain embodiments, the small molecule inhibitor of the NHEJ pathway comprises an SCR7 analog, for example, PK66, PK76, PK409.

In certain embodiments, the NHEJ inhibitor comprises a KU inhibitor, for example, KU5788, and KU0060648.

In certain embodiments, a small molecule NHEJ inhibitor is linked to a polyglycine tripeptide through PEG for sortase-mediated ligation, as described in WO2019/135816, Guimaraes et al., *Nat Protoc* 8:1787-99, 2013; Theile et al., *Nat Protoc* 8:1800-7, 2013; and Schmohl et al., *Curr Opin Chem Biol* 22:122-8, 2014 (all incorporated herein by reference). The same means can also be used for attaching small molecule HDR enhancers to protein.

An exemplary method for conjugating a small molecule DNA-repair modulating biomolecule without loss of activity is described in WO2019135816, where SCR-7 conjugation of a poly-glycine peptide with the para-carboxylic moiety at ring 4 retained activity of the inhibitor, with rings 1, 2 and 3 of the molecule having involvement in the target-engagement, providing a simple and effective strategy to ligate a small molecule NHEJ inhibitor to the system described herein (e.g., to the sequence-specific nuclease including Cas enzymes, or to the RT) to precisely enhance HDR pathway near a nucleic acid target site.

In certain embodiments, a nucleic acid targeting moiety conjugates based on small molecule inhibitor of DNA-dependent protein kinase (DNA-PK) or heterodimeric Ku (KU70/KU80) can be utilized. KU-0060648 is one potent KU-inhibitors, which can also be functionalized with poly-glycine and used for recombination enhancement.

In certain embodiments, the DNA-repair modulating biomolecule comprises the Tumor Suppressor p53. p53 plays a direct role in DNA repair, including HR regulation, where it affects the extension of new DNA, thereby affecting HDR selection. In vivo, p53 binds to the nuclear matrix and is a rate-limiting factor in repairing DNA structure. p53 regulates DNA repair processes in almost all eukaryotes via transactivation-dependent and -independent pathways, but only the transactivation-independent function of p53 is involved in HR regulation. Wild-type p53 protein can link double stranded breaks to form intact DNA, as well as also playing a role in inhibiting NHEJ. p53 interacts with HR-related proteins, including Rad51, where it controls HR through direct interaction with Rad51.

I. Vectors for Expression of Engineered Retrons

Delivery of an engineered retron to a cell can generally be accomplished with or without vectors. Delivery of the ncRNA encoded by the engineered retron generally does not require a vector used to produce the ncRNA from the engineered retron. For example, the ncRNA can be packaged directly into a delivery vehicle such as a lipid nanoparticle and delivered into a host cell, as described in other sections.

The engineered retrons (or vectors containing them) may be introduced into any type of cell, including any cell from a prokaryotic, eukaryotic, or archaeon organism, including bacteria, archaea, fungi, protists, plants (e.g., monocotyledonous and dicotyledonous plants); and animals (e.g., vertebrates and invertebrates). Examples of animals that may be transfected with an engineered retron include, without limitation, vertebrates such as fish, birds, mammals (e.g., human and non-human primates, farm animals, pets, and laboratory animals), reptiles, and amphibians.

The engineered retrons can be introduced into a single cell or a population of cells. Cells from tissues, organs, and biopsies, as well as recombinant cells, genetically modified cells, cells from cell lines cultured in vitro, and artificial cells (e.g., nanoparticles, liposomes, polymersomes, or microcapsules encapsulating nucleic acids) may all be transfected with the engineered retrons.

The engineered retrons can be introduced into cellular fragments, cell components, or organelles (e.g., mitochondria in animal and plant cells, plastids (e.g., chloroplasts) in plant cells and algae).

Cells may be cultured or expanded after transfection with the engineered retron.

Methods of introducing nucleic acids into a host cell are well known in the art. Commonly used methods include chemically induced transformation, typically using divalent cations (e.g., $CaCl_2$), dextran-mediated transfection, polybrene mediated transfection, lipofectamine and LT-1 mediated transfection, electroporation, protoplast fusion, encapsulation of nucleic acids in liposomes, and direct microinjection of the nucleic acids comprising engineered retrons into nuclei. See, e.g., Sambrook et al. (2001) Molecular Cloning, a laboratory manual, 3rd edition, Cold Spring Harbor Laboratories, New York, Davis et al. (1995) Basic Methods in Molecular Biology, 2nd edition, McGraw-Hill, and Chu et al. (1981) Gene 13:197; herein incorporated by reference in their entireties.

Methods for genetic transformation of plant cells are known in the art and include those set forth in US2022/

0145296, and U.S. Pat. Nos. 8,575,425; 7,692,068; 8,802,934; 7,541,517; each of which is herein incorporated by reference in its entirety. See, also, Rakoczy-Trojanowska, M. (2002) Cell Mol Biol Lett. 7:849-858; Jones et al. (2005) Plant Methods 1:5; Rivera et al. (2012) Physics of Life Reviews 9:308-345; Bartlett et al. (2008) Plant Methods 4:1-12; Bates, G. W. (1999) Methods in Molecular Biology 111:359-366; Binns and Thomashow (1988) Annual Reviews in Microbiology 42:575-606; Christou, P. (1992) The Plant Journal 2:275-281; Christou, P. (1995) Euphytica 85:13-27; Tzfira et al. (2004) TRENDS in Genetics 20:375-383; Yao et al. (2006) Journal of Experimental Botany 57:3737-3746; Zupan and Zambryski (1995) Plant Physiology 107:1041-1047; and Jones et al. (2005) Plant Methods 1:5.

The plant cells that have been transformed may be grown into a transgenic organism, such as a plant, in accordance with conventional methods. See, for example, McCormick et al. (1986) Plant Cell Reports 5:81-84.

Plant material that may be transformed with the engineered retrons described herein includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Progeny, variants, and mutants of the regenerated plants are also included within the scope of the disclosure, provided that these parts comprise the genetic modification introduced by the engineered retron. Further provided is a processed plant product or byproduct that retains the genetic modification introduced by the engineered retron.

The engineered retrons described herein may be used to produce transgenic plants with desired phenotypes, including but not limited to, increased disease resistance (e.g., increased viral, bacterial of fungal resistance), increased insect resistance, increased drought resistance, increased yield, and altered fruit ripening characteristics, sugar and oil composition, and color.

In some embodiments, the retron msr gene, msd gene, and/or ret gene are expressed in vitro from a vector, such as in an in vitro transcription system. The resulting ncRNA or msDNA can be isolated before being packaged and/or formulated for direct delivery into a host cell. For example, the isolated ncRNA or msDNA can be packaged/formulated in a delivery vehicle such as lipid nanoparticles as described in other sections.

In some embodiments, the retron msr gene, msd gene, and/or ret gene are expressed in vivo from a vector within a cell. The retron msr gene, msd gene, and/or ret gene can be introduced into a cell with a single vector or in multiple separate vectors to produce msDNA in a host subject.

In other embodiments, the retron msr gene, msd gene, and/or ret gene, and any other components of the retron-based genome editing systems described herein (e.g., guide RNA in trans, programmable nuclease (e.g., in trans)) may be expressed in vivo from RNA delivered to the cell. The retron msr gene, msd gene, and/or ret gene can be introduced into a cell with a single vector or in multiple separate vectors to produce msDNA in a host subject.

Vectors and/or nucleic acid molecules encoding the recombinant retron-based genome editing system or components thereof can include control elements operably linked to the retron sequences, which allow for the production of msDNA either in vitro, or in vivo in the subject species. For example, the retron msr gene, msd gene, and/or ret gene can be operably linked to a promoter to allow expression of the retron reverse transcriptase and/or the msDNA product. In some embodiments, heterologous sequences encoding desired products of interest (e.g., polynucleotide encoding polypeptide or regulatory RNA, donor polynucleotide for gene editing, or protospacer DNA for molecular recording) may be inserted in the msr gene and/or msd gene.

Any eukaryotic, archaeal, or prokaryotic cell, capable of being transfected with a vector or retron delivery system comprising the engineered retron sequences, may be used to produce the msDNA in vivo. The ability of constructs to produce the msDNA along with other retron-encoded products can be empirically determined. For example the transfected cell can be assayed either through phenotypic changes that occur due to the introduced sequences or by direct DNA sequencing.

In some embodiments, the engineered retron is produced by a vector system comprising one or more vectors. In the vector system, the msr gene, the msd gene, and/or the ret gene may be provided by the same vector (i.e., cis arrangement of all such retron elements), wherein the vector comprises a promoter operably linked to the msr gene and/or the msd gene. In some embodiments, the promoter is further operably linked to the ret gene. In other embodiments, the vector further comprises a second promoter operably linked to the ret gene. Alternatively, the ret gene may be provided by a second vector that does not include the msr gene and/or the msd gene (i.e., trans arrangement of msr-msd and ret). In yet other embodiments, the msr gene, the msd gene, and the ret gene are each provided by different vectors (i.e., trans arrangement of all retron elements).

Numerous vectors are available for use in the vector or vector system, including but not limited to, linear polynucleotides, polynucleotides associated with ionic or amphiphilic compounds, plasmids, and viruses.

Examples of viral vectors include, but are not limited to, adenoviral vectors, adeno-associated virus (AAV) vectors, retroviral vectors, lentiviral vectors, and the like. An expression construct can be replicated in a living cell, or it can be made synthetically.

In some embodiments, the nucleic acid comprising an engineered retron sequence is under transcriptional control of a promoter. In some embodiments, the promoter is competent for initiating transcription of an operably linked coding sequence by a RNA polymerase I, II, or III.

Exemplary promoters for mammalian cell expression include the SV40 early promoter, a CMV promoter such as the CMV immediate early promoter (see, U.S. Pat. Nos. 5,168,062 and 5,385,839, incorporated herein by reference in their entireties), the mouse mammary tumor virus LTR promoter, the adenovirus major late promoter (Ad MLP), and the herpes simplex virus promoter, among others. Other nonviral promoters, such as a promoter derived from the murine metallothionein gene, will also find use for mammalian expression.

Exemplary promoters for plant cell expression include the CaMV 35S promoter (Odell et al., 1985, Nature 313:810-812); the rice actin promoter (McElroy et al., 1990, Plant Cell 2:163-171); the ubiquitin promoter (Christensen et al., 1989, Plant Mol. Biol. 12:619-632; and Christensen et al., 1992, Plant Mol. Biol. 18:675-689); the pEMU promoter (Last et al., 1991, Theor. Appl. Genet. 81:581-588); and the MAS promoter (Velten et al., 1984, EMBO J. 3:2723-2730).

In additional embodiments, the retron-based vectors may also comprise tissue-specific promoters to start expression only after it is delivered into a specific tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-b promoter, Mb promoter, Nphs1 promoter, OG-2 promoter, SP-B promoter, SYN1 promoter, and WASP promoter.

These and other promoters can be obtained from or incorporated into commercially available plasmids, using techniques well known in the art. See, e.g., Sambrook et al., supra.

In some embodiments, one or more enhancer elements is/are used in association with the promoter to increase expression levels of the constructs. Examples include the SV40 early gene enhancer, as described in Dijkema et al., EMBOJ (1985) 4:761, the enhancer/promoter derived from the long terminal repeat (LTR) of the Rous Sarcoma Virus, as described in Gorman et al., Proc. Natl. Acad. Sci. USA (1982b) 79:6777, and elements derived from human CMV, as described in Boshart et al., Cell (1985) 41:521, such as elements included in the CMV intron A sequence. All such sequences are incorporated herein by reference.

In one embodiment, an expression vector for expressing an engineered retron, including the msr gene, msd gene, and/or ret gene comprises a promoter operably linked to a polynucleotide encoding the msr gene, msd gene, and/or ret gene.

In some embodiments, the vector or vector system also comprises a transcription terminator/polyadenylation signal. Examples of such sequences include, but are not limited to, those derived from SV40, as described in Sambrook et al., supra, as well as a bovine growth hormone terminator sequence (see, e.g., U.S. Pat. No. 5,122,458).

Additionally, 5'-UTR sequences can be placed adjacent to the coding sequence to further enhance the expression. Such sequences may include UTRs comprising an internal ribosome entry site (IRES). Inclusion of an IRES permits the translation of one or more open reading frames from a vector. The IRES element attracts a eukaryotic ribosomal translation initiation complex and promotes translation initiation. See, e.g., Kaufman et al., Nuc. Acids Res. (1991) 19:4485-4490; Gurtu et al., Biochem. Biophys. Res. Comm. (1996) 229:295-298: Rees et al., BioTechniques (1996) 20:102-110; Kobayashi et al., BioTechniques (1996) 21:399-402; and Mosser et al., BioTechniques (199722 ISO-161)c. A multitude of IRES sequences are known and include sequences derived from a wide variety of viruses, such as from leader sequences of picornaviruses such as the encephalomyocarditis virus (EMCV) UTR (Jang et al. Virol. (1989) 63:1651-1660). the polio leader sequence, the hepatitis A virus leader, the hepatitis C virus IRES, human rhinovirus type 2 IRES (Dobrikova et al., Proc. Natl. Acad. Sci. (2003) 100(251:15125-151301)). an IRES element from the foot and mouth disease virus (Ramesh et al., Nucl. Acid Res. (1996) 24:2697-2700), a giardiavirus IRES (Garlapati et al., J Biol. Chem. (2004) 279(51):3389-33971) and the like. A variety of nonviral IRES sequences will also find use herein, including, but not limited to IRES sequences from yeast, as well as the human angiotensin II type 1 receptor IRES (Martin et al., Mol. Cell Endocrinol. (2003) 212:51-61), fibroblast growth factor IRESs (FGF-1 IRES and FGF-2 IRES, Martineau et al. (2004) Mol. Cell. Biol. 24(17): 7622-7635), vascular endothelial growth factor IRES (Baranick et al. (2008) Proc. Natl. Acad Sci. U.S.A. 105(12): 4733-4738, Stein et al. (1998) Mol. Cell. Biol. 18(6):3112-3119, Bert et al. (2006) RNA 12(6): 1074-1083), and insulin-like growth factor 2 IRES (Pedersen et al. (2002) Biochem. J. 363(Pt 1):37-44).

These elements are commercially available in plasmids sold, e.g., by Clontech (Mountain View, CA), Invivogen (San Diego, CA), Addgene (Cambridge, MA) and GeneCopoeia (Rockville, MD). See also IRESite: The database of experimentally verified IRES structures (iresite.org). An IRES sequence may be included in a vector, for example, to express multiple bacteriophage recombination proteins for recombineering or an RNA-guided nuclease (e.g., Cas9) for HDR in combination with a retron reverse transcriptase from an expression cassette.

In some embodiments, a polynucleotide encoding a viral self-cleaving 2A peptide, such as a T2A peptide, can be used to allow production of multiple protein products (e.g., Cas9, bacteriophage recombination proteins, retron reverse transcriptase) from a single vector or a single transcription unit under one promoter. One or more 2A linker peptides can be inserted between the coding sequences in the multicistronic construct. The 2A peptide, which is self-cleaving, allows co-expressed proteins from the multicistronic construct to be produced at equimolar levels. 2A peptides from various viruses may be used, including, but not limited to 2A peptides derived from the foot-and-mouth disease virus, equine rhinitis A virus, Jhosea asigna virus and porcine teschovirus-1. See, e.g., Kim et al. (2011) PLoS One 6(4): e18556, Trichas et al. (2008) BMC Biol. 6:40, Provost et al. (2007) Genesis 45(10): 625-629, Furler et al. (2001) Gene Ther. 8(11):864-873; herein incorporated by reference in their entireties.

In some embodiments, the expression construct comprises a plasmid suitable for transforming a bacterial host. Numerous bacterial expression vectors are known to those of skill in the art, and the selection of an appropriate vector is a matter of choice. Bacterial expression vectors include, but are not limited to, pACYC177, pASK75, pBAD, pBADM, pBAT, pCal, pET, pETM, pGAT, pGEX, pHAT, pKK223, pMal, pProEx, pQE, and pZA31 Bacterial plasmids may contain antibiotic selection markers (e.g., ampicillin, kanamycin, erythromycin, carbenicillin, streptomycin, or tetracycline resistance), a lacZ gene (b-galactosidase produces blue pigment from x-gal substrate), fluorescent markers (e.g., GFP. mCherry), or other markers for selection of transformed bacteria. See, e.g., Sambrook et al., supra.

In other embodiments, the expression construct comprises a plasmid suitable for transforming a yeast cell. Yeast expression plasmids typically contain a yeast-specific origin of replication (ORI) and nutritional selection markers (e.g., HIS3, URA3, LYS2, LEU2, TRP1, METIS, ura4+, leu1+, ade6+), antibiotic selection markers (e.g., kanamycin resistance), fluorescent markers (e.g., mCherry), or other markers for selection of transformed yeast cells. The yeast plasmid may further contain components to allow shuttling between a bacterial host (e.g., E coif) and yeast cells. A number of different types of yeast plasmids are available including yeast integrating plasmids (Yip), which lack an ORI and are integrated into host chromosomes by homologous recombination; yeast replicating plasmids (YRp), which contain an autonomously replicating sequence (ARS) and can replicate independently; yeast centromere plasmids (YCp), which are low copy vectors containing a part of an ARS and part of a centromere sequence (CEN); and yeast episomal plasmids (YEp), which are high copy number plasmids comprising a fragment from a 2 micron circle (a natural yeast plasmid) that allows for 50 or more copies to be stably propagated per cell.

In other embodiments, the expression construct does not comprise a plasmid suitable for transforming a yeast cell.

In other embodiments, the expression construct comprises a virus or engineered construct derived from a viral genome. A number of viral based systems have been developed for gene transfer into mammalian cells. These include adenoviruses, retroviruses (g-retroviruses and lentiviruses), poxviruses, adeno-associated viruses, baculoviruses, and herpes simplex viruses (see e.g., Warnock et al. (2011) Methods Mol. Biol. 737:1-25; Walther et al. (2000) Drugs 60(2):249-271; and Lundstrom (2003) Trends Biotechnol. 21(3): 117-122; herein incorporated by reference in their entireties). The ability of certain viruses to enter cells via receptor-mediated endocytosis, to integrate into host cell genomes and express viral genes stably and efficiently have made them attractive candidates for the transfer of foreign genes into mammalian cells.

For example, retroviruses provide a convenient platform for gene delivery systems. Selected sequences can be inserted into a vector and packaged in retroviral particles using techniques known in the art. The recombinant virus can then be isolated and delivered to cells of the subject either in vivo or ex vivo. A number of retroviral systems have been described (U.S. Pat. No. 5,219,740; Miller and Rosman (1989) BioTechniques 7:980-990; Miller, A. D. (1990) Human Gene Therapy 1:5-14; Scarpa et al. (1991) Virology 180:849-852; Bums et al. (1993) Proc. Natl. Acad. Sci. USA 90:8033-8037; Boris-Lawrie and Temin (1993) Cur. Opin. Genet. Develop. 3:102-109; and Ferry et al. (2011) Curr. Pharm. Des. 17(24): 2516-2527). Lentiviruses are a class of retroviruses that are particularly useful for delivering polynucleotides to mammalian cells because they are able to infect both dividing and nondividing cells (see e.g., Lois et al. (2002) Science 295:868-872; Durand et al. (2011) Viruses 3(2): 132-159; herein incorporated by reference).

A number of adenoviral vectors have also been described. Unlike retroviruses which integrate into the host genome, adenoviruses persist extrachromosomally thus minimizing the risks associated with insertional mutagenesis.

Additionally, various adeno-associated vims (AAV) vector systems have been developed for gene delivery. AAV vectors can be readily constructed using techniques well known in the art. See, e.g., U.S. Pat. Nos. 5,173,414 and 5,139,941; International Publication Nos. WO 92/01070 (published 23 Jan. 1992) and WO 93/03769 (published 4 Mar. 1993); Lebkowski et al., Molec. Cell. Biol. (1988) 8:3988-3996; Vincent et al., Vaccines 90 (1990) (Cold Spring Harbor LaboratoryPress); Carter, B. J. Current Opinion in Biotechnology (1992) 3:533-539; Muzyczka, N. Current Topics in Microbiol and Immunol. (1992) 158:97-129; Kotin, R. M. Human Gene Therapy (1994) 5:793-801; Shelling and Smith, Gene Therapy (1994) 1:165-169; and Zhou et al., J. Exp. Med. (1994) 179:1867-1875.

Another vector system useful for delivering nucleic acids encoding the engineered retrons is the enterically administered recombinant poxvirus vaccines described by Small, Jr., P. A., et al. (U.S. Pat. No. 5,676,950, issued Oct. 14, 1997, herein incorporated by reference).

Other viral vectors include those derived from the pox family of viruses, including vaccinia virus and avian poxvirus. By way of example, vaccinia virus recombinants expressing a nucleic acid molecule of interest (e.g., engineered retron) can be constructed as follows. The DNA encoding the particular nucleic acid sequence is first inserted into an appropriate vector so that it is adjacent to a vaccinia promoter and flanking vaccinia DNA sequences, such as the sequence encoding thymidine kinase (TK). This vector is then used to transfect cells which are simultaneously infected with vaccinia. Homologous recombination serves to insert the vaccinia promoter plus the gene encoding the sequences of interest into the viral genome. The resulting TK-recombinant can be selected by culturing the cells in the presence of 5-bromodeoxyuridine and picking viral plaques resistant thereto.

In some embodiments, avipoxviruses, such as the fowlpox and canarypox viruses, can also be used to deliver the nucleic acid molecules of interest. The use of an avipox vector is particularly desirable in human and other mammalian species since members of the avipox genus can only productively replicate in susceptible avian species and therefore are not infective in mammalian cells. Methods for producing recombinant avipoxviruses are known in the art and employ genetic recombination, as described above with respect to the production of vaccinia viruses. See, e.g., WO 91/12882; WO 89/03429; and WO 92/03545.

Molecular conjugate vectors, such as the adenovirus chimeric vectors described in Michael et al., J. Biol. Chem. (1993) 268:6866-6869 and Wagner et al., Proc. Natl. Acad. Sci. USA (1992) 89:6099-6103, can also be used for gene delivery.

Members of the alphavirus genus, such as, but not limited to, vectors derived from the Sindbis virus (SIN), Semliki Forest virus (SFV), and Venezuelan Equine Encephalitis virus (VEE), will also find use as viral vectors for delivering the polynucleotides of the present invention. For a description of Sindbis-virus derived vectors useful for the practice of the instant methods, see, Dubensky et al. (1996) J. Virol. 70:508-519; and International Publication Nos. WO 95/07995, WO 96/17072; as well as, Dubensky, Jr., T. W., et al., U.S. Pat. No. 5,843,723, issued Dec. 1, 1998, and Dubensky, Jr., T. W., U.S. Pat. No. 5,789,245, issued Aug. 4, 1998, both herein incorporated by reference. Particularly preferred are chimeric alphavirus vectors comprised of sequences derived from Sindbis virus and Venezuelan equine encephalitis virus. See, e.g., Perri et al. (2003) J. Virol. 77: 10394-10403 and International Publication Nos. WO 02/099035, WO 02/080982, WO 01/81609, and WO 00/61772; herein incorporated by reference in their entireties.

A vaccinia-based infection/transfection system can be conveniently used to provide for inducible, transient expression of the nucleic acids of interest (e.g., engineered retron) in a host cell. In this system, cells are first infected in vitro with a vaccinia virus recombinant that encodes the bacteriophage T7 RNA polymerase. This polymerase displays exquisite specificity in that it only transcribes templates bearing T7 promoters. Following infection, cells are transfected with the nucleic acid of interest, driven by a T7 promoter. The polymerase expressed in the cytoplasm from the vaccinia virus recombinant transcribes the transfected DNA into RNA. The method provides for high level, transient, cytoplasmic production of large quantities of RNA. See, e.g., Elroy-Stein and Moss, Proc. Natl. Acad. Sci. USA (1990) 87:6743-6747; Fuerst et al., Proc. Natl. Acad. Sci. USA (1986) 83:8122-8126.

In other approaches to infection with vaccinia or avipox virus recombinants, or to the delivery of nucleic acids using other viral vectors, an amplification system can be used that will lead to high level expression following introduction into host cells. Specifically, a T7 RNA polymerase promoter preceding the coding region for T7 RNA polymerase can be engineered. Translation of RNA derived from this template will generate T7 RNA polymerase which in turn will transcribe more templates. Concomitantly, there will be a cDNA whose expression is under the control of the T7 promoter.

Thus, some of the T7 RNA polymerase generated from translation of the amplification template RNA will lead to transcription of the desired gene. Because some T7 RNA polymerase is required to initiate the amplification, T7 RNA polymerase can be introduced into cells along with the template(s) to prime the transcription reaction. The polymerase can be introduced as a protein or on a plasmid encoding the RNA polymerase. For a further discussion of T7 systems and their use for transforming cells, see, e.g., International Publication No. WO 94/26911; Studier and Moffatt, J. Mol. Biol. (1986) 189:113-130; Deng and Wolff, Gene (1994) 143:245-249; Gao et al., Biochem. Biophys. Res. Commun. (1994) 200:1201-1206; Gao and Huang, Nuc. Acids Res. (1993) 21:2867-2872; Chen et al., Nuc. Acids Res. (1994) 22:2114-2120; and U.S. Pat. No. 5,135,855.

Insect cell expression systems, such as baculovirus systems, can also be used and are known to those of skill in the art and described in, e.g., Baculovirus and Insect Cell Expression Protocols (Methods in Molecular Biology, D. W. Murhammer ed., Humana Press, 2nd edition, 2007) and L. King The Baculovirus Expression System: A laboratory guide (Springer, 1992). Materials and methods for baculovirus/insect cell expression systems are commercially available in kit form from, inter alia, Thermo Fisher Scientific (Waltham, MA) and Clontech (Mountain View, CA).

Plant expression systems can also be used for transforming plant cells. Generally, such systems use virus-based vectors to transfect plant cells with heterologous genes. For a description of such systems see, e.g., Porta et al., Mol. Biotech. (1996) 5:209-221; and Hackland et al., Arch. Virol. (1994) 139:1-22.

To obtain expression of the engineered retron or the ncRNA encoded thereby, the expression construct or the ncRNA must be delivered into a cell. This delivery may be accomplished in vitro, as in laboratory procedures for transforming cells lines, or in vivo or ex vivo, as in the treatment of certain disease states. One mechanism for delivery is via viral infection where the expression construct is encapsulated in an infectious viral particle.

Several non-viral methods for the transfer of expression constructs into cultured cells also are contemplated. These include the use of calcium phosphate precipitation, DEAE-dextran, electroporation, direct microinjection, DNA-loaded liposomes, lipofectamine-DNA complexes, cell sonication, gene bombardment using high velocity microprojectiles, and receptor-mediated transfection (see, e.g., Graham and Van Der Eb (1973) Virology 52:456-467; Chen and Okayama (1987) Mol. Cell Biol. 7:2745-2752; Rippe et al. (1990) Mol. Cell Biol. 10:689-695; Gopal (1985) Mol. Cell Biol. 5:1188-1190; Tur-Kaspa et al. (1986) Mol. Cell. Biol. 6:716-718; Potter et al. (1984) Proc. Natl. Acad. Sci. USA 81:7161-7165); Harland and Weintraub (1985) J. Cell Biol. 101: 1094-1099); Nicolau & Sene (1982) Biochim. Biophys. Acta 721:185-190; Fraley et al. (1979) Proc. Natl. Acad. Sci. USA 76:3348-3352; Fechheimer et al. (1987) Proc Natl. Acad. Sci. USA 84:8463-8467; Yang et al. (1990) Proc. Natl. Acad. Sci. USA 87:9568-9572; Wu and Wu (1987) J. Biol. Chem. 262:4429-4432; Wu and Wu (1988) Biochemistry 27:887-892; herein incorporated by reference). Some of these techniques may be successfully adapted for in vivo or ex vivo use.

Once the expression construct has been delivered into the cell the nucleic acid comprising the engineered retron sequence may be positioned and expressed at different sites. In some embodiments, the nucleic acid comprising the engineered retron sequence may be stably integrated into the genome of the cell. This integration may be in the cognate location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or episomes encode sequences sufficient to permit maintenance and replication independent of or in synchronization with the host cell cycle. How the expression construct is delivered to a cell and where in the cell the nucleic acid remains is dependent on the type of expression construct employed.

In some embodiments, the expression construct may simply consist of naked recombinant DNA or plasmids comprising the engineered retron. Transfer of the construct may be performed by any of the methods mentioned above which physically or chemically permeabilize the cell membrane. This is particularly applicable for transfer in vitro but it may be applied to in vivo use as well. Dubensky et al. (Proc. Natl. Acad. Sci. USA (1984) 81:7529-7533) successfully injected polyomavirus DNA in the form of calcium phosphate precipitates into liver and spleen of adult and newborn mice demonstrating active viral replication and acute infection. Benvenisty & Neshif (Proc. Natl. Acad. Sci. USA (1986) 83:9551-9555) also demonstrated that direct intraperitoneal injection of calcium phosphate-precipitated plasmids results in expression of the transfected genes. It is envisioned that DNA encoding an engineered retron of interest may also be transferred in a similar manner in vivo and express retron products.

In still another embodiment, a naked DNA expression construct may be transferred into cells by particle bombardment. This method depends on the ability to accelerate DNA-coated microprojectiles to a high velocity allowing them to pierce cell membranes and enter cells without killing them (Klein et al. (1987) Nature 327:70-73). Several devices for accelerating small particles have been developed. One such device relies on a high voltage discharge to generate an electrical current, which in turn provides the motive force (Yang et al. (1990) Proc. Natl. Acad. Sci. USA 87:9568-9572). The microprojectiles may consist of biologically inert substances, such as tungsten or gold beads.

In a further embodiment, the expression construct may be delivered using liposomes. Liposomes are vesicular structures characterized by a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh & Bachhawat (1991) Liver Diseases, Targeted Diagnosis and Therapy Using Specific Receptors and Ligands, Wu et al. (Eds.), Marcel Dekker, NY, 87-104). Also contemplated is the use of lipofectamine-DNA complexes.

In some embodiments, the liposome may be complexed with a hemagglutinating virus (HVJ). This has been shown to facilitate fusion with the cell membrane and promote cell entry of liposome-encapsulated DNA (Kaneda et al. (1989) Science 243:375-378). In other embodiments, the liposome may be complexed or employed in conjunction with nuclear non-histone chromosomal proteins (HMG-I) (Kato et al. (1991) J. Biol. Chem. 266(6):3361-3364).

In yet further embodiments, the liposome may be complexed or employed in conjunction with both HVJ and HMG-I. Where a bacterial promoter is employed in the DNA construct, it also will be desirable to include within the liposome an appropriate bacterial polymerase.

Other expression constructs which can be employed to deliver a nucleic acid into cells are receptor-mediated delivery vehicles. These take advantage of the selective uptake of macromolecules by receptor-mediated endocytosis in almost all eukaryotic cells. Because of the cell type-specific distribution of various receptors, the delivery can be highly specific (Wu and Wu (1993) Adv. Drug Delivery Rev. 12:159-167). Receptor-mediated gene targeting vehicles generally consist of two components: a cell receptor-specific ligand and a DNA-binding agent. Several ligands have been used for receptor-mediated gene transfer. The most extensively characterized ligands are asialoorosomucoid (ASOR) and transferrin (see, e.g., Wu and Wu (1987), supra; Wagner et al. (1990) Proc. Natl. Acad. Sci. USA 87(9):3410-3414). A synthetic neoglycoprotein, which recognizes the same receptor as ASOR, has been used as a gene delivery vehicle (Ferkol et al. (1993) FASEB J. 7:1081-1091; Perales et al. (1994) Proc. Natl. Acad. Sci. USA 91(9):4086-4090), and epidermal growth factor (EGF) has also been used to deliver genes to squamous carcinoma cells (Myers, EPO 0273085).

In other embodiments, the delivery vehicle may comprise a ligand and a liposome. For example, Nicolau et al. (Methods Enzymol. (1987) 149:157-176) employed lactosyl-ceramide, a galactose-terminal asialoganglioside, incorporated into liposomes and observed an increase in the uptake of the insulin gene by hepatocytes. Thus, it is feasible that a nucleic acid encoding a particular gene also may be specifically delivered into a cell by any number of receptor-ligand systems with or without liposomes. Also, antibodies to surface antigens on cells can similarly be used as targeting moieties.

In some embodiments, the promoters that may be used in the retron delivery systems described herein may be constitutive, inducible, or tissue-specific. In some embodiments, the promoters may be a constitutive promoters. Non-limiting exemplary constitutive promoters include cytomegalovirus immediate early promoter (CMV), simian virus (SV40) promoter, adenovirus major late (MLP) promoter, Rous sarcoma virus (RSV) promoter, mouse mammary tumor virus (MMTV) promoter, phosphoglycerate kinase (PGK) promoter, elongation factor-alpha (EF1a) promoter, ubiquitin promoters, actin promoters, tubulin promoters, immunoglobulin promoters, a functional fragment thereof, or a combination of any of the foregoing. In some embodiments, the promoter may be a CMV promoter. In some embodiments, the promoter may be a truncated CMV promoter. In other embodiments, the promoter may be an EF1a promoter. In some embodiments, the promoter may be an inducible promoter. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech). In some embodiments, the promoter may be a tissue-specific promoter. In some embodiments, the tissue-specific promoter is exclusively or predominantly expressed in liver tissue. Non-limiting exemplary tissue-specific promoters include B29 promoter, CD14 promoter, CD43 promoter, CD45 promoter, CD68 promoter, desmin promoter, elastase-1 promoter, endoglin promoter, fibronectin promoter, Flt-1 promoter, GFAP promoter, GPIIb promoter, ICAM-2 promoter, INF-b promoter, Mb promoter, Nphs1 promoter, OG-2 promoter, SP-B promoter, SYN1 promoter, and WASP promoter.

J. Delivery Systems and Methods of Delivery

The engineered retrons can be delivered by any known delivery system such as those described above. Non-limiting examples of delivery vehicles include lipid particles (e.g. Lipid nanoparticles (LNPs)), non-lipid nanoparticles, exosomes, liposomes, micelles, viral particles, Stable nucleic-acid-lipid particles (SNALPs), lipoplexes/polyplexes, DNA nanoclews, Gold nanoparticles, iTOP, Streptolysin O (SLO), multifunctional envelope-type nanodevice (MEND), lipid-coated mesoporous silica particles, inorganic nanoparticles, and polymeric delivery technology (e.g., polymer-based particles).

All-RNA Delivery System and RNA Ratios

In various embodiments, the retron editing systems disclosed herein may be delivered in an "all-RNA" format. As used herein, the term "all-RNA" format refers to the fact that each of the components of a retron editing system (e.g., the retron RT, the programmable nuclease, the sgRNA, and the ncRNA) are delivered and/or administered as RNA. In some embodiments, the RNA components may be delivered to cells and/or tissues by direct means, such as electroporation or transfection. In other embodiments, the RNA components may be delivered to cells and/or tissues by way of a delivery vehicle, such as an LNP or liposome.

In various embodiments, the retron editing systems described herein may comprise a coding RNA (e.g., linear or circular mRNA) that encodes a retron reverse transcriptase (e.g., any RT from Table X or Table A), a coding RNA (e.g., linear or circular mRNA) that encodes a programmable nuclease, a retron ncRNA (e.g., a ncRNA from Table B), and a guide RNA.

In some embodiments, RT and nuclease components may be encoded on the same coding RNA molecule. The proteins may also be expressed from separate coding RNA molecules. In still other embodiments, the RT and the nuclease components can be fused together as a singular fusion polypeptide having an RT domain and a nuclease domain optionally joined by a linker.

In addition, in some embodiments, the ncRNA and the guide RNA may be fused together as a single RNA molecule. For example, the guide RNA may be located at the 5' end of the ncRNA. In other embodiments, the guide RNA may be located at the 3' end of the ncRNA. In some embodiments, the ncRNA may comprise a guide RNA at both the 3' and the 5' ends of the ncRNA.

In still other embodiments, the ncRNA and the guide RNA may be separate molecules, i.e., delivered separately.

In still other embodiments, the retron editing system may include both a ncRNA-guide RNA fusion and an additional guide RNA provided as a separate molecule.

In various embodiments, the different RNA components of the all-RNA retron editing system can be combined and administered (e.g., directly or within a delivery vehicle) in different ratios. In some embodiments, the ratios of such RNA components or species can be expressed as molar ratios.

For example, the molar ratio of RT coding RNA to nuclease coding RNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In another example, the molar ratio of nuclease coding RNA to RT coding RNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of ncRNA or ncRNA-guide RNA fusion to separate guide RNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of separate guide RNA to ncRNA or ncRNA-guide RNA fusion can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of ncRNA to separate guide RNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of separate guide RNA to ncRNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of a coding RNA (e.g., encoding RT and/or nuclease) to ncRNA or ncRNA-guide RNA fusion, as the case may be, can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of a coding RNA encoding a retron RT to ncRNA or ncRNA-guide RNA fusion, as the case may be, can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of a coding RNA encoding a programmable nuclease to ncRNA or ncRNA-guide RNA fusion, as the case may be, can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of a coding RNA encoding a retron RT or a nuclease to a separate guide RNA can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In still another example, the molar ratio of a separate guide RNA to a coding RNA encoding a retron RT or a nuclease can be about 1:1, about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40.

In certain embodiments, the amount of ncRNA-sgRNA relative to RT mRNA is augmented. In certain embodiments the RT mRNA:ncRNA-sgRNA ratio is about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40. In certain embodiments, an RT-Cas9 (or Cas9-RT) fusion is encoded by an mRNA. In certain embodiments, the RT-Cas9 mRNA:ncRNA-sgRNA ratio is about 1:1.5, about 1:2, about 1:2.5, about 1:3, about 1:4, about 1:5, about 1:6, about 1:7, about 1:8, about 1:9, about 1:10, about 1:12, about 1:15, about 1:20. Useful ranges include from 1:1 to 1:2, from 1:1.5 to 1:4, from 1:2 to 1:4, from 1:2 to 1:8, from 1:2 to 1:10, from 1:3 to 1:9, from 1:3 to 1:12, from 1:3 to 1:15, from 1:4 to 1:8, from 1:4 to 1:12, from 1:4 to 1:20, from 1:5 to 1:10, from 1:5 to 1:15, from 1:5 to 1:20, from 1:10 to 1:20, or from 1:10 to 1:40. In certain embodiments, multiple genetic loci are targeted hence the ncRNA-sgRNA includes a mixture of ncRNA-sgRNA species and the same ratios and ranges are applicable.

Format of ncRNA and Guide RNA

In certain embodiments, the ncRNA and the guide RNA can be delivered as a single molecule, i.e., with the guide RNA fused to the 5' and/or 3' end of the ncRNA. The ncRNA may have guide RNAs located at both ends in some embodiments.

In other embodiments, the guide RNA and ncRNA may be provided and/or delivered as separate components. As shown in Example 4, separation of the guide RNA from the ncRNA can result in increased editing efficiency.

In still other embodiments, a ncRNA-gRNA fusion may be co-delivered with a separate guide RNA.

Modified ncRNAs

In still other embodiments, the ncRNAs disclosed herein may be modified by introducing additional RNA motifs into the ncRNAs, e.g., at the 5' and 3' termini of the ncRNAs, or even at positions therein between (e.g., in the msr or msd regions) to improve transcriptional production and/or stability and/or function (e.g., RT-DNA production). Such structures may include, but are not limited to RNA hairpins, RNA step-loops, RNA quadruplexes, cap structures, and poly(A) tails, or ribozyme functions and the like. Also, ncRNAs could also be modified to include one or more nuclear localization sequences.

Additional RNA motifs could also improve RT processivity of the ncRNA or enhance ncRNA activity by enhancing RT binding. Addition of dimerization motifs—such as kissing loops or a GNRA tetraloop/tetraloop receptor pair—at the 5' and 3' termini of the ncRNA could also result in effective circularization of the ncRNA, improving stability. Additionally, it is envisioned that addition of these motifs could enable the physical separation of ncRNA components, e.g., separation of the msr and msd regions. Short 5' extensions or 3' extensions to the ncRNA that form a small toehold hairpin at either or both ends of the ncRNA could also compete favorably against the annealing of intracomplementary regions along the length of the ncRNA. Finally, kissing loops could also be used to recruit other RNAs or proteins to the genomic site and enable swapping of RT activity from one RNA to the other.

ncRNAs could be further improved via directed evolution, in an analogous fashion to how protein function can be improved. Directed evolution could enhance ncRNA recognition by RT and/or reduce off-site targeting and/or indels and/or improve precise editing efficiency.

The present disclosure contemplates any such ways to further improve the stability and/or functionality of the ncRNAs disclosed here.

In some embodiments, the RNAs (including the guide RNAs and the ncRNAs) used in the compositions of the disclosure have undergone a chemical or biological modification to render them more stable. Exemplary modifications to an RNA include the depletion of a base (e.g., by deletion or by the substitution of one nucleotide for another) or modification of a base, for example, the chemical modification of a base. The phrase "chemical modifications" as used herein, includes modifications which introduce chemistries which differ from those seen in naturally occurring RNA, for example, covalent modifications such as the introduction of modified nucleotides, (e.g., nucleotide analogs, or the inclusion of pendant groups which are not naturally found in such mRNA molecules).

Other suitable polynucleotide modifications that may be incorporated into the RNAs used in the compositions of the disclosure include, but are not limited to, 4'-thio-modified bases: 4'-thio-adenosine, 4'-thio-guanosine, 4'-thio-cytidine, 4'-thio-uridine, 4'-thio-5-methyl-cytidine, 4'-thio-pseudouridine, and 4'-thio-2-thiouridine, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl)adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, and combinations thereof. The term modification also includes, for example, the incorporation of non-nucleotide linkages or modified nucleotides into the mRNA sequences of the present invention (e.g., modifications to one or both of the 3' and 5' ends of an mRNA molecule encoding a functional protein or enzyme). Such modifications include the addition of bases to an mRNA sequence (e.g., the inclusion of a poly A tail or a longer poly A tail), the alteration of the 3' UTR or the 5' UTR, complexing the mRNA with an agent (e.g., a protein or a complementary nucleic acid molecule), and inclusion of elements which change the structure of an RNA molecule (e.g., which form secondary structures).

In some embodiments, RNAs (e.g., ncRNAs) include a 5' cap structure. A 5' cap is typically added as follows: first, an RNA terminal phosphatase removes one of the terminal phosphate groups from the 5' nucleotide, leaving two terminal phosphates; guanosine triphosphate (GTP) is then added to the terminal phosphates via a guanylyl transferase, producing a 5'5'5 triphosphate linkage; and the 7-nitrogen of guanine is then methylated by a methyltransferase. Examples of cap structures include, but are not limited to, m7G(5')ppp (5'(A,G(5')ppp(5')A and G(5')ppp(5')G. Naturally occurring cap structures comprise a 7-methyl guanosine that is linked via a triphosphate bridge to the 5'-end of the first transcribed nucleotide, resulting in a dinucleotide cap of m7G(5')ppp(5')N, where N is any nucleoside. In vivo, the cap is added enzymatically. The cap is added in the nucleus and is catalyzed by the enzyme guanylyl transferase. The addition of the cap to the 5' terminal end of RNA occurs immediately after initiation of transcription. The terminal nucleoside is typically a guanosine, and is in the reverse orientation to all the other nucleotides, i.e., G(5')ppp(5') GpNpNp.

Additional cap analogs include, but are not limited to, a chemical structures selected from the group consisting of m7GpppG, m7GpppA, m7GpppC; unmethylated cap analogs (e.g., GpppG); dimethylated cap analog (e.g., m2,7GpppG), trimethylated cap analog (e.g., m2,2, 7GpppG), dimethylated symmetrical cap analogs (e.g., m7Gpppm7G), or anti reverse cap analogs (e.g., ARCA; m7,2'OmeGpppG, m72'dGpppG, m7,3'OmeGpppG, m7,3'dGpppG and their tetraphosphate derivatives) (see, e.g., Jemielity, J. et al., "Novel 'anti-reverse' cap analogs with superior translational properties", RNA, 9: 1108-1122 (2003)).

Typically, the presence of a "tail" serves to protect the RNA (e.g., ncRNA) from exonuclease degradation. A poly A or poly U tail is thought to stabilize natural messengers and synthetic sense RNA. Therefore, in certain embodiments a long poly A or poly U tail can be added to an RNA molecule thus rendering the RNA more stable. Poly A or poly U tails can be added using a variety of art-recognized techniques. For example, long poly A tails can be added to synthetic or in vitro transcribed RNA using poly A polymerase (Yokoe, et al. Nature Biotechnology. 1996; 14: 1252-1256). A transcription vector can also encode long poly A tails. In addition, poly A tails can be added by transcription directly from PCR products. Poly A may also be ligated to the 3' end of a sense RNA with RNA ligase (see, e.g., Molecular Cloning A Laboratory Manual, 2nd Ed., ed. by Sambrook, Fritsch and Maniatis (Cold Spring Harbor Laboratory Press: 1991 edition)).

Typically, the length of a poly A or poly U tail can be at least about 10, 50, 100, 200, 300, 400 at least 500 nucleotides. In some embodiments, a poly-A tail on the 3' terminus of mRNA typically includes about 10 to 300 adenosine nucleotides (e.g., about 10 to 200 adenosine nucleotides, about 10 to 150 adenosine nucleotides, about 10 to 100 adenosine nucleotides, about 20 to 70 adenosine nucleotides, or about 20 to 60 adenosine nucleotides). In some embodiments, mRNAs include a 3' poly(C) tail structure. A suitable poly-C tail on the 3' terminus of mRNA typically include about 10 to 200 cytosine nucleotides (e.g., about 10 to 150 cytosine nucleotides, about 10 to 100 cytosine nucleotides, about 20 to 70 cytosine nucleotides, about 20 to 60 cytosine nucleotides, or about 10 to 40 cytosine nucleotides). The poly-C tail may be added to the poly-A or poly U tail or may substitute the poly-A or poly U tail.

RNAs according to the present disclosure (e.g., ncRNAs) may be synthesized according to any of a variety of known methods. For example, RNAs according to the present invention may be synthesized via in vitro transcription (IVT). Briefly, IVT is typically performed with a linear or circular DNA template containing a promoter, a pool of ribonucleotide triphosphates, a buffer system that may include DTT and magnesium ions, and an appropriate RNA polymerase (e.g., T3, T7 or SP6 RNA polymerase), DNAse I, pyrophosphatase, and/or RNAse inhibitor. The exact conditions will vary according to the specific application. An improved method of IVT of a ncRNA is disclosed in Example 5 herein.

In a particular embodiment (as exemplified in Example 6 herein), the ncRNAs can comprise an MS2 modification, as specific RNA hairpin structure recognized in nature by a certain MS2-binding protein. This domain can help to stabilize the ncRNA and improve the editing efficiency. The disclosure contemplates other similar modifications. A review of other such MS2-like domains are described in the art, for example, in Johansson et al., "RNA recognition by the MS2 phage coat protein," Sem Virol., 1997, Vol. 8(3): 176-185; Delebecque et al., "Organization of intracellular reactions with rationally designed RNA assemblies," Science, 2011, Vol. 333: 470-474; Mali et al., "Cas9 transcriptional activators for target specificity screening and paired nickases for cooperative genome engineering," Nat. Biotechnol., 2013, Vol. 31: 833-838; and Zalatan et al., "Engineering complex synthetic transcriptional programs with CRISPR RNA scaffolds," Cell, 2015, Vol. 160: 339-350, each of which are incorporated herein by reference in their entireties. Other systems include the PP7 hairpin, which specifically recruits the PCP protein, and the "com" hairpin, which specifically recruits the Com protein. See Zalatan et al. The nucleotide sequence of the MS2 hairpin (or equivalently referred to as the "MS2 aptamer") is:

(SEQ ID NO: 19158)
GCCAACATGAGGATCACCCATGTCTGCAGGGCC.

Lipid Nanoparticles

In some embodiments, the lipid delivery system includes lipid nanoparticles (LNP). In some embodiments the LNP are small solid or semi-solid particles possessing an exterior lipid layer with a hydrophilic exterior surface that is exposed to the non-LNP environment, an interior space which may aqueous (vesicle like) or non-aqueous (micelle like), and at least one hydrophobic inter-membrane space. LNP membranes may be lamellar or non-lamellar and may be comprised of 1, 2, 3, 4, 5 or more layers. In some embodiments, LNPs may comprise a nucleic acid (e.g. engineered retron) into their interior space, into the inter membrane space, onto their exterior surface, or any combination thereof.

In some embodiments, an LNP of the present disclosure comprises an ionizable lipid, a structural lipid, a PEGylated lipid (aka PEG lipid), and a phospholipid. In alternative embodiments, an LNP comprises an ionizable lipid, a structural lipid, a PEGylated lipid (aka PEG lipid), and a zwitterionic amino acid lipid. In some embodiments, an LNP further comprises a $5^{th}$ lipid, besides any of the aforementioned lipid components. In some embodiments, the LNP encapsulates one or more elements of the active agent of the present disclosure. In some embodiments, an LNP further comprises a targeting moiety covalently or non-covalently bound to the outer surface of the LNP. In some embodiments, the targeting moiety is a targeting moiety that binds to, or otherwise facilitates uptake by, cells of a particular organ system.

In some embodiments, an LNP has a diameter of at least about 20 nm, 30 nm, 40 nm, 50 nm, 60 nm, 70 nm, 80 nm, or 90 nm. In some embodiments, an LNP has a diameter of less than about 100 nm, 110 nm, 120 nm, 130 nm, 140 nm, 150 nm, or 160 nm. In some embodiments, an LNP has a diameter of less than about 100 nm. In some embodiments, an LNP has a diameter of less than about 90 nm. In some embodiments, an LNP has a diameter of less than about 80 nm. In some embodiments, an LNP has a diameter of about 60-100 nm. In some embodiments, an LNP has a diameter of about 75-80 nm.

In some embodiments, the lipid nanoparticle compositions of the present disclosure are described according to the respective molar ratios of the component lipids in the formulation. As a non-limiting example, the mol-% of the ionizable lipid may be from about 10 mol-% to about 80 mol-%. As a non-limiting example, the mol-% of the ionizable lipid may be from about 20 mol-% to about 70 mol-%. As a non-limiting example, the mol-% of the ionizable lipid may be from about 30 mol-% to about 60 mol-%. As a non-limiting example, the mol-% of the ionizable lipid may be from about 35 mol-% to about 55 mol-%. As a non-limiting example, the mol-% of the ionizable lipid may be from about 40 mol-% to about 50 mol-%.

In some embodiments, the mol-% of the phospholipid may be from about 1 mol-% to about 50 mol-%. In some embodiments, the mol-% of the phospholipid may be from about 2 mol-% to about 45 mol-%. In some embodiments, the mol-% of the phospholipid may be from about 3 mol-% to about 40 mol-%. In some embodiments, the mol-% of the phospholipid may be from about 4 mol-% to about 35 mol-%. In some embodiments, the mol-% of the phospholipid may be from about 5 mol-% to about 30 mol-%. In some embodiments, the mol-% of the phospholipid may be from about 10 mol-% to about 20 mol-%. In some embodiments, the mol-% of the phospholipid may be from about 5 mol-% to about 20 mol-%.

In some embodiments, the mol-% of the structural lipid may be from about 10 mol-% to about 80 mol-%. In some embodiments, the mol-% of the structural lipid may be from about 20 mol-% to about 70 mol-%. In some embodiments, the mol-% of the structural lipid may be from about 30 mol-% to about 60 mol-%. In some embodiments, the mol-% of the structural lipid may be from about 35 mol-% to about 55 mol-%. In some embodiments, the mol-% of the structural lipid may be from about 40 mol-% to about 50 mol-%.

In some embodiments, the mol-% of the PEG lipid may be from about 0.1 mol-% to about 10 mol-%. In some embodiments, the mol-% of the PEG lipid may be from about 0.2 mol-% to about 5 mol-%. In some embodiments, the mol-% of the PEG lipid may be from about 0.5 mol-% to about 3 mol-%. In some embodiments, the mol-% of the PEG lipid may be from about 1 mol-% to about 2 mol-%. In some embodiments, the mol-% of the PEG lipid may be about 1.5 mol-%.

i. Ionizable Lipids

In some embodiments, an LNP disclosed herein comprises an ionizable lipid. In some embodiments, an LNP comprises two or more ionizable lipids.

In some embodiments, an ionizable lipid has a dimethylamine or an ethanolamine head. In some embodiments, an ionizable lipid has an alkyl tail. In some embodiments, a tail has one or more ester linkages, which may enhance biodegradability. In some embodiments, a tail is branched, such as with 3 or more branches. In some embodiments, a branched tail may enhance endosomal escape. In some embodiments, an ionizable lipid has a pKa between 6 and 7, which may be measured, for example, by TNS assay.

In some embodiments, an ionizable lipid has a structure of any of the formulas disclosed below, and all formulas disclosed in a reference publication and patent application publication cited below. In some embodiments, an ionizable lipid comprises a head group of any structure or formula disclosed below. In some embodiments, an ionizable lipid comprises a bridging moiety of any structure or formula disclosed below. In some embodiments, an ionizable lipid comprises any tail group, or combination of tail groups disclosed below. The present disclosure contemplates all permutations and combinations of head group, bridging moiety and tail group, or tail groups, disclosed herein.

In some embodiments, a head, tail, or structure of an ionizable lipid is described in US patent application US20170210697A1.

In some embodiments, a compound has a structure according to formula 1:

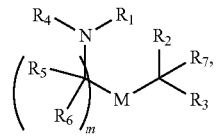

wherein:

$R^1$ is selected from the group consisting of $C_{5-30}$ alkyl, $C_{5-20}$ alkenyl, —R*YR", YR", and —R"M'R'; $R^2$ and $R^3$ are independently selected from the group consisting of H, C1-14 alkyl, C2-14 alkenyl, —R*YR", —YR", and —R*OR", or $R^2$ and $R^3$, together with the atom to which they are attached, form a heterocycle or carbocycle;

$R^4$ is selected from the group consisting of a $C_{3-6}$ carbocycle, —(CH$_2$)nQ, —(CH$_2$)nCHQR, —CHQR, CO(R)$_2$, and unsubstituted $C_{1-6}$ alkyl, where Q is selected from a carbocycle, heterocycle, —OR, —O(CH$_2$)nN(R)$_2$, —C(O)OR, —OC(O)R, —CX$_3$, —CX$_2$H, —CXH$_2$, —CN, —N(R)$_2$, —C(O)N(R)$_2$, —N(R)C(O)R, —N(R)S(O)2R, —N(R)C(O)N(R)2, —N(R)C(S)N(R)$_2$, —N(R)R$^8$, —O(CH$_2$)$_n$OR, —N(R)C(=NR$^9$)N(R)$_2$—N(R)C(=CHR$^9$)N(R)$_2$, —OC(O)N(R)$_2$, —N(R)C(O)OR, —N(OR)C(O)R, —N(OR)S(O)$_2$R, —N(OR)C(O)OR, —N(OR)C(O)N(R)$_2$, —N(OR)C(S)N(R)$_2$—N(OR)C(=NR)N(R)—N(OR)C(=CHR$^9$)N(R)$_2$, —C(=NR$^9$)N(R)$_2$, —C(=NR$^9$)R, —C(O)N(R)OR, and —C(R)N(R)$_2$, C(O)OR, and each n is independently selected from 1, 2, 3, 4, and 5 or a head group disclosed in Table 1;

each $R^5$ is independently selected from the group consisting of C1-3 alkyl, C2-3 alkenyl, and H;

each $R^6$ is independently selected from the group consisting of C1-3 alkyl, C2-3 alkenyl, and H;

M and M' are independently selected from C(O)O—, —OC(O)—, —C(O)N(R')—, —N(R')C(O)—, —C(O)—, —C(S)—, —C(S)S—, —SC(S)—, —CH(OH)—, —P(O)(OR')O—, —S(O)—, —S—S—, an aryl group, and a heteroaryl group;

$R^7$ is selected from the group consisting of C1-3alkyl, C2-3 alkenyl, and H;

$R^8$ is selected from the group consisting of C3-6 carbocycle and heterocycle;

$R^9$ is selected from the group consisting of H. CN, NO$_2$, C1-6 alkyl, —OR, —S(O)2R, —S(O)$_2$N(R)$_2$, C2-6 alkenyl, C3-6 carbocycle and heterocycle;

each R is independently selected from the group consisting of C1-3 alkyl, C2-3 alkenyl, and H;

each R' is independently selected from the group consisting of C1-18 alkyl, C2-18 alkenyl, —R*YR", —YR", and H;

each R" is independently selected from the group consisting of C3-14 alkyl, C3-14 alkenyl, and H;

each R* is independently selected from the group consisting of C1-12 alkyl and C2-12 alkenyl:

each Y is independently a C3-6 carbocycle;

each X is independently selected from the group consisting of F, Cl, Br, and I;

each Q is —OH, —NHC(S)N(R)$_2$, —NHC(O)N(R)$_2$, —N(R)C(O)R, —N(R)S(O)$_2$R, —N(R)R$^8$, —NHC(=NR$^9$)N(R)$_2$, —NHC(=CHR$^9$)N(R)$_2$, —OC(O)N(R)$_2$, —N(R)C(O)OR, heteroaryl or heterocycloalkyl; and m is selected from 5, 6, 7, 8, 9, 10, 11, 12, and 13:

and wherein when R$^4$ is —(CH$_2$)$_n$Q, —(CH$_2$)$_n$CHQR, —CHQR, or —CQ(R)$_2$, then (i) Q is not —N(R), when n is 1, 2, 3, 4 or 5, or (ii) Q is not 5, 6, or 7-membered heterocycloalkyl when n is 1 or 2.

In some embodiments, R$^4$ is in Table 1.

In some embodiments, R$^4$ in formula 1 is selected from head groups 1-47.

TABLE 1

| Ionizable lipid head groups | |
|---|---|
| Head number | Structure |
| 1 | *propanamide structure* |
| 2 | *oxazolidinone-butyl structure* |
| 3 | *N-hydroxy acetamide structure* |
| 4 | *nitroguanidine structure* |
| 5 | *isobutyramide structure* |
| 6 | *imidazolidinone structure* |
| 7 | *N-hydroxy methyl carbamate structure* |
| 8 | *methoxy guanidine structure* |

TABLE 1-continued

| Ionizable lipid head groups | |
|---|---|
| Head number | Structure |
| 9 | *pyrrolidinone structure* |
| 10 | *hydantoin structure* |
| 11 | *N-hydroxy methanesulfonamide structure* |
| 12 | *succinimide structure* |
| 13 | *N-methyl acetamide structure* |
| 04 | *N-methyl hydantoin structure* |
| 15 | *methyl carbamate structure* |
| 16 | *methanesulfonyl guanidine structure* |
| 17 | *butoxy acetamide structure* |
| 18 | *morpholine-2,5-dione structure* |

TABLE 1-continued
Ionizable lipid head groups
| Head number | Structure |
|---|---|
| 19 | 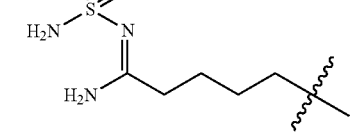 |
| 20 | 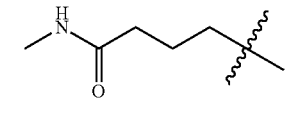 |
| 21 | 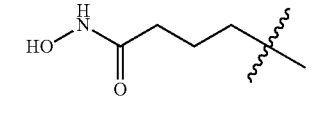 |
| 22 | 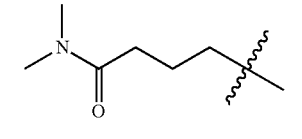 |
| 23 | 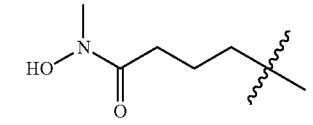 |
| 24 | 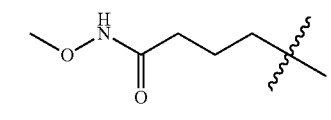 |
| 25 | 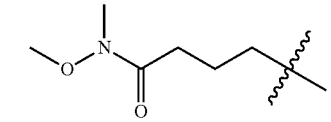 |
| 26 | 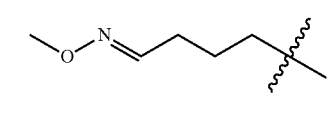 |
| 27 | 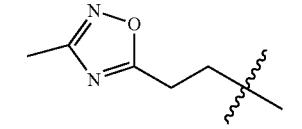 |
| 28 | 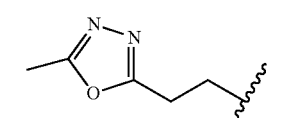 |
| 29 | 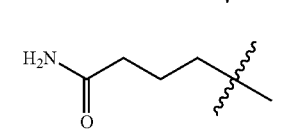 |
| 30 | 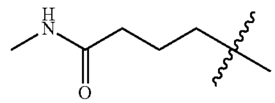 [SMILES: *CCCC(=O)NC] |
| 31 | 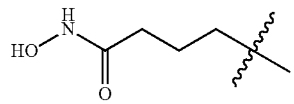 [SMILES: *CCCC(=O)NO] |
| 32 | 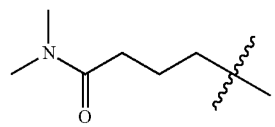 [SMILES: *CCCC(=O)N(C)C] |
| 33 | 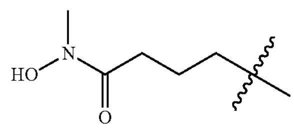 [SMILES: *CCCC(=O)N(C)O] |
| 34 | 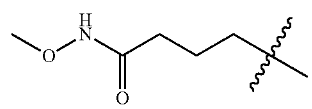 [SMILES: *CCCC(=O)NOC] |
| 35 | 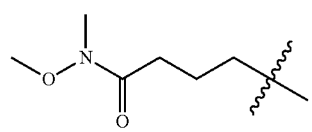 [SMILES: *CCCC(=O)N(C)OC] |
| 36 | 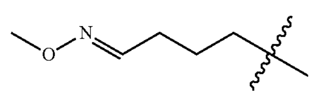 [SMILES: *CCC/C=N/OC] |
| 37 | 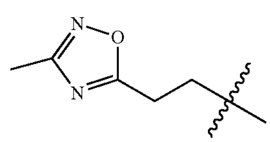 [SMILES: *CCc1nc(C)no1] |
| 38 | 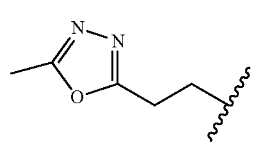 [SMILES: *CCc1nnc(C)o1] |
| 39 | 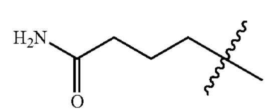 [SMILES: *CCCC(N)=O] |

TABLE 1-continued

Ionizable lipid head groups

| Head number | Structure |
|---|---|
| 40 | [structure] |
| 41 | [structure] |
| 42 | [structure] |
| 43 | [structure] |
| 44 | [structure] |
| 45 | [structure] |
| 46 | [structure] |
| 47 | [structure] |
| 48 | [structure] |
| 49 | [structure] |
| 50 | [structure] |
| 51 | [structure] |
| 52 | [structure] |
| 53 | [structure] |
| 54 | [structure] |
| 55 | [structure] |
| 56 | [structure] |
| 57 | [structure] |
| 58 | [structure] |
| 59 | [structure] |
| 60 | [structure] |
| 61 | [structure] |
| 62 | [structure] |
| 63 | [structure] |

TABLE 1-continued

Ionizable lipid head groups

| Head number | Structure |
|---|---|
| 64 | 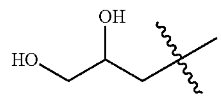 |
| 65 | 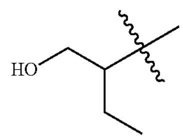 [SMILES: *C(CC)CO] |
| 66 | 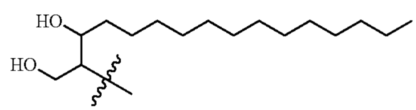 [SMILES: *C(CO)C(O)CCCCCCCCCCCCC] |
| 67 | 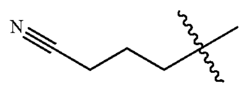 [SMILES: *CCCC#N] |
| 68 | 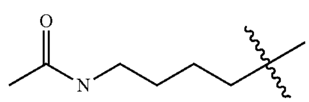 [SMILES: *CCCCNC(C)=O] |

In some embodiments, a subset of the compounds of formula 1 are also described by formula 1b:

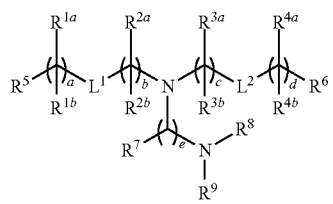

wherein l is selected from 1, 2, 3, 4, and 5; $M^1$ is a bond or M'; $R^4$ is unsubstituted C1-3 alkyl, or —(CH$_2$)nQ, in which n is 2, 3, or 4, and Q is —OH, —NHC(S)N(R)$_2$, —NHC(O)N(R)$_2$, —N(R)C(O)R, —N(R)S(O)$_2$R, —N(R)R$^8$, —NHC(=NR$^9$)N(R)$_2$, —NHC(=CHR$^9$)N(R)$_2$, —OC(O)N(R)$_2$, —N(R)C(O)OR, heteroaryl or heterocycloalkyl; M and M' are independently selected from —C(O)O—, —OC(O)—, —C(O)N(R')—, —P(O)(OR')O—, —S—S—, an aryl group, and a heteroaryl group; and $R^2$ and R3 are independently selected from the group consisting of H, C1-14 alkyl, and C2-14 alkenyl. In some embodiments, a head, tail, or structure of an ionizable lipid is described in international patent application PCT/US2018/058555.

In some embodiments, an ionizable lipid has a structure according to formula 2:

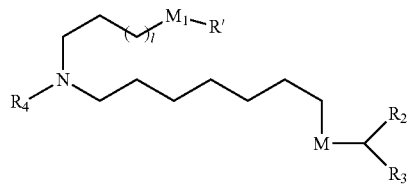

wherein:
one of $L^1$ or $L^2$ is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC(=O)O—, and the other of $L^1$ or $L^2$ is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC(=O)O— or a direct bond;

Ra is H or C1-C12 alkyl;

$R^{1a}$ and $R^{1b}$ are, at each occurrence, independently either (a) H or C1-C12 alkyl, or (b) $R^{1a}$ is H or C1-C12 alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either (a) H or C1-C12 alkyl, or (b) $R^{2a}$ is H or C1-C12 alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either (a) H or C1-C12 alkyl, or (b) $R^{3a}$ is H or C1-C12 alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either (a) H or C1-C12 alkyl, or (b) $R^{4a}$ is H or C1-C12 alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently methyl or cycloalkyl;

$R^7$ is, at each occurrence, independently H or C1-C12 alkyl;

$R^8$ and $R^9$ are each independently unsubstituted C1-C12 alkyl; or $R^8$ and $R^9$, together with the nitrogen atom to which they are attached, form a 5, 6 or 7-membered heterocyclic ring comprising one nitrogen atom;

a and d are each independently an integer from 0 to 24;

b and c are each independently an integer from 1 to 24;

e is 1 or 2; and x is 0, 1 or 2.

In some embodiments, an ionizable lipid has a structure according to formula 3:

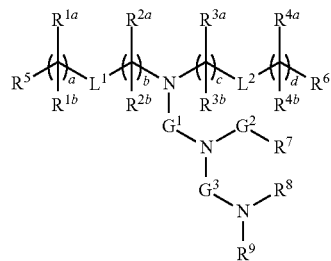

wherein:
one of $L^1$ or $L^2$ is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC (=O)O—, and the other of L¹ or L² is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC(=O)O— or a direct bond;

G1 is C1-C2 alkylene, —(C=O)—, —O(C=O)—, —SC(=O)—, —NRaC(=O)— or a direct bond:

G2 is —C(=O)—, —(C=O)O—, —C(=O)S—, —C(=O)NRa— or a direct bond;

G3 is C1-C6 alkylene;

Ra is H or C1-C12 alkyl;

$R^{1a}$ and $R^{1b}$ are, at each occurrence, independently either: (a) H or C1-C12 alkyl; or (b) $R^{1a}$ is H or C1-C12 alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either: (a) H or C1-C12 alkyl; or (b) $R^{2a}$ is H or C1-C12 alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either (a): H or C1-C12 alkyl; or (b) $R^{3a}$ is H or C1-C12 alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either: (a) H or C1-C12 alkyl; or (b) $R^{4a}$ is H or C1-C12 alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently H or methyl;

$R^7$ is C4-C20 alkyl;

$R^8$ and $R^9$ are each independently C1-C12 alkyl; or $R^8$ and $R^9$, together with the nitrogen atom to which they are attached, form a 5, 6 or 7-membered heterocyclic ring;

a, b, c and d are each independently an integer from 1 to 24; and x is 0, 1 or 2.

In some embodiments, an ionizable lipid has a structure according to formula 4:

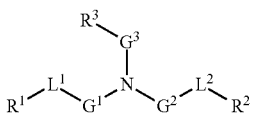

wherein:
one of L¹ or L² is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC(=O)O—, and the other of L¹ or L² is —O(C=O)—, —(C=O)O—, —C(=O)—, —O—, —S(O)x-, —S—S—, —C(=O)S—, SC(=O)—, —NRaC(=O)—, —C(=O)NRa—, NRaC(=O)NRa—, —OC(=O)NRa— or —NRaC(=O)O— or a direct bond;

G¹ and G² are each independently unsubstituted C1-C12 alkylene or C1-C12 alkenylene;

G³ is C1-C24 alkylene, C1-C24 alkenylene, C3-C8 cycloalkylene, C3-C8 cycloalkenylene;

Ra is H or C1-C12 alkyl;

R¹ and R² are each independently C6-C24 alkyl or C6-C24 alkenyl;

R³ is H, OR5, CN, —C(=O)OR4, —OC(=O)R4 or —NR5C(=O)R4;

$R^4$ is C1-C12 alkyl;

$R^5$ is H or C1-C6 alkyl; and x is 0, 1 or 2.

In some embodiments, an ionizable lipid has a structure according to formula 5:

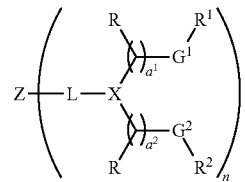

wherein:
one of G¹ or G² is, at each occurrence, —O(C=O)—, —(C=O)O—, —C(=O)—, —O—, —S(O)y, —S—S—, —C(=O)S—, SC(=O)—, —N(Ra)C(=O)—, —C(=O)N(Ra)—, —N(Ra)C(=O)N(Ra)—, —OC(=O)N(Ra)— or —N(Ra)C(=O)O—, and the other of G1 or G2 is, at each occurrence, —O(C=O)—, —(C=O)O—, —C(=O)—, —O—, —S(O)y, —S—S—, —C(=O)S—, —SC(=O)—, —N(Ra)C(=O)—, —C(=O)N(Ra)—, —N(Ra)C(=O)N(Ra)—, —OC(=O)N(Ra)— or —N(Ra)C(=O)O— or a direct bond;

L is, at each occurrence, ~O(C=O)—, wherein ~ represents a covalent bond to X;

X is CRa;

Z is alkyl, cycloalkyl or a monovalent moiety comprising at least one polar functional group when n is 1; or Z is alkylene, cycloalkylene or a polyvalent moiety comprising at least one polar functional group when n is greater than 1;

Ra is, at each occurrence, independently H, C1-C12 alkyl, C1-C12 hydroxylalkyl, C1-C12 aminoalkyl, C1-C12 alkylaminylalkyl, C1-C12 alkoxyalkyl, C1-C12 alkoxycarbonyl, C1-C12 alkylcarbonyloxy, C1-C12 alkylcarbonyloxyalkyl or C1-C12 alkylcarbonyl;

R is, at each occurrence, independently either: (a) H or C1-C12 alkyl; or (b) R together with the carbon atom to which it is bound is taken together with an adjacent R and the carbon atom to which it is bound to form a carbon-carbon double bond;

R¹ and R² have, at each occurrence, the following structure, respectively:

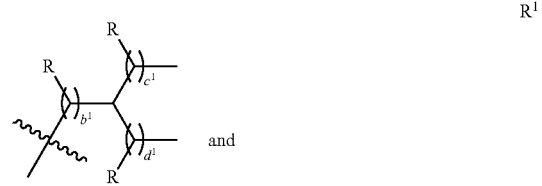

-continued

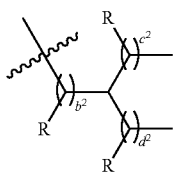

a¹ and a² are, at each occurrence, independently an integer from 3 to 12;

b¹ and b² are, at each occurrence, independently 0 or 1;

c¹ and c² are, at each occurrence, independently an integer from 5 to 10;

d¹ and d² are, at each occurrence, independently an integer from 5 to 10;

y is, at each occurrence, independently an integer from 0 to 2; and n is an integer from 1 to 6, wherein each alkyl, alkylene, hydroxylalkyl, aminoalkyl, alkylaminylalkyl, alkoxyalkyl, alkoxycarbonyl, alkylcarbonyloxy, alkylcarbonyloxyalkyl and alkylcarbonyl is optionally substituted with one or more substituent.

In some embodiments, an ionizable lipid has a structure according to formula 6:

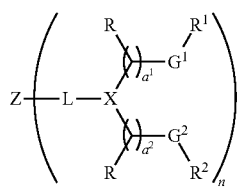

wherein:

one of $G^1$ or $G^2$ is at each occurrence, —O(C=O)—, —(C=O)O—, —C(=O)—, —O—, —S(O)y, —S—S—, —C(=O)S—, SC(=O)—, —N(Ra)C(=O)—, —C(=O)N(Ra)—, —N(Ra)C(=O)N(Ra)—, —OC(=O)N(Ra)— or —N(Ra)C(=O)O—, and the other of G1 or G2 is, at each occurrence, —O(C=O)—, —(C=O)O—, —C(=O)—, —O—, —S(O)y-, —S—S—, —C(=O)S—, —SC(=O)—, —N(Ra)C(=O)—, —C(=O)N(Ra)—, —N(Ra)C(=O)N(Ra)—, —OC(=O)N(Ra)— or —N(Ra)C(=O)O— or a direct bond;

L is, at each occurrence, ~O(C=O)—, wherein ~ represents a covalent bond to X;

X is CRa;

Z is alkyl, cycloalkyl or a monovalent moiety comprising at least one polar functional group when n is 1; or Z is alkylene, cycloalkylene or a polyvalent moiety comprising at least one polar functional group when n is greater than 1;

Ra is, at each occurrence, independently H, C1-C12 alkyl, C1-C12 hydroxylalkyl, C1-C12 aminoalkyl, C1-C12 alkylaminylalkyl, C1-C12 alkoxyalkyl, C1-C12 alkoxycarbonyl, C1-C12 alkylcarbonyloxy, C1-C12 alkylcarbonyloxyalkyl or C1-C12 alkylcarbonyl;

R is, at each occurrence, independently either: (a) H or C1-C12 alkyl; or (b) R together with the carbon atom to which it is bound is taken together with an adjacent R and the carbon atom to which it is bound to form a carbon-carbon double bond;

$R^1$ and $R^2$ have, at each occurrence, the following structure, respectively:

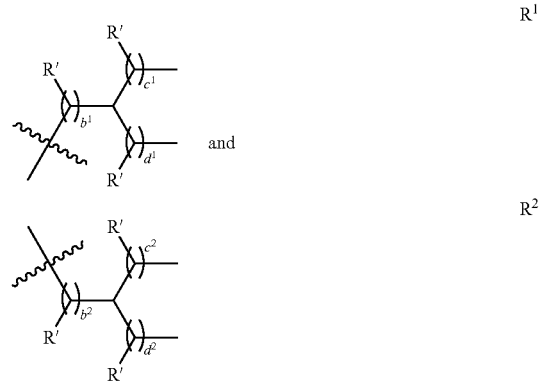

R' is, at each occurrence, independently H or C1-C12 alkyl;

a¹ and a² are, at each occurrence, independently an integer from 3 to 12;

b¹ and b² are, at each occurrence, independently 0 or 1;

c¹ and c² are, at each occurrence, independently an integer from 2 to 12;

d¹ and d² are, at each occurrence, independently an integer from 2 to 12;

y is, at each occurrence, independently an integer from 0 to 2; and n is an integer from 1 to 6, wherein a¹, a², c¹, c², d¹ and d² are selected such that the sum of a¹+c¹+d¹ is an integer from 18 to 30, and the sum of a²+c²+d² is an integer from 18 to 30, and wherein each alkyl, alkylene, hydroxylalkyl, aminoalkyl, alkylaminylalkyl, alkoxyalkyl, alkoxycarbonyl, alkylcarbonyloxy, alkylcarbonyloxyalkyl and alkylcarbonyl is optionally substituted with one or more substituent. In certain embodiments of Formula (V), $G^1$ and $G^2$ are each independently —O(C=O)— or —(C=O)O—.

In some embodiments, an ionizable lipid has a disulfide tail.

In some embodiments, an ionizable lipid includes short peptides of 12-15 mer length as head groups.

In some embodiments, the head of an ionizable lipid comprises the structure of Vitamin A, D, E, or K as described in the published Patent Application WO2019232095A1, which is incorporated by herein by reference in its entirety.

In some embodiments, a lipid is described in international patent applications WO2021077067, or WO2019152557, each of which is incorporated herein by reference in its entirety.

In some embodiments, an LNP described herein comprises a lipid, e.g., an ionizable lipid, disclosed in US 2019/0240354, which is incorporated herein by reference in its entirety.

In some embodiments, the lipids disclosed in US 2019/0240354 are of Formula I:

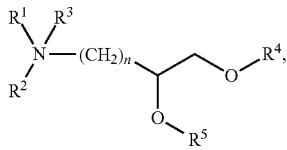

(I)

or salts thereof, wherein:
$R^1$ and $R^2$ are either the same or different and are independently hydrogen (H) or an optionally substituted $C_1$-$C_6$ alkyl, $C_2$-$C_6$ alkenyl, or $C_2$-$C_6$ alkynyl, or $R^1$ and $R^2$ may join to form an optionally substituted heterocyclic ring of 4 to 6 carbon atoms and 1 or 2 heteroatoms selected from the group consisting of nitrogen (N), oxygen (O), and mixtures thereof;
$R^3$ is either absent or is hydrogen (H) or a $C_1$-$C_6$ alkyl to provide a quaternary amine; $R^4$ and $R^5$ are either the same or different and are independently an optionally substituted $C_{10}$-$C_{24}$ alkyl, $C_{10}$-$C_{24}$ alkenyl, $C_{10}$-$C_{24}$ alkynyl, or $C_{10}$-$C_{24}$ acyl, wherein at least one of $R^4$ and $R^5$ comprises at least two sites of unsaturation; and
n is 0, 1, 2, 3, or 4.

In some embodiments, the lipids disclosed in US 2019/0240354 are of Formula II:

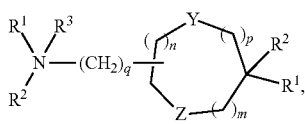

(II)

wherein $R^1$ and $R^2$ are either the same or different and are independently an optionally substituted $C_{12}$-$C_{24}$ alkyl, $C_{12}$-$C_{24}$ alkenyl, $C_{12}$-$C_{24}$ alkynyl, or $C_{12}$-$C_{24}$ acyl; $R^3$ and $R^4$ are either the same or different and are independently an optionally substituted $C_1$-$C_6$ alkyl, $C_2$-$C_6$ alkenyl, or $C_2$-$C_6$ alkynyl, or $R^3$ and $R^4$ may join to form an optionally substituted heterocyclic ring of 4 to 6 carbon atoms and 1 or 2 heteroatoms chosen from nitrogen and oxygen; $R^5$ is either absent or is hydrogen (H) or a $C_1$-$C_6$ alkyl to provide a quaternary amine; m, n, and p are either the same or different and are independently either 0, 1, or 2, with the proviso that m, n, and p are not simultaneously 0; q is 0, 1, 2, 3, or 4; and Y and Z are either the same or different and are independently O, S, or NH. In some embodiments, q is 2.

In some embodiments, the cationic lipid of Formula II is 2,2-dilinoleyl-4-(2-dimethylaminoethyl)-[1,3]-dioxolane, 2,2-dilinoleyl-4-(3-dimethylaminopropyl)-[1,3]-dioxolane, 2,2-dilinoleyl-4-(4-dimethylaminobutyl)-[1,3]-dioxolane, 2,2-dilinoleyl-5-dimethylaminomethyl-[1,3]-dioxane, 2,2-dilinoleyl-4-N-methylpiperazino-[1,3]-dioxolane, 2,2-dilinoleyl-4-dimethylaminomethyl-[1,3]-dioxolane, 2,2-dioleoyl-4-dimethylaminomethyl-[1,3]-dioxolane, 2,2-distearoyl-4-dimethylaminomethyl-[1,3]-dioxolane, 2,2-dilinoleyl-4-N-morpholino-[1,3]-dioxolane, 2,2-Dilinoleyl-4-trimethylamino-[1,3]-dioxolane chloride, 2,2-dilinoleyl-4,5-bis(dimethylaminomethyl)-[1,3]-dioxolane, 2,2-dilinoleyl-4-methylpiperazine-[1,3]-dioxolane, or mixtures thereof. In some embodiments, the cationic lipid of Formula II is 2,2-dilinoleyl-4-(2-dimethylaminoethyl)-[1,3]-dioxolane.

In some embodiments, the lipids disclosed in US 2019/0240354 are of Formula III:

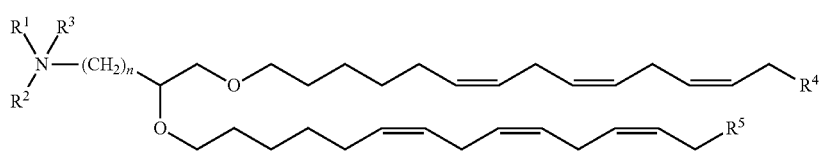

(III)

or salts thereof, wherein: $R^1$ and $R^2$ are either the same or different and are independently an optionally substituted $C_1$-$C_6$ alkyl, $C_2$-$C_6$ alkenyl, or $C_2$-$C_6$ alkynyl, or $R^1$ and $R^2$ may join to form an optionally substituted heterocyclic ring of 4 to 6 carbon atoms and 1 or 2 heteroatoms selected from the group consisting of nitrogen (N), oxygen (O), and mixtures thereof; $R^3$ is either absent or is hydrogen (H) or a $C_1$-$C_6$ alkyl to provide a quaternary amine; $R^4$ and $R^5$ are either absent or present and when present are either the same or different and are independently an optionally substituted $C_1$-$C_{10}$ alkyl or $C_2$-$C_{10}$ alkenyl; and n is 0, 1, 2, 3, or 4.

In some embodiments, the lipids disclosed in US 2019/0240354 are of Formula C:

$$X\text{-}A\text{-}Y\text{—}Z^1;\qquad\text{(Formula C)}$$

or salts thereof, wherein:
X is —N(H)R or —NR$_2$;
A is absent, $C_1$ to $C_6$ alkyl, $C_2$ to $C_6$ alkenyl, or $C_2$ to $C_6$ alkynyl, which $C_1$ to $C_6$ alkyl, $C_2$ to $C_6$ alkenyl, and $C_2$ to $C_6$ alkynyl is optionally substituted with one or more groups independently selected from oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$, and —SO$_n$NR$^x$R$^y$, wherein n is 0, 1, or 2, and R$^x$ and R$^y$ are each independently hydrogen, alkyl, or heterocycle, wherein each alkyl and heterocycle of R$^x$ and R$^y$ may be further substituted with one or more groups independently selected from oxo, halogen, —OH, —CN, alkyl, —OR$^{x'}$, heterocycle, —NR$^{x'}$R$^{y'}$, —NR$^{x'}$C(=O)R$^{y'}$, —NR$^{x'}$SO$_2$R$^{y'}$, —C(=O)R$^{x'}$, —C(=O)OR$^{x'}$, —C(=O)NR$^{x'}$R$^{y'}$, —SO$_{n'}$R$^{x'}$, and —SO$_{n'}$NR$^{x'}$R$^{y'}$, wherein n' is 0, 1, or 2, and R$^{x'}$ and R$^{y'}$ are each independently hydrogen, alkyl, or heterocycle;
Y is selected from the group consisting of absent, —C(=O)—, —O—, —OC(=O)—, —C(=O)O—, —N(R$^b$)C(=O)—, —C(=O)N(R$^b$)—, —N(R$^b$)C(=O)O—, and —OC(=O)N(R$^b$)—;
$Z^1$ is a $C_1$ to $C_6$ alkyl that is substituted with three or four R$^x$ groups, wherein each R$^x$ is independently selected from $C_6$ to $C_{11}$ alkyl, $C_6$ to $C_{11}$ alkenyl, and $C_6$ to $C_{11}$ alkynyl, which $C_6$ to $C_{11}$ alkyl, $C_6$ to $C_{11}$ alkenyl, and $C_6$ to $C_{11}$ alkynyl is optionally substituted with one or more groups independently selected from oxo, halogen, heterocycle, —CN, —OR$^x$, —NR$^x$R$^y$, —NR$^x$C(=O)R$^y$, —NR$^x$SO$_2$R$^y$, —C(=O)R$^x$, —C(=O)OR$^x$, —C(=O)NR$^x$R$^y$, —SO$_n$R$^x$, and SO$_n$NR$^x$R$^y$, wherein n is 0, 1, or 2, and R$^x$ and R$^y$ are each independently hydrogen, alkyl, or heterocycle, wherein any alkyl and heterocycle of R$^x$ and R$^y$ may be further substituted with one or more groups independently selected from oxo, halogen, —OH, —CN, alkyl, —OR$^{x'}$, heterocycle, —NR$^{x'}$R$^{y'}$, —NR$^{x'}$C(=O)R$^{y'}$, —NR$^{x'}$SO$_2$R$^{y'}$, —C(=O)R$^{x'}$, —C(=O)OR$^{x'}$, —C(=O)NR$^{x'}$R$^{y'}$, —SO$_{n'}$R$^{x'}$, and —SO$_{n'}$NR$^{x'}$R$^{y'}$, wherein n' is 0, 1, or 2, and R$^{x'}$ and R$^{y'}$ are each independently hydrogen, alkyl, or heterocycle;

each R is independently alkyl, alkenyl, or alkynyl, that is optionally substituted with one or more groups independently selected from oxo, halogen, heterocycle, —CN, —OR$^x$, —NR$^x$R$^y$, —NR$^x$C(=O)R$^y$, —NR$^x$SO$_2$R$^Y$, —C(=O)R$^x$, —C(=O)OR$^x$, —C(=O)NR$^x$R$^y$, —SO$_n$R$^x$, and —SO$_n$NR$^x$R$^y$, wherein n is 0, 1, or 2, and R$^x$ and R$^y$ are each independently hydrogen, alkyl, or heterocycle, wherein any alkyl and heterocycle of R$^x$ and R$^y$ may be further substituted with one or more groups independently selected from oxo, halogen, —OH, —CN, alkyl, —OR$^{x'}$, heterocycle, —NR$^{x'}$R$^{y'}$, —NR$^{x'}$C(=O)R$^{y'}$, —NR$^{x'}$SO$_2$R$^{y'}$, —C(=O)R$^{x'}$, —C(=O)OR$^{x'}$, —C(=O)NR$^{x'}$R$^{y'}$, —SO$_{n'}$R$^{x'}$ and —SO$_{n'}$NR$^{x'}$R$^{Y}$, wherein n' is 0, 1, or 2, and R$^{x'}$ and R$^{y'}$ are each independently hydrogen, alkyl, or heterocycle; and each R$^b$ is H or C$_1$ to C$_6$alkyl.

In some embodiments, an LNP described herein comprises a lipid, e.g., an ionizable lipid, disclosed in US 2010/0130588, which is incorporated herein by reference in its entirety.

In some embodiments, the lipids disclosed in US 2010/0130588 are of Formula I.

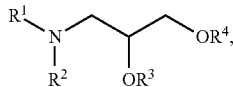

(I)

wherein R$^1$ and R$^2$ are independently selected and are H or C$_1$-C$_3$ alkyls, R$^3$ and R$^4$ are independently selected and are alkyl groups having from about 10 to about 20 carbon atoms, and at least one of R$^3$ and R$^4$ comprises at least two sites of unsaturation. In some embodiments, R$^3$ and R$^4$ are both the same, i.e., R$^3$ and R$^4$ are both linoleyl (C$_{18}$), etc. In some embodiments, R$^3$ and R$^4$ are different, i.e., R$^3$ is tetradectrienyl (C$_{14}$) and R$^4$ is linoleyl (C$_{18}$).

In some embodiments, the lipid of Formula I is 1,2-dilinoleyloxy-N,N-dimethylaminopropane (DLinDMA) or 1,2-dilinolenyloxy-N,N-dimethylaminopropane (DLenDMA).

In some embodiments, the lipids disclosed in US 2010/0130588 are of Formula II:

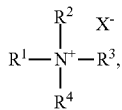

(II)

wherein R$^1$ and R$^2$ are independently selected and are H or C$_1$-C$_3$ alkyls, R$^3$ and R$^4$ are independently selected and are alkyl groups having from about 10 to about 20 carbon atoms, and at least one of R$^3$ and R$^4$ comprises at least two sites of unsaturation.

In some embodiments, an LNP described herein comprises a lipid, e.g., an ionizable lipid, disclosed in US 2021/0087135, which is incorporated herein by reference in its entirety.

In some embodiments, the lipids disclosed in US 2021/0087135 are of Formula (A):

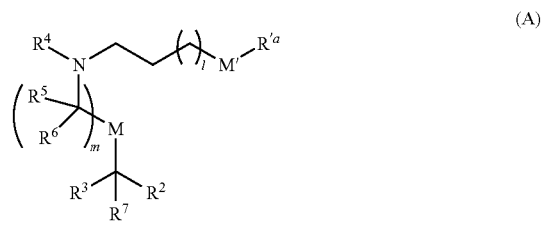

(A)

or its N-oxide, or a salt or isomer thereof,
wherein R$'^a$ is R$'^{branched}$ or R$'^{cyclic}$; wherein R$'^{branched}$ is:

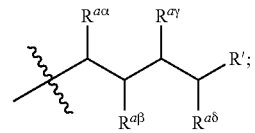

R$'^{cyclic}$ is:

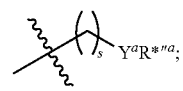

wherein:

denotes a point of attachment;
wherein R$^{a\alpha}$ is H, and R$^{a\beta}$, R$^{a\gamma}$, and R$^{a\delta}$ are each independently selected from the group consisting of H, C$_{2-12}$ alkyl, and C$_{2-12}$ alkenyl, wherein at least one of R$^{a\beta}$, R$^{a\gamma}$, and R$^{a\delta}$ is selected from the group consisting of C$_{2-12}$ alkyl and C$_{2-12}$ alkenyl;
R$^2$ and R$^3$ are each C$_{1-14}$ alkyl;
R$^4$ is selected from the group consisting of —(CH$_2$)$_2$OH, —(CH$_2$)$_3$OH, —(CH$_2$)$_4$OH, —(CH$_2$)$_5$OH and

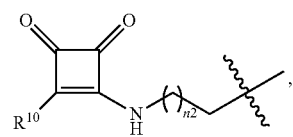

wherein:

denotes a point of attachment;

$R^{10}$ is $N(R)_2$; each R is independently selected from the group consisting of $C_{1-6}$ alkyl, $C_{2-3}$ alkenyl, and H; and n2 is selected from the group consisting of 1, 2, 3, 4, 5, 6, 7, 8, 9, and 10;

each $R^5$ is independently selected from the group consisting of OH, $C_{1-3}$ alkyl, $C_{2-3}$ alkenyl, and H;

each $R^6$ is independently selected from the group consisting of OH, $C_{1-3}$ alkyl, $C_{2-3}$ alkenyl, and H;

$R^7$ is H;

M and M' are each independently selected from the group consisting of —C(O)O— and —OC(O)—;

R' is a $C_{1-12}$ alkyl or $C_{2-12}$ alkenyl;

$Y^a$ is a $C_{3-6}$ carbocycle;

$R^{*"a}$ is selected from the group consisting of $C_{1-15}$ alkyl and $C_{2-15}$ alkenyl; 1 is selected from the group consisting of 1, 2, 3, 4, and 5;

s is 2 or 3; and m is selected from the group consisting of 5, 6, 7, 8, 9, 10, 11, 12, and 13.

In some embodiments, an LNP described herein comprises a lipid, e.g., an ionizable lipid, disclosed in US 2021/0128488, which is incorporated herein by reference in its entirety In some embodiments, the lipids disclosed in US 2021/0128488 are of structure (I):

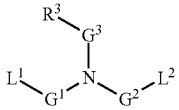

I or a pharmaceutically acceptable salt, prodrug or stereoisomer thereof, wherein:

$L^1$ is —O(C=O)R', —(C=O)OR$^1$, —C(=O)R$^1$, —OR$^1$, —S(O)$_x$R$^1$, —S—SR$^1$, —C('O)SR', —SC(=O)R', —NR$^a$C(=O)R$^1$, —C(=O)NR$^b$R$^c$, —NR$^a$C(=O)NR$^b$R$^c$, —OC(=O)NR$^b$R$^c$ or —NR$^a$C(=O)OR$^1$;

$L^2$ is —O(C=O)R$^2$, —(C=O)OR$^2$, —C(=O)R$^2$, —OR$^2$, —S(O)$_x$R$^2$, —S—SR$^2$, —C(=O)SR$^2$, —SC(=O)R$^2$, —NR$^a$C(=O)R$^2$, —C(=O)NR$^e$R$^f$, —NR$^a$C(=O)NR$^e$R$^f$, —OC(=O)NR$^e$R$^f$; —NR$^a$C(=O)OR$^2$ or a direct bond to R$^2$;

$G^1$ and $G^2$ are each independently $C_2$-$C_{12}$ alkylene or $C_2$-$C_{12}$ alkenylene;

$G^3$ is $C_1$-$C_{24}$ alkylene, $C_2$-$C_{24}$ alkenylene, $C_3$-$C_8$ cycloalkylene or $C_3$-$C_8$ cycloalkenylene;

$R^a$, $R^b$, $R^d$ and $R^e$ are each independently H or $C_1$-$C_{12}$ alkyl or $C_1$-$C_{12}$ alkenyl;

$R^c$ and $R^f$ are each independently $C_1$-$C_{12}$ alkyl or $C_2$-$C_{12}$ alkenyl;

$R^1$ and $R^2$ are each independently branched $C_6$-$C_{24}$ alkyl or branched $C_6$-$C_{24}$ alkenyl;

$R^3$ is —N(R$^4$)R$^5$;

$R^4$ is $C_1$-$C_{12}$ alkyl;

$R^5$ is substituted $C_1$-$C_{12}$ alkyl; and x is 0, 1 or 2, and wherein each alkyl, alkenyl, alkylene, alkenylene, cycloalkylene, cycloalkenylene, aryl and aralkyl is independently substituted or unsubstituted unless otherwise specified.

In some embodiments, an LNP described herein comprises a lipid, e.g., an ionizable lipid, disclosed in US 2020/0121809, which is incorporated herein by reference in its entirety.

In some embodiments the lipids disclosed in US 2020/0121809 have a structure of Formula II:

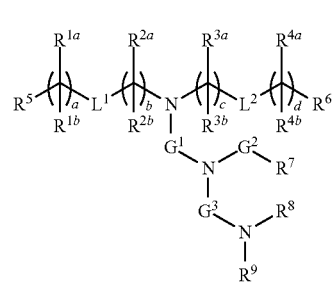

II or a pharmaceutically acceptable salt, tautomer, prodrug or stereoisomer thereof, wherein:

one of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O— or a direct bond;

$G^1$ is $C_1$-$C_2$ alkylene, —(C=O)—, —O(C=O)—, —SC(=O)—, —NR$^a$C(=O)— or a direct bond;

$G^2$ is —C(=O)—, —(C=O)O—, —C(=O)S—, —C(=O)NR$^a$— or a direct bond;

$G^3$ is $C_1$-$C_6$ alkylene;

$R^a$ is H or $C_1$-$C_{12}$ alkyl;

$R^{1a}$ and $R^{1b}$ are, at each occurrence, independently either: (a) H or $C_1$-$C_{12}$ alkyl; or (b) $R^{1a}$ is H or $C_1$-$C_{12}$ alkyl, and $R^{1b}$ together with the carbon atom to which it is bound is taken together with an adjacent $R^{1b}$ and the carbon atom to which it is bound to form a carbon-carbon double bond;

$R^{2a}$ and $R^{2b}$ are, at each occurrence, independently either: (a) H or $C_1$-$C_{12}$ alkyl; or (b) $R^{2a}$ is H or $C_1$-$C_{12}$ alkyl, and $R^{2b}$ together with the carbon atom to which it is bound is taken together with an adjacent $R^{2b}$ and the carbon atom to which it is bound to form a carbon-carbon double bond;

$R^{3a}$ and $R^{3b}$ are, at each occurrence, independently either (a): H or $C_1$-$C_{12}$ alkyl; or (b) $R^{3a}$ is H or $C_1$-$C_{12}$ alkyl, and $R^{3b}$ together with the carbon atom to which it is bound is taken together with an adjacent $R^{3b}$ and the carbon atom to which it is bound to form a carbon-carbon double bond;

$R^{4a}$ and $R^{4b}$ are, at each occurrence, independently either: (a) H or $C_1$-$C_{12}$ alkyl; or (b) $R^{4a}$ is H or $C_1$-$C_{12}$ alkyl, and $R^{4b}$ together with the carbon atom to which it is bound is taken together with an adjacent $R^{4b}$ and the carbon atom to which it is bound to form a carbon-carbon double bond;

$R^5$ and $R^6$ are each independently H or methyl;

$R^7$ is $C_4$-$C_{20}$ alkyl;

$R^8$ and $R^9$ are each independently $C_1$-$C_{12}$ alkyl; or $R^8$ and $R^9$, together with the nitrogen atom to which they are attached, form a 5, 6 or 7-membered heterocyclic ring;

a, b, c and d are each independently an integer from 1 to 24; and x is 0, 1 or 2.

In some embodiments, the lipids disclosed in US 2020/0121809 have a structure of Formula III:

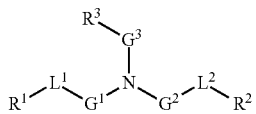

III or a pharmaceutically acceptable salt, prodrug or stereoisomer thereof, wherein:

one of $L^1$ or $L^2$ is —O(C=O)—, —(C=O)O—, —C(=O), —O—, —S(O)$_x$—, —S—S—, —C(=O)S—, —SC(=O)—, —NR$^a$C(=O)—, —C(=O)NR$^a$—, —NR$^a$C(=O)NR$^a$—, —OC(=O)NR$^a$— or —NR$^a$C(=O)O—, and the other of $L^1$ or $L^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, NR$^a$C(=O)NR$^a$—, —OC(=O)NR$^a$— or —NR$^a$C(=O)O— or a direct bond;

$G^1$ and $G^2$ are each independently unsubstituted $C_1$-$C_{12}$ alkylene or $C_1$-$C_{12}$ alkenylene;

$G^3$ is $C_1$-$C_{24}$ alkylene, $C_1$-$C_{24}$ alkenylene, $C_3$-$C_8$ cycloalkylene, $C_3$-$C_8$ cycloalkenylene;

$R^a$ is H or $C_1$-$C_{12}$ alkyl;

$R^1$ and $R^2$ are each independently $C_6$-$C_{24}$ alkyl or $C_6$-$C_{24}$ alkenyl;

$R^3$ is H, OR$^S$, CN, —C(=O)OR$^4$, —OC(=O)R$^4$ or —NR$^5$C(=O)R$^4$;

$R^4$ is $C_1$-$C_{12}$ alkyl;

$R^5$ is H or $C_1$-$C_6$ alkyl; and x is 0, 1 or 2.

In some embodiments, the lipids disclosed in US 2020/0121809 have a structure of Formula (IV):

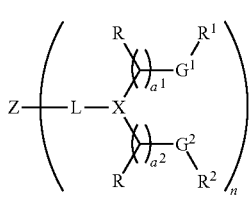

(IV)

or a pharmaceutically acceptable salt, prodrug or stereoisomer thereof, wherein:

one of $G^1$ or $G^2$ is, at each occurrence, —O(C=O)—, —(C=O)O—, —C(=O)—, —O—, —S(O)$_y$—, —S—S—, —C(=O)S—, SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O—, and the other of $G^1$ or $G^2$ is, at each occurrence, —O(C=O)—, —(C=O)O—, —C(=O)—, —O—, —S(O)$_y$—, —S—S—, —C(=O)S—, —SC(=O)—, —N(R$^a$)C(=O)—, —C(=O)N(R$^a$)—, —N(R$^a$)C(=O)N(R$^a$)—, —OC(=O)N(R$^a$)— or —N(R$^a$)C(=O)O— or a direct bond;

L is, at each occurrence, —O(C=O)—, wherein - represents a covalent bond to X;

X is CR$^a$;

Z is alkyl, cycloalkyl or a monovalent moiety comprising at least one polar functional group when n is 1; or Z is alkylene, cycloalkylene or a polyvalent moiety comprising at least one polar functional group when n is greater than 1;

R$^a$ is, at each occurrence, independently H, $C_1$-$C_{12}$ alkyl, $C_1$-$C_{12}$ hydroxylalkyl, $C_1$-$C_{12}$ aminoalkyl, $C_1$-$C_{12}$ alkylaminylalkyl, $C_1$-$C_{12}$ alkoxyalkyl, $C_1$-$C_{12}$ alkoxycarbonyl, $C_1$-$C_{12}$ alkylcarbonyloxy, $C_1$-$C_{12}$ alkylcarbonyloxyalkyl or $C_1$-$C_{12}$ alkylcarbonyl;

R is, at each occurrence, independently either: (a) H or $C_1$-$C_{12}$ alkyl; or (b) R together with the carbon atom to which it is bound is taken together with an adjacent R and the carbon atom to which it is bound to form a carbon-carbon double bond;

$R^1$ and $R^2$ have, at each occurrence, the following structure, respectively:

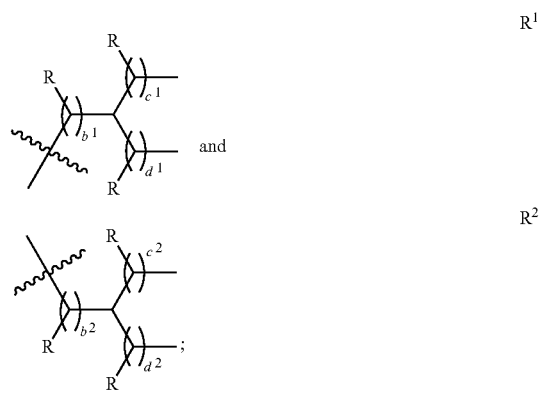

$a^1$ and $a^2$ are, at each occurrence, independently an integer from 3 to 12;

$b^1$ and $b^2$ are, at each occurrence, independently 0 or 1;

$c^1$ and $c^2$ are, at each occurrence, independently an integer from 5 to 10;

$d^1$ and $d^2$ are, at each occurrence, independently an integer from 5 to 10;

y is, at each occurrence, independently an integer from 0 to 2; and n is an integer from 1 to 6, wherein each alkyl, alkylene, hydroxylalkyl, aminoalkyl, alkylaminylalkyl, alkoxyalkyl, alkoxycarbonyl, alkylcarbonyloxy, alkylcarbonyloxyalkyl and alkylcarbonyl is optionally substituted with one or more substituent.

In some embodiments, an LNP described herein comprises a lipid, e.g., an ionizable lipid, disclosed in US 2013/0108685, which is incorporated herein by reference in its entirety.

In some embodiments, the lipids disclosed in US 2013/0108685 are represented by the following formula (I):

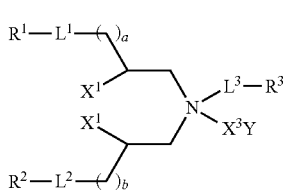
(I)

wherein:
- $R^1$ and $R^2$ are, the same or different, each linear or branched alkyl, alkenyl or alkynyl having 12 to 24 carbon atoms, or $R^1$ and $R^2$ are combined together to form dialkylmethylene, dialkenylmethylene, dialkynylmethylene or alkylalkenylmethylene,
- $X^1$ and $X^3$ are hydrogen atoms, or are combined together to form a single bond or alkylene,
- $X^3$ is absent or represents alkyl having 1 to 6 carbon atoms, or alkenyl having 3 to 6 carbon atoms, when $X^3$ is absent,
- Y is absent, a and b are 0, $L^3$ is a single bond, $R^3$ is alkyl having 1 to 6 carbon atoms, alkenyl having 3 to 6 carbon atoms, pyrrolidin-3-yl, piperidin-3-yl, piperidin-4-yl, or alkyl having 1 to 6 carbon atoms or alkenyl having 3 to 6 carbon atoms substituted with 1 to 3 substituent(s), which is(are), the same or different, amino, monoalkylamino, dialkylamino, trialkylammonio, hydroxy, alkoxy, carbamoyl, monoalkylcarbamoyl, dialkylcarbamoyl, pyrrolidinyl, piperidyl or morpholinyl, and $L^1$ and $L^2$ are —O—,
- Y is absent, a and b are, the same or different, 0 to 3, and are not 0 at the same time, $L^3$ is a single bond, $R^3$ is alkyl having 1 to 6 carbon atoms, alkenyl having 3 to 6 carbon atoms, pyrrolidin-3-yl, piperidin-3-yl, piperidin-4-yl, or alkyl having 1 to 6 carbon atoms or alkenyl having 3 to 6 carbon atoms substituted with 1 to 3 substituent(s), which is(are), the same or different, amino, monoalkylamino, dialkylamino, trialkylammonio, hydroxy, alkoxy, carbamoyl, monoalkylcarbamoyl, dialkylcarbamoyl, pyrrolidinyl, piperidyl or morpholinyl, $L^1$ and $L^2$ are, the same or different, —O—, —CO—O— or —O—CO—,
- Y is absent, a and b are, the same or different, 0 to 3, $L^3$ is a single bond, $R^3$ is a hydrogen atom, and $L^1$ and $L^2$ are, the same or different, —O—, —CO—O— or —O—CO—, or Y is absent, a and b are, the same or different, 0 to 3, $L^3$ is —CO— or —CO—O—, $R^3$ is pyrrolidin-2-yl, pyrrolidin-3-yl, piperidin-2-yl, piperidin-3-yl, piperidin-4-yl, morpholin-2-yl, morpholin-3-yl, or alkyl having 1 to 6 carbon atoms or alkenyl having 3 to 6 carbon atoms substituted with 1 to 3 substituent(s), which is(are), the same or different, amino, monoalkylamino, dialkylamino, trialkylammonio, hydroxy, alkoxy, carbamoyl, monoalkylcarbamoyl, dialkylcarbamoyl, pyrrolidinyl, piperidyl or morpholinyl, wherein at least one of the substituents is amino, monoalkylamino, dialkylamino, trialkylammonio, pyrrolidinyl, piperidyl or morpholinyl, and $L^1$ and $L^2$ are, the same or different, —O—, —CO—O— or —O—CO—, and
- when $X^3$ is alkyl having 1 to 6 carbon atoms or alkenyl having 3 to 6 carbon atoms,
- Y is a pharmaceutically acceptable anion, a and b are, the same or different, 0 to 3, $L^3$ is a single bond, $R^3$ is alkyl having 1 to 6 carbon atoms, alkenyl having 3 to 6 carbon atoms, pyrrolidin-2-yl, pyrrolidin-3-yl, piperidin-2-yl, piperidin-3-yl, piperidin-4-yl, morpholin-2-yl, morpholin-3-yl, or alkyl having 1 to 6 carbon atoms or alkenyl having 3 to 6 carbon atoms substituted with 1 to 3 substituent(s), which is(are), the same or different, amino, monoalkylamino, dialkylamino, trialkylammonio, hydroxy, alkoxy, carbamoyl, monoalkylcarbamoyl, dialkylcarbamoyl, pyrrolidinyl, piperidyl or morpholinyl, $L^1$ and $L^2$ are, the same or different, —O—, —CO—O— or —O—CO—).

In some embodiments, an LNP described herein comprises a lipid, e.g., an ionizable lipid, disclosed in US 2013/0195920, which is incorporated herein by reference in its entirety.

In some embodiments, the lipids disclosed in US 2013/0195920 are of formula (I), which has a branched alkyl at the alpha position adjacent to the biodegradable group (between the biodegradable group and the teriary carbon):

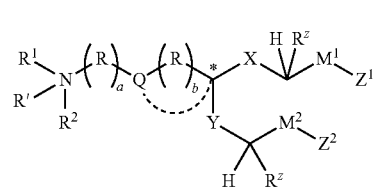
Formula (I)

or a salt thereof (e.g., a pharmaceutically acceptable salt thereof), wherein
- R' is absent, hydrogen, or alkyl (e.g., $C_1$-$C_4$ alkyl);
- with respect to $R^1$ and $R^2$,
  - (i) $R^1$ and $R^2$ are each, independently, optionally substituted alkyl, alkenyl, alkynyl, cycloalkylalkyl, heterocycle, or $R^{10}$;
  - (ii) $R^1$ and $R^2$, together with the nitrogen atom to which they are attached, form an optionally substituted heterocylic ring; or
  - (iii) one of $R^1$ and $R^2$ is optionally substituted alkyl, alkenyl, alkynyl, cycloalkyl, cycloalkylalkyl, or heterocycle, and the other forms a 4-10 member heterocyclic ring or heteroaryl (e.g., a 6-member ring) with (a) the adjacent nitrogen atom and (b) the $(R)_a$ group adjacent to the nitrogen atom;
- each occurrence of R is, independently, —$(CR^3R^4)$—;
- each occurrence of $R^3$ and $R^4$ are, independently H, halogen, OH, alkyl, alkoxy, —$NH_2$, $R^{10}$, alkylamino, or dialkylamino (In some embodiments, each occurrence of $R^3$ and $R^4$ are, independently H or $C_1$-$C_4$ alkyl);
- each occurrence of $R^{10}$ is independently selected from PEG and polymers based on poly(oxazoline), poly(ethylene oxide), poly(vinyl alcohol), poly(glycerol), poly(N-vinylpyrrolidone), poly[N-(2-hydroxypropyl) methacrylamide] and poly(amino acid)s, wherein (i) the PEG or polymer is linear or branched, (ii) the PEG or polymer is polymerized by n subunits, (iii) n is a number-averaged degree of polymerization between 10 and 200 units, and (iv) wherein the compound of formula has at most two $R^{10}$ groups (preferably at most one $R^{10}$ group); the dashed line to Q is absent or a bond; when the dashed line to Q is absent then Q is absent or is —O—, —NH—, —S—, —C(O)—, —C(O)O—, —OC(O)—, —C(O)N($R^4$)—, —N($R^5$)C(O)—, —S—S—, —OC(O)O—, —O—N=C($R^5$)—, —C($R^5$)

=N—O—, —OC(O)N(R⁵)—, —N(R⁵)C(O)N(R⁵)—, —N(R⁵)C(O)O—, —C(O)S—, —C(S)O— or —C(R⁵)=N—O—C(O)—; or when the dashed line to Q is a bond then (i) b is 0 and (ii) Q and the tertiary carbon adjacent to it (C*) form a substituted or unsubstituted, mono- or bi-cyclic heterocyclic group having from 5 to 10 ring atoms (e.g., the heteroatoms in the heterocyclic group are selected from O and S, preferably O);

each occurrence of $R^5$ is, independently, H or alkyl (e.g. $C_1$-$C_4$ alkyl);

X and Y are each, independently, alkylene or alkenylene (e.g., $C_4$ to $C_{20}$ alkylene or $C_4$ to $C_{20}$ alkenylene);

$M^1$ and $M^2$ are each, independently, a biodegradable group (e.g., —OC(O)—, —C(O)O—, —SC(O)—, —C(O)S—, —OC(S)—, —C(S)O—, —S—S—, C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

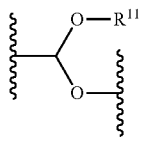

wherein $R^{11}$ is a $C_2$-$C_8$ alkyl or alkenyl;

each occurrence of $R^z$ is, independently, $C_1$-$C_8$ alkyl (e.g., methyl, ethyl, isopropyl, n-butyl, n-pentyl, or n-hexyl);

a is 1, 2, 3, 4, 5 or 6;

b is 0, 1, 2, or 3; and $Z^1$ and $Z^2$ are each, independently, $C_8$-$C_{14}$ alkyl or $C_8$-$C_{14}$ alkenyl, wherein the alkenyl group may optionally be substituted with one or two fluorine atoms at the alpha position to a double bond which is between the double bond and the terminus of $Z^1$ or $Z^2$.

In some embodiments, the lipids disclosed in US 2013/0195920 are of formula (II), which has a branched alkyl at the alpha position adjacent to the biodegradable group (between the biodegradable group and the terminus of the tail, i.e., $Z^1$ or $Z^2$)

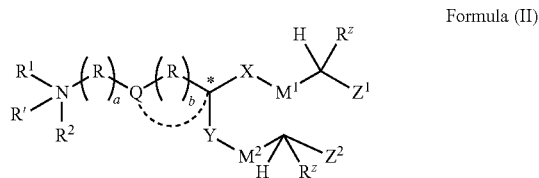

Formula (II)

or a salt thereof (e.g., a pharmaceutically acceptable salt thereof), wherein

R' is absent, hydrogen, or alkyl (e.g., $C_1$-$C_4$ alkyl);

with respect to $R^1$ and $R^2$, (i) $R^1$ and $R^2$ are each, independently, optionally substituted alkyl, alkenyl, alkynyl, cycloalkylalkyl, heterocycle, or $R^{10}$;

(ii) $R^1$ and $R^2$, together with the nitrogen atom to which they are attached, form an optionally substituted heterocyclic ring; or (iii) one of $R^1$ and $R^2$ is optionally substituted alkyl, alkenyl, alkynyl, cycloalkyl, cycloalkylalkyl, or heterocycle, and the other forms a 4-10 membered heterocyclic ring or heteroaryl (e.g., a 6-member ring) with (a) the adjacent nitrogen atom and (b) the (R)$_a$ group adjacent to the nitrogen atom;

each occurrence of R is, independently, —(C$R^3R^4$)—;

each occurrence of $R^3$ and $R^4$ are, independently H, halogen, OH, alkyl, alkoxy, —NH$_2$, $R^{10}$, alkylamino, or dialkylamino (In some embodiments, each occurrence of $R^3$ and $R^4$ are, independently H or $C_1$-$C_4$ alkyl);

each occurrence of $R^{10}$ is independently selected from PEG and polymers based on poly(oxazoline), poly(ethylene oxide), poly(vinyl alcohol), poly(glycerol), poly(N-vinylpyrrolidone), poly[N-(2-hydroxypropyl) methacrylamide] and poly(amino acid)s, wherein (i) the PEG or polymer is linear or branched, (ii) the PEG or polymer is polymerized by n subunits, (iii) n is a number-averaged degree of polymerization between 10 and 200 units, and (iv) wherein the compound of formula has at most two $R^{10}$ groups (preferably at most one $R^{10}$ group); the dashed line to Q is absent or a bond; when the dashed line to Q is absent then Q is absent or is —O—, —NH—, —S—, —C(O)—, —C(O)O—, —OC(O)—, —C(O)N($R^4$)—, —N($R^5$)C(O)—, —S—S—, —OC(O)O—, —O—N=C($R^5$)—, —C($R^5$)=N—O—, —OC(O)N($R^5$)—, —N($R^5$)C(O)N($R^5$), —N($R^5$)C(O)O—, —C(O)S—, —C(S)O— or —C($R^5$)=N—O—C(O)—; or when the dashed line to Q is a bond then (i) b is 0 and (ii) Q and the tertiary carbon adjacent to it (C*) form a substituted or unsubstituted, mono- or bi-cyclic heterocyclic group having from 5 to 10 ring atoms (e.g., the heteroatoms in the heterocyclic group are selected from O and S, preferably O);

each occurrence of $R^5$ is, independently, H or alkyl;

X and Y are each, independently, alkylene (e.g., $C_6$-$C_8$ alkylene) or alkenylene, wherein the alkylene or alkenylene group is optionally substituted with one or two fluorine atoms at the alpha position to the $M^1$ or $M^2$ group $M^1$ and $M^2$ are each, independently, a biodegradable group (e.g., —OC(O)—, —C(O)O—, —SC(O)—, —C(O)S—, —OC(S)—, —C(S)O, —S—S—, C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

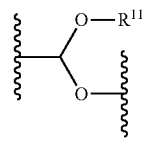

wherein $R^{11}$ is a $C_2$-$C_8$ alkyl or alkenyl;

each occurrence of $R^z$ is, independently, $C_1$-$C_8$ alkyl (e.g., methyl, ethyl, isopropyl);

a is 1, 2, 3, 4, 5 or 6;

b is 0, 1, 2, or 3; and $Z^1$ and $Z^2$ are each, independently, $C_8$-$C_{14}$ alkyl or $C_8$-$C_{14}$ alkenyl, wherein (i) the alkenyl group may optionally be substituted with one or two fluorine atoms at the alpha position to a double bond which is between the double bond and the terminus of $Z^1$ or $Z^2$;

and (ii) the terminus of at least one of $Z^1$ and $Z^2$ is separated from the group $M^1$ or $M^2$ by at least 8 carbon atoms.

In some embodiments, the lipids disclosed in US 2013/0195920 are of formula (III), which has a branching point at a position that is 2-6 carbon atoms (i.e., at the beta (β), gamma (γ), delta (δ), epsilon (ε) or zeta position (ζ) adjacent to the biodegradable group (between the biodegradable group and the terminus of the tail, i.e., $Z^1$ or $Z^2$)

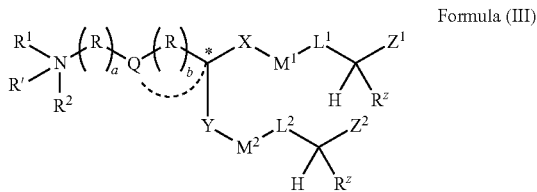

Formula (III)

or a salt thereof (e.g., a pharmaceutically acceptable salt thereof), wherein

R', $R^1$, $R^2$, R, $R^3$, $R^4$, $R^{10}$, Q, $R^5$, $M^1$, $M^2$, $R^z$, a, and b are defined as in formula (I);

$L^1$ and $L^2$ are each, independently, $C_1$-$C_5$ alkylene or $C_2$-$C_5$ alkenylene;

X and Y are each, independently, alkylene (e.g., $C_4$ to $C_{20}$ alkylene or $C_6$-$C_8$ alkylene) or alkenylene (e.g., $C_4$ to $C_{20}$ alkenylene); and $Z^1$ and $Z^2$ are each, independently, $C_8$-$C_{14}$ alkyl or $C_8$-$C_{14}$ alkenyl, wherein the alkenyl group may optionally be substituted with one or two fluorine atoms at the alpha position to a double bond which is between the double bond and the terminus of $Z^1$ or $Z^2$.

and with the proviso that the terminus of at least one of $Z^1$ and $Z^2$ is separated from the group $M^1$ or $M^2$ by at least 8 carbon atoms.

In some embodiments, the cationic lipid disclosed in US 2013/0195920 is a compound of formula (IV), which has a branching point at a position that is 2-6 carbon atoms (i.e., at beta (β), gamma (γ), delta (δ), epsilon (ε) or zeta position (ζ) adjacent to the biodegradable group (between the biodegradable group and the terminus of the tail, i.e., $Z^1$ or $Z^2$)

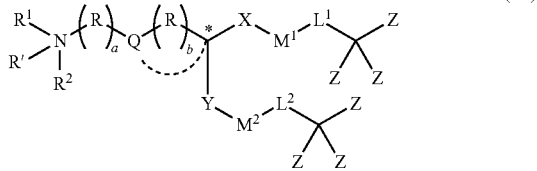

Formula (IV)

or a salt thereof (e.g., a pharmaceutically acceptable salt thereof), wherein

R', $R^1$, $R^2$, R, $R^3$, $R^4$, $R^{10}$, Q, $R^5$, $M^2$, $R^z$, a, and b are defined as in formula (I);

$L^1$ and $L^2$ and are each, independently, $C_1$-$C_5$ alkylene or $C_2$-$C_5$ alkenylene;

X and Y are each, independently, alkylene or alkenylene (e.g., $C_{12}$-$C_{20}$ alkylene or $C_{12}$-$C_{20}$ alkenylene); and each occurrence of Z is independently $C_1$-$C_4$ alkyl (preferably, methyl).

For example, in some embodiments, -$L^1$-C(Z)$_3$ is —CH$_2$C(CH$_3$)$_3$. In some embodiments, -$L^1$-C(Z)$_3$ is —CH$_2$CH$_2$C(CH$_3$)$_3$.

In some embodiments, the lipids disclosed in US 2013/0195920 are of formula (V), which has an alkoxy or thioalkoxy (i.e., —S-alkyl) group substitution on at least one tail:

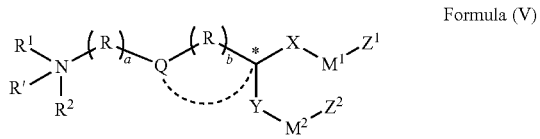

Formula (V)

or a salt thereof (e.g., a pharmaceutically acceptable salt thereof), wherein

R', $R^1$, $R^2$, R, $R^3$, $R^4$, $R^{10}$, Q, $R^5$, $M^1$, $M^2$, a, and b are defined as in formula (I);

X and Y are each, independently, alkylene (e.g., $C_6$-$C_8$ alkylene) or alkenylene, wherein the alkylene or alkenylene group is optionally substituted with one or two fluorine atoms at the alpha position to the $M^1$ or $M^2$ group;

$Z^1$ and $Z^2$ are each, independently, $C_8$-$C_{14}$ alkyl or $C_8$-$C_{14}$ alkenyl, wherein (i) the $C_8$-$C_{14}$ alkyl or $C_8$-$C_{14}$ alkenyl of at least one of $Z^1$ and $Z^2$ is substituted by one or more alkoxy (e.g., a $C_1$-$C_4$ alkoxy such as —OCH$_3$) or thioalkoxy (e.g., a $C_1$-$C_4$ thioalkoxy such as —SCH$_3$) groups, and (ii) the alkenyl group may optionally be substituted with one or two fluorine atoms at the alpha position to a double bond which is between the double bond and the terminus of $Z^1$ or $Z^2$.

In some embodiments, the lipids disclosed in US 2013/0195920 are of formula (VIA), which has one or more fluoro substituents on at least one tail at a position that is either alpha to a double bond or alpha to a biodegradable group:

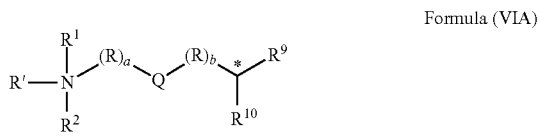

Formula (VIA)

or a salt thereof (e.g., a pharmaceutically acceptable salt thereof), wherein $R^1$, $R^2$, R, a, and b are as defined with respect to formula (I);

Q is absent or is —O—, —NH—, —S—, —C(O)—, —C(O)O—, —OC(O)—, —C(O)N($R^4$)—, —N($R^5$)C(O)—, —S—S—, —OC(O)O—, —O—N=C($R^5$)—, —C($R^5$)=N—O—, —OC(O)N($R^5$)—, —N($R^5$)C(O)N($R^5$)—, —N($R^5$)C(O)O—, —C(O)S—, —C(S)O— or —C($R^5$)=N—O—C(O)—;

R' is absent, hydrogen, or alkyl (e.g., $C_1$-$C_4$ alkyl); and each of $R^9$ and $R^{10}$ are independently $C_{12}$-$C_{24}$ alkyl (e.g., $C_{12}$-$C_{20}$ alkyl), $C_{12}$-$C_{24}$ alkenyl (e.g., $C_{12}$-$C_{20}$ alkenyl), or $C_{12}$-$C_{24}$ alkoxy (e.g., $C_{12}$-$C_{20}$ alkoxy) (a) having one or more biodegradable groups and (b) optionally substituted with one or more fluorine atoms at a position which is (i) alpha to a biodegradable group and between the biodegradable group and the tertiary carbon atom CLEAN with an asterisk (*), or (ii) alpha to a carbon-carbon double bond and between the double bond and the terminus of the $R^9$ or $R^{10}$ group; each biodegradable group independently interrupts the $C_{12}$-

C$_{24}$ alkyl, alkenyl, or alkoxy group or is substituted at the terminus of the C$_{12}$-C$_{24}$ alkyl, alkenyl, or alkoxy group, wherein
(i) at least one of R$^9$ and R$^{10}$ contains a fluoro group;
(ii) the compound does not contain the following moiety:

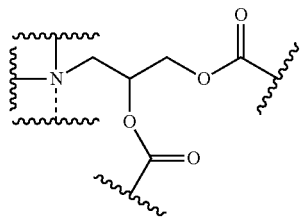

wherein - - - - is an optional bond; and
(iii) the terminus of R$^9$ and R$^{10}$ is separated from the tertiary carbon atom CLEAN with an asterisk (*) by a chain of 8 or more atoms (e.g., 12 or 14 or more atoms).

In some embodiments, the terminus of R$^9$ and R$^{10}$ is separated from the tertiary carbon atom CLEAN with an asterisk (*) by a chain of 18-22 carbon atoms (e.g., 18-20 carbon atoms).

In some embodiments, the lipids disclosed in US 2013/0195920 are of formula (VIB), which has one or more fluoro substituents on at least one tail at a position that is either alpha to a double bond or alpha to a biodegradable group:

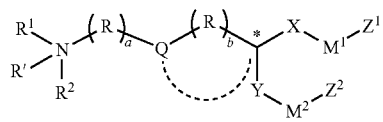
Formula (VIB)

or a salt thereof (e.g., a pharmaceutically acceptable salt thereof), wherein
R', R$^1$, R$^2$, R, R$^3$, R$^4$, R$^{10}$, Q, R$^5$, M$^1$, M$^2$, a, and b are defined as in formula (I);
X and Y are each, independently, alkylene (e.g., C$_6$-C$_8$ alkylene) or alkenylene, wherein the alkylene or alkenylene group is optionally substituted with one or two fluorine atoms at the alpha position to the M$^1$ or M$^2$ group; and
Z$^1$ and Z$^2$ are each, independently, C$_8$-C$_{14}$ alkyl or C$_8$-C$_{14}$ alkenyl, wherein said C$_8$-C$_{14}$ alkenyl is optionally substituted by one or more fluorine atoms at a position that is alpha to a double bond, wherein at least one of X, Y, Z$^1$, and Z$^2$ contains a fluorine atom.

In some embodiments, the lipids disclosed in US 2013/0195920 are of formula (VII), which has an acetal group as a biodegradable group in at least one tail:

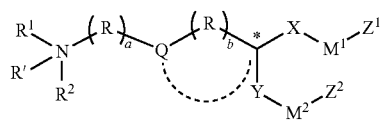
Formula (VII)

or a salt thereof (e.g., a pharmaceutically acceptable salt thereof), wherein
R', R$^1$, R$^2$, R, R$^3$, R$^4$, R$^{10}$, Q, R$^5$, a, and b are defined as in formula (I);
X and Y are each, independently, alkylene (e.g., C$_6$-C$_8$ alkylene) or alkenylene, wherein the alkylene or alkenylene group is optionally substituted with one or two fluorine atoms at the alpha position to the M$^1$ or M$^2$ group M$^1$ and M$^2$ are each, independently, a biodegradable group (e.g., —OC(O)—, —C(O)O—, —SC(O)—, —C(O)S—, —OC(S)—, —C(S)O, —S—S—, C(R$^5$)=N—, —N=C(R$^5$)—, —C(R$^5$)=N—O—, —O—N=C(R$^5$)—, —C(O)(NR$^5$)—, —N(R$^5$)C(O)—, —C(S)(NR$^5$), N(R$^5$)C(O)—, —N(R$^5$)C(O)N(R$^5$)—, —OC(O)O—, —OSi(R$^5$)$_2$O—, —C(O)(CR$^3$R$^4$)C(O)O—, —OC(O)(CR$^3$R$^4$)C(O)—, or

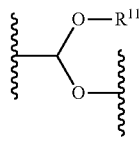

wherein R$^{11}$ is a C$_4$-C$_{10}$ alkyl or C$_4$-C$_{10}$ alkenyl;
with the proviso that at least one of M$^1$ and M$^2$ is

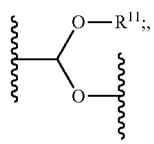

and
Z$^1$ and Z$^2$ are each, independently, C$_4$-C$_{14}$ alkyl or C$_4$-C$_{14}$ alkenyl, wherein the alkenyl group may optionally be substituted with one or two fluorine atoms at the alpha position to a double bond which is between the double bond and the terminus of Z$^1$ or Z$^2$.

In some embodiments, an LNP described herein comprises a lipid, e.g., an ionizable lipid, disclosed in US 2015/0005363, which is incorporated herein by reference in its entirety.

In some embodiments, an LNP described herein comprises a lipid, e.g., an ionizable lipid, disclosed in US 2014/0308304, which is incorporated herein by reference in its entirety.

In some embodiments, the lipid disclosed in US 2014/0308304 is a compound of formula (I):

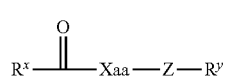
(I)

or a salt thereof (e.g., a pharmaceutically acceptable salt thereof), wherein
Xaa is a D- or L-amino acid residue having the formula —NR$^N$—CR$^1$R$^2$—(C=O)—, or a peptide of amino acid residues having the formula —{NR$^N$—CR$^1$R$^2$—(C=O)}$_n$+, wherein n is 2 to 20;
R$^1$ is independently, for each occurrence, a non-hydrogen, substituted or unsubstituted side chain of an amino acid;
R$^2$ and R$^N$ are independently, for each occurrence, hydrogen, an organic group consisting of carbon, oxygen, nitrogen, sulfur, and hydrogen atoms, or any combination of the foregoing, and having from 1 to 20 carbon atoms, $C_{(1-5)}$alkyl, cycloalkyl, cycloalkylalkyl, $C_{(3-5)}$alkenyl, $C_{(3-5)}$alkynyl, $C_{(1-5)}$alkanoyl, $C_{(1-5)}$alkanoyloxy, $C_{(1-5)}$alkoxy, $C_{(1-5)}$alkoxy-$C_{(1-5)}$alkyl, $C_{(1-5)}$alkoxy-$C_{(1-5)}$alkoxy, $C_{(1-5)}$alkyl-amino-$C_{(1-5)}$alkyl-, $C_{(1-5)}$dialkyl-amino-$C_{(1-5)}$alkyl-, nitro-$C_{(1-5)}$alkyl, cyano-$C_{(1-5)}$alkyl, aryl-$C_{(1-5)}$alkyl, 4-biphenyl-$C_{(1-5)}$alkyl, carboxyl, or hydroxyl;

Z is NH, O, S, —$CH_2S$—, —$CH_2S(O)$—, or an organic linker consisting of 1-40 atoms selected from hydrogen, carbon, oxygen, nitrogen, and sulfur atoms (preferably, Z is NH or O);

$R^x$ and $R^y$ are, independently, (i) a lipophilic tail derived from a lipid (which can be naturally-occurring or synthetic), phospholipid, glycolipid, triacylglycerol, glycerophospholipid, sphingolipid, ceramide, sphingomyelin, cerebroside, or ganglioside, wherein the tail optionally includes a steroid; (ii) an amino acid terminal group selected from hydrogen, hydroxyl, amino, and an organic protecting group; or (iii) a substituted or unsubstituted $C_{(3-22)}$alkyl, $C_{(6-12)}$cycloalkyl, $C_{(6-12)}$cycloalkyl-$C_{(3-22)}$alkyl, $C_{(3-22)}$alkenyl, $C_{(3-22)}$alkynyl, $C_{(3-22)}$alkoxy, or $C_{(6-12)}$-alkoxy-$C_{(3-22)}$alkyl;

one of $R^x$ and $R^y$ is a lipophilic tail as defined above and the other is an amino acid terminal group, or both $R^x$ and $R^y$ are lipophilic tails;

at least one of $R^x$ and $R^y$ is interrupted by one or more biodegradable groups (e.g., —OC(O)—, —C(O)O—, —SC(O)—, —C(O)S—, —OC(S)—, —C(S)O—, —S—S—, —C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)— or

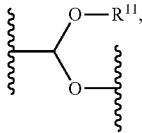

(wherein $R^{11}$ is a $C_2$-$C_8$ alkyl or alkenyl), in which each occurrence of $R^5$ is, independently, H or alkyl; and each occurrence of $R^3$ and $R^4$ are, independently H, halogen, OH, alkyl, alkoxy, —$NH_2$, alkylamino, or dialkylamino; or $R^3$ and $R^4$, together with the carbon atom to which they are directly attached, form a cycloalkyl group (in some embodiments, each occurrence of $R^3$ and $R^4$ are, independently H or $C_1$-$C_4$ alkyl)); and $R^x$ and $R^y$ each, independently, optionally have one or more carbon-carbon double bonds.

In some embodiments, the lipid disclosed in US 2014/0308304 is a compound of formula (IA):

or a salt thereof (e.g., a pharmaceutically acceptable salt thereof), wherein Z and Xaa are as defined with respect to formula (I) (the variables which are used in the definition of Xaa, namely $R^N$, $R^1$ and $R^2$, are also as defined in formula (I));

each occurrence of R is, independently, —(C$R^3R^4$)—;

each occurrence of $R^3$ and $R^4$ are, independently H, halogen, OH, alkyl, alkoxy, —$NH_2$, alkylamino, or dialkylamino (in some embodiments, each occurrence of $R^3$ and $R^4$ are, independently H or $C_1$-$C_4$ alkyl);

or $R^3$ and $R^4$, together with the carbon atom to which they are directly attached, form a cycloalkyl group, wherein no more than three R groups in each chain between the Z-Xaa-C(O) and $Z^2$ moieties are cycloalkyl (e.g., cyclopropyl);

$Q^1$ and $Q^2$ are each, independently, absent, —O—, —S—, —OC(O)—, —C(O)O—, —SC(O)—, —C(O)S—, —OC(S)—, —C(S)O—, —S—S—, —C(O)(N$R^5$)—, —N($R^5$)C(O)—, —C(S)(N$R^5$)—, —N($R^5$)C(O)—, —N($R^5$)C(O)N($R^5$)—, or —OC(O)O—;

$Q^3$ and $Q^4$ are each, independently, H, —(C$R^3R^4$)—, cycloalkyl, heterocyclyl, heterocyclylalkyl, aryl, heteroaryl, or a cholesterol moiety;

each occurrence of $A^1$, $A^2$, $A^3$ and $A^4$ is, independently, —(C$R^5R^5$—C$R^5$=C$R^5$)—;

$M^1$ and $M^2$ are each, independently, a biodegradable group (e.g., —OC(O)—, —C(O)O—, —SC(O)—, —C(O)S—, —OC(S)—, —C(S)O—, —S—S—, —C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

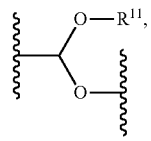

(wherein $R^{11}$ is a $C_2$-$C_8$ alkyl or alkenyl));

each occurrence of $R^5$ is, independently, H or alkyl (e.g., $C_1$-$C_4$ alkyl);

$Z^2$ is absent, alkylene or —O—P(O)(OH)O—;

each ----- attached to $Z^2$ is an optional bond, such that when $Z^2$ is absent, $Q^3$ and $Q^4$ are not directly covalently bound together;

c, d, e, f, i, j, m, n, q and r are each, independently, 0, 1, 2, 3, 4, 5, 6, 7, 8, 9, or 10;

g and h are each, independently, 0, 1 or 2;

k and l are each, independently, 0 or 1, wherein at least one of k and l is 1;

and p are each, independently, 0, 1 or 2; and

Formula (IA)

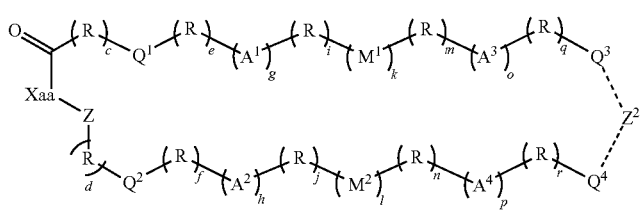

$Q^3$ and $Q^4$ are each, independently, separated from the —Z-Xaa-C(O)+ moiety by a chain of 8 or more atoms (e.g., 12 or 14 or more atoms).

In some embodiments the lipids disclosed in US 2014/0308304 are of the formula (IC):

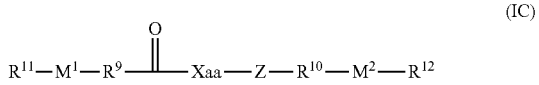

(IC)

or a salt thereof (e.g., a pharmaceutically acceptable salt thereof), wherein
Z and Xaa are as defined with respect to formula (I) (the variables which are used in the definition of Xaa, namely $R^N$, $R^1$ and $R^2$, are also as defined in formula (I));
each of $R^9$ and $R^{10}$ are, independently, alkylene or alkenylene;
each of $R^{11}$ and $R^{12}$ are, independently, alkyl or alkenyl, optionally terminated by $COOR^{13}$ wherein each $R^{13}$ is independently unsubstituted alkyl (e.g., $C_1$-$C_4$ alkyl such as methyl or ethyl), substituted alkyl (such as benzyl), or cycloalkyl;
$M^1$ and $M^2$ are each, independently, a biodegradable group (e.g., —OC(O)—, —C(O)O—, —SC(O)—, —C(O)S—, —OC(S)—, —C(S)O—, —S—S—, —C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

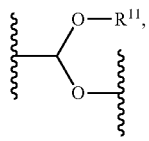

wherein $R^{11}$ is a $C_2$-$C_8$ alkyl or alkenyl, in which each occurrence of $R^5$ is, independently, H or alkyl; and each occurrence of $R^3$ and $R^4$ are, independently H, halogen, OH, alkyl, alkoxy, —NH$_2$, alkylamino, or dialkylamino; or $R^3$ and $R^4$, together with the carbon atom to which they are directly attached, form a cycloalkyl group (in some embodiments, each occurrence of $R^3$ and $R^4$ are, independently H or $C_1$-$C_4$ alkyl));
$R^9$, $M^1$, and $R^{11}$ are together at least 8 carbon atoms in length (e.g., 12 or 14 carbon atoms or longer); and
$R^{10}$, $M^2$, and $R^{12}$ are together at least 8 carbon atoms in length (e.g., 12 or 14 carbon atoms or longer).

In some embodiments, the lipid disclosed in US 2014/0308304 is a compound of the formula II:

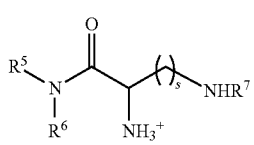

(II)

or a salt thereof (e.g., a pharmaceutically acceptable salt thereof), wherein:
s is 1, 2, 3 or 4; and
$R^7$ is selected from lysyl, ornithyl, 2,3-diaminobutyryl, histidyl and an acyl moiety of the formula:

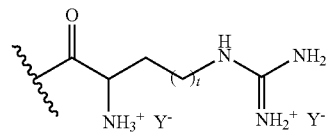

t is 1, 2 or 3;
the NH$_3^+$ moiety in the acyl moiety in $R^7$ is optionally absent;
each occurrence of Y$^-$ is independently a pharmaceutically acceptable anion (e.g., halide, such as chloride);
$R^5$ and $R^6$ are each, independently a lipophilic tail derived from a naturally-occurring or synthetic lipid, phospholipid, glycolipid, triacylglycerol, glycerophospholipid, sphingolipid, ceramide, sphingomyelin, cerebroside, or ganglioside, wherein the tail may contain a steroid; or a substituted or unsubstituted $C_{(3-22)}$alkyl, $C_{(6-12)}$cycloalkyl, $C_{(6-12)}$cycloalkyl-$C_{(3-22)}$alkyl, $C_{(3-22)}$alkenyl, $C_{(3-22)}$alkynyl, $C_{(3-22)}$alkoxy, or $C_{(6-12)}$alkoxy-$C_{(3-22)}$alkyl;
at least one of $R^5$ and $R^6$ is interrupted by one or more biodegradable groups (e.g., —SC(O)—, —C(O)S—, —OC(S)—, —C(S)O—, —S—S—, —C(O)(N$R^a$)—, —N($R^a$)C(O)—, —C(S)(N$R^a$)—, —N($R^a$)C(O)—, —N($R^a$)C(O)N($R^a$)—, or —OC(O)O—);
each occurrence of $R^a$ is, independently, H or alkyl; and
$R^5$ and $R^6$ each, independently, optionally contain one or more carbon-carbon double bonds.

In some embodiments, the lipids disclosed in US 2014/0308304 are of the formula (IIA):

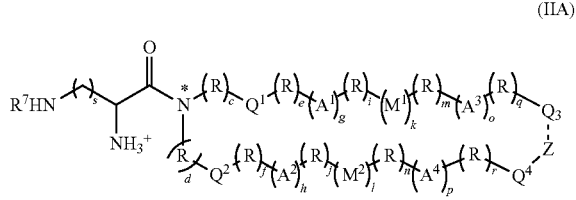

(IIA)

or a salt thereof (e.g., a pharmaceutically acceptable salt thereof), wherein:
$R^7$ and s are as defined with respect to formula (II);
each occurrence of R is, independently, —(C$R^3R^4$)—;
each occurrence of $R^3$ and $R^4$ are, independently, H, halogen, OH, alkyl, alkoxy, —NH$_2$, alkylamino, or dialkylamino (in some embodiments, each occurrence of $R^3$ and $R^4$ are, independently H or $C_1$-$C_4$ alkyl);
or $R^3$ and $R^4$, together with the carbon atom to which they are directly attached, form a cycloalkyl group, wherein no more than three R groups in each chain attached to the nitrogen N* are cycloalkyl (e.g., cyclopropyl);
$Q^1$ and $Q^2$ are each, independently, absent, —O—, —S—, —OC(O)—, —C(O)O—, —SC(O)—, —C(O)S—, —OC(S)—, —C(S)O—, —S—S—, —C(O)(N$R^5$)—, —N($R^5$)C(O)—, —C(S)(N$R^5$)—, —N($R^5$)C(O)—, —N($R^5$)C(O)N($R^5$)—, or —OC(O)O—;
$Q^3$ and $Q^4$ are each, independently, H, —(C$R^3R^4$)—, aryl, cycloalkyl, heterocyclyl, heterocyclylalkyl, heteroaryl, or a cholesterol moiety;

each occurrence of $A^1$, $A^2$, $A^3$ and $A^4$ is, independently, —$(CR^5R^5$—$CR^5$=$CR^5)$—;

$M^1$ and $M^2$ are each, independently, a biodegradable group (e.g., —OC(O)—, —C(O)O—, —SC(O)—, —C(O)S—, —OC(S)—, —C(S)O—, —S—S—, —C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

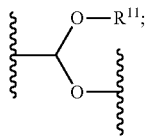

wherein $R^{11}$ is a $C_2$-$C_8$ alkyl or alkenyl;

each occurrence of $R^5$ is, independently, H or alkyl;

Z is absent, alkylene or —O—P(O)(OH)O—;

each ----- attached to Z is an optional bond, such that when Z is absent, $Q^3$ and $Q^4$ are not directly covalently bound together;

c, d, e, f, i, j, m, n, q and r are each, independently, 0, 1, 2, 3, 4, 5, 6, 7, 8, 9, or 10;

g and h are each, independently, 0, 1 or 2;

k and l are each, independently, 0 or 1, where at least one of k and l is 1; and and p are each, independently, 0, 1 or 2.

In some embodiments the lipid disclosed in US 2014/0308304 are of the formula (IIC):

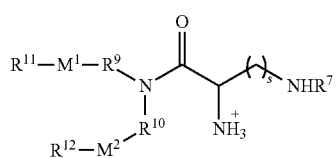

(IIC)

or a salt thereof (e.g., a pharmaceutically acceptable salt thereof), wherein:

$R^7$ and s are as defined with respect to formula (II);

each of $R^9$ and $R^{10}$ are independently alkyl (e.g., $C_{12}$-$C_{24}$ alkyl) or alkenyl (e.g., $C_{12}$-$C_{24}$ alkenyl);

each of R" and $R^{12}$ are independently alkyl or alkenyl, optionally terminated by COO$R^{13}$ where each $R^{13}$ is independently alkyl (e.g., $C_1$-$C_4$ alkyl such as methyl or ethyl);

$M^1$ and $M^2$ are each, independently, a biodegradable group (e.g., —OC(O)—, —C(O)O—, —SC(O)—, —C(O)S—, —OC(S)—, —C(S)O—, —S—S—, —C($R^5$)=N—, —N=C($R^5$)—, —C($R^5$)=N—O—, —O—N=C($R^5$)—, —C(O)(N$R^5$)—, —N($R^5$)C(O)—, —C(S)(N$R^5$)—, —N($R^5$)C(O)—, —N($R^5$)C(O)N($R^5$)—, —OC(O)O—, —OSi($R^5$)$_2$O—, —C(O)(C$R^3R^4$)C(O)O—, —OC(O)(C$R^3R^4$)C(O)—, or

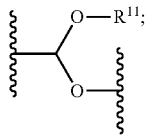

wherein $R^{11}$ is a $C_2$-$C_8$ alkyl or alkenyl;

in which each occurrence of $R^5$ is, independently, H or alkyl; and each occurrence of $R^3$ and $R^4$ are, independently H, halogen, OH, alkyl, alkoxy, —NH$_2$, alkylamino, or dialkylamino; or $R^3$ and $R^4$, together with the carbon atom to which they are directly attached, form a cycloalkyl group (in some embodiments, each occurrence of $R^3$ and $R^4$ are, independently, H or $C_1$-$C_4$ alkyl));

$R^9$, $M^1$, and $R^{11}$ are together at least 8 carbons atoms in length (e.g., 12 or 14 carbon atoms or longer); and $R^{10}$, $M^2$, and $R^{12}$ are together at least 8 carbons atoms in length (e.g., 12 or 14 carbon atoms or longer).

In some embodiments, the lipid disclosed in US 2014/0308304 is a compound of the formula (4):

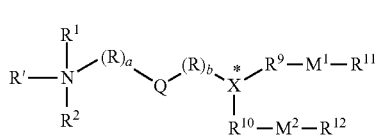

Formula (4)

wherein:

X is N or P;

$R^1$, $R^2$, R, a, b, $M^1$, and $M^2$ are as defined with respect to formula (I);

Q is absent or is —O—, —NH—, —S—, —C(O)O—, —OC(O)—, —C(O)N($R^4$)—, —N($R^5$)C(O)—, —S—S—, —OC(O)O—, —O—N=C($R^5$)—, —C($R^5$)=N—O—, —OC(O)N($R^5$)—, —N($R^5$)C(O)N($R^5$)—, —N($R^5$)C(O)O—, —C(O)S—, —C(S)O— or —C($R^5$)=N—O—C(O)—;

R' is absent, hydrogen, or alkyl (e.g., $C_1$-$C_4$ alkyl);

each of $R^9$ and $R^{10}$ are independently alkylene, or alkenylene; and each of $R^{11}$ and $R^{12}$ are independently alkyl or alkenyl, optionally terminated by COO$R^{13}$ where each $R^{13}$ is independently alkyl (e.g., $C_1$-$C_4$ alkyl such as methyl or ethyl);

$R^9$, $M^1$, and $R^{11}$ are together at least 8 carbons atoms in length (e.g., 12 or 14 carbon atoms or longer); and $R^{10}$, $M^2$, and $R^{12}$ are together at least 8 carbons atoms in length (e.g., 12 or 14 carbon atoms or longer).

In some embodiments, the lipid disclosed in US 2014/0308304 is a compound of the formula (5)

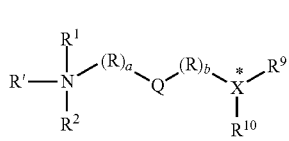

Formula (5)

wherein:

X is N or P;

$R^1$, $R^2$, R, a, and b are as defined with respect to formula (I);

Q is absent or is —O—, —NH—, —S—, —C(O)O—, —OC(O)—, —C(O)N($R^4$)—, —N($R^5$)C(O)—, —S—S—, —OC(O)O—, —O—N=C($R^5$)—, —C($R^5$)=N—O—, —OC(O)N($R^5$)—, —N($R^5$)C(O)N($R^5$)—, —N($R^5$)C(O)O—, —C(O)S—, —C(S)O— or —C($R^5$)=N—O—C(O)—; R' is absent, hydrogen, or alkyl (e.g., $C_1$-$C_4$ alkyl);

each of $R^9$ and $R^{10}$ are independently $C_{12}$-$C_{24}$ alkyl or alkenyl substituted at its terminus with a biodegradable group, such as $COOR^{13}$ where each $R^{13}$ is independently alkyl (preferably $C_1$-$C_4$ alkyl such as methyl or ethyl).

In some embodiments the lipids disclosed in US 2014/0308304 are of Formula A:

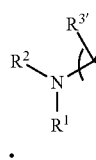

Formula A or a pharmaceutically acceptable salt or stereoisomer thereof, wherein:
- n is 0-6 (e.g., n is 0, 1 or 2);
- $R^1$ and $R^2$ are independently selected from H, ($C_1$-$C_6$) alkyl, heterocyclyl, and a polyamine, wherein said alkyl, heterocyclyl and polyamine are optionally substituted with one or more substituents selected from R', or $R^1$ and $R^2$ can be taken together with the nitrogen to which they are attached to form a monocyclic heterocycle with 3-7 (e.g., 4-7) members optionally containing, in addition to the nitrogen, one or two additional heteroatoms selected from N, O and S, said monocyclic heterocycle is optionally substituted with one or more substituents selected from R';
- $R^3$ is selected from H and ($C_1$-$C_6$)alkyl, wherein said alkyl is optionally substituted with one or more substituents selected from R', or $R^3$ can be taken together with $R^1$ to form a monocyclic heterocycle with 3-7 (e.g., 4-7) members optionally containing, in addition to the nitrogen, one or two additional heteroatoms selected from N, O and S, said monocyclic heterocycle is optionally substituted with one or more substituents selected from R';
- each occurrence of $R^4$, $R^{3'}$ and $R^{4'}$ is independently selected from H, ($C_1$-$C_6$)alkyl and O-alkyl, said alkyl is optionally substituted with one or more substituents selected from R'; or $R^{3'}$ and $R^{4'}$ when directly bound to the same carbon atom form an oxo (=O) group, cyclopropyl or cyclobutyl;
- or $R^3$ and $R^4$ form an oxo (=O) group;
- $R^5$ is selected from H and ($C_1$-$C_6$)alkyl; or $R^5$ can be taken together with $R^1$ to form a monocyclic heterocycle with 4-7 members optionally containing, in addition to the nitrogen, one or two additional heteroatoms selected from N, O and S, said monocyclic heterocycle is optionally substituted with one or more substituents selected from R';
- each occurrence of R' is independently selected from halogen, R", OR", SR", CN, $CO_2R"$ and $CON(R")_2$;
- each occurrence of R" is selected from H and ($C_1$-$C_6$) alkyl, wherein said alkyl is optionally substituted with one or more substituents selected from halogen and OH;
- $L^1$ is a $C_4$-$C_{22}$ alkyl or $C_4$-$C_{22}$ alkenyl, said alkyl or alkenyl is optionally interrupted by or terminated with one or more biodegradable groups; and said alkyl or alkenyl is optionally substituted with one or more substituents selected from R'; and
- $L^2$ is a $C_4$-$C_{22}$ alkyl or $C_4$-$C_{22}$ alkenyl, said alkyl or alkenyl is optionally interrupted by or terminated with one or more biodegradable groups; and said alkyl or alkenyl is optionally substituted with one or more substituents selected from R'; with the proviso that the $CR^{3'}R^{4'}$ group when present adjacent to the nitrogen atom in formula A is not a ketone (—C(O)—).

In some embodiments the lipids disclosed in US 2014/0308304 are of formula B:

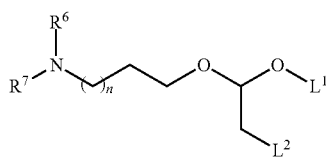

Formula B or a pharmaceutically acceptable salt or stereoisomer thereof, wherein:
- n is 0, 1, 2, 3, 4, or 5;
- $R^6$ and $R^7$ are each independently (i) $C_1$-$C_4$ linear or branched alkyl (e.g., methyl or ethyl) optionally substituted with 1-4 R', or (ii) $C_3$-$C_8$ cycloalkyl (e.g., $C_3$-$C_6$ cycloalkyl); or $R^6$ and $R^7$ together with the nitrogen atom adjacent to them form a 3-6 membered ring;
- $L^1$ is a $C_4$-$C_{22}$ alkyl or $C_4$-$C_{22}$ alkenyl, said alkyl or alkenyl optionally interrupted by or terminated with one or more biodegradable groups; and said alkyl or alkenyl is optionally substituted with 1-5 substituents selected from R'; and
- $L^2$ is a $C_4$-$C_{22}$ alkyl or $C_4$-$C_{22}$ alkenyl, said alkyl or alkenyl optionally interrupted by or terminated with one or more biodegradable groups; and said alkyl or alkenyl is optionally substituted with 1-5 substituents selected from R';
- each occurrence of R' is independently selected from halogen, R", OR", SR", CN, $CO_2R"$ and $CON(R")_2$; and
- each occurrence of R" is independently selected from H and ($C_1$-$C_6$)alkyl, wherein said alkyl is optionally substituted with one or more substituents selected from halogen and OH.

In some embodiments, lipids disclosed in US 2014/0308304 are of formula C:

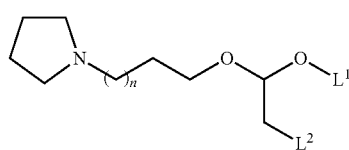

Formula C or a pharmaceutically acceptable salt or stereoisomer thereof, wherein:
- n is 0, 1, 2, 3, 4, or 5;
- $L^1$ is a $C_4$-$C_{22}$ alkyl or $C_4$-$C_{22}$ alkenyl, said alkyl or alkenyl optionally has one or more biodegradable groups; each biodegradable group independently interrupts the alkyl or alkenyl group or is substituted at the terminus of the alkyl or alkenyl group, and said alkyl or alkenyl is optionally substituted with 1-5 substituents selected from R'; and $L^2$ is a $C_4$-$C_{22}$ alkyl or $C_4$-$C_{22}$ alkenyl, said alkyl or alkenyl optionally interrupted by or terminated with one or more biodegradable groups; and said alkyl or alkenyl is optionally substituted with 1-5 substituents selected from R';

each occurrence of R' is independently selected from halogen, R", OR", SR", CN, $CO_2R"$ and $CON(R")_2$; and each occurrence of R" is independently selected from H and ($C_1$-$C_6$)alkyl, wherein said alkyl is optionally substituted with one or more substituents selected from halogen and OH.

In some embodiments, the lipid disclosed in US 2014/0308304 are of formula D:

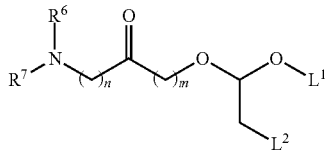

Formula D or a pharmaceutically acceptable salt or stereoisomer thereof, wherein m is 0, 1, 2, or 3;

n is 0, 1, 2, 3, 4, or 5;

$R^6$ and $R^7$ are each independently (i) $C_1$-$C_4$ linear or branched alkyl (e.g., methyl or ethyl) optionally substituted with 1-4 R', or (ii) $C_3$-$C_8$ cycloalkyl (e.g., $C_3$-$C_6$ cycloalkyl); or $R^6$ and $R^7$ together with the nitrogen atom adjacent to them form a 3-6 membered ring;

$L^1$ is a $C_4$-$C_{22}$ alkyl or $C_4$-$C_{22}$ alkenyl, said alkyl or alkenyl optionally interrupted by or terminated with one or more biodegradable groups; and said alkyl or alkenyl is optionally substituted with 1-5 substituents selected from R'; and $L^2$ is a $C_4$-$C_{22}$ alkyl or $C_4$-$C_{22}$ alkenyl, said alkyl or alkenyl optionally interrupted by or terminated with one or more biodegradable groups; and said alkyl or alkenyl is optionally substituted with 1-5 substituents selected from R';

each occurrence of R' is independently selected from halogen, R", OR", SR", CN, $CO_2R"$ and $CON(R")_2$; and each occurrence of R" is independently selected from H and ($C_1$-$C_6$)alkyl, wherein said alkyl is optionally substituted with one or more substituents selected from halogen and OH.

In some embodiments lipid disclosed in US 2014/0308304 are of formula E:

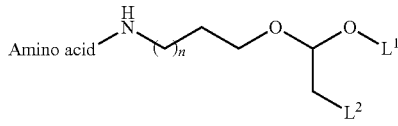

Formula E or a pharmaceutically acceptable salt or stereoisomer thereof, wherein n is 0, 1, 2, 3, 4, or 5;

the group "amino acid" is an amino acid residue;

$L^1$ is a $C_4$-$C_{22}$ alkyl or $C_4$-$C_{22}$ alkenyl, said alkyl or alkenyl optionally interrupted by or terminated with one or more biodegradable groups, and said alkyl or alkenyl is optionally substituted with 1-5 substituents selected from R'; and $L^2$ is a $C_4$-$C_{22}$ alkyl or $C_4$-$C_{22}$ alkenyl, said alkyl or alkenyl optionally interrupted by or terminated with one or more biodegradable groups, and said alkyl or alkenyl is optionally substituted with 1-5 substituents selected from R';

each occurrence of R' is independently selected from halogen, R", OR", SR", CN, $CO_2R"$ and $CON(R")_2$; and each occurrence of R" is independently selected from H and ($C_1$-$C_6$)alkyl, wherein said alkyl is optionally substituted with one or more substituents selected from halogen and OH.

The amino acid residue in formula E may have the formula —C(O)—C($R^9$)($NH_2$), where $R^9$ is an amino acid side chain.

In some embodiments, the lipid disclosed in US 2014/0308304 are of formula F:

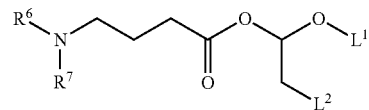

Formula F or a pharmaceutically acceptable salt or stereoisomer thereof, wherein:

$R^6$ and $R^7$ are independently (i) $C_1$-$C_4$ linear or branched alkyl (e.g., methyl or ethyl) optionally substituted with 1-4 R', or (ii) $C_3$-$C_8$ cycloalkyl (e.g., $C_3$-$C_6$ cycloalkyl); or $R^6$ and $R^7$ together with the nitrogen atom adjacent to them form a 3-6 membered ring;

$L^1$ is a $C_4$-$C_{22}$ alkyl or $C_4$-$C_{22}$ alkenyl optionally interrupted by or terminated with one or more biodegradable groups, and said alkyl or alkenyl is optionally substituted with 1-5 substituents selected from R'; and $L^2$ is a $C_4$-$C_{22}$ alkyl or $C_4$-$C_{22}$ alkenyl optionally interrupted by or terminated with one or more biodegradable groups, and said alkyl or alkenyl is optionally substituted with 1-5 substituents selected from R';

each occurrence of R' is independently selected from halogen, R", OR", SR", CN, $CO_2R"$ and $CON(R")_2$;

each occurrence of R" is independently selected from H and ($C_1$-$C_6$)alkyl, wherein said alkyl is optionally substituted with one or more substituents selected from halogen and OH.

In some embodiments, the lipid disclosed in US 2014/0308304 are of formula G:

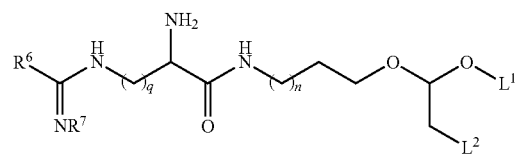

Formula G or a pharmaceutically acceptable salt or stereoisomer thereof, wherein:

n is 0, 1, 2, 3, 4, or 5;

q is 1, 2, 3, or 4

$R^6$ and $R^7$ are independently (i) $C_1$-$C_4$ linear or branched alkyl (e.g., methyl or ethyl) optionally substituted with 1-4 R', or (ii) $C_3$-$C_8$ cycloalkyl (e.g., $C_3$-$C_6$ cycloalkyl);

$L^1$ is a $C_4$-$C_{22}$ alkyl or $C_4$-$C_{22}$ alkenyl optionally interrupted by or terminated with one or more biodegradable groups, and said alkyl or alkenyl is optionally substituted with 1-5 substituents selected from R'; and $L^2$ is a $C_4$-$C_{22}$ alkyl or $C_4$-$C_{22}$ alkenyl optionally interrupted by or terminated with one or more biodegradable groups, and said alkyl or alkenyl is optionally substituted with 1-5 substituents selected from R';

each occurrence of R' is independently selected from halogen, R", OR", SR", CN, $CO_2R"$ and $CON(R")_2$;

each occurrence of R" is independently selected from H and ($C_1$-$C_6$)alkyl, wherein said alkyl is optionally substituted with one or more substituents selected from halogen and OH.

In some embodiments, an LNP described herein comprises a lipid, e.g., an ionizable lipid, disclosed in US 2013/0053572, which is incorporated herein by reference in its entirety.

In some embodiments, the lipids disclosed in US 2013/0053572 are of Formula A:

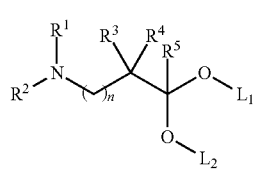

A wherein:

n is 0, 1 or 2;

$R^1$ and $R^2$ are independently selected from H, ($C_1$-$C_6$) alkyl, heterocyclyl, and a polyamine, wherein said alkyl, heterocyclyl and polyamine are optionally substituted with one or more substituents selected from R', or $R^1$, and $R^2$ can be taken together with the nitrogen to which they are attached to form a monocyclic heterocycle with 4-7 members optionally containing, in addition to the nitrogen, one or two additional heteroatoms selected from N, O and S, said monocyclic heterocycle is optionally substituted with one or more substituents selected from $R^1$;

$R^3$ is selected from H and ($C_1$-$C_6$)alkyl, wherein said alkyl is optionally substituted with one or more substituents selected from R', or $R^3$ can be taken together with $R^1$ to form a monocyclic heterocycle with 4-7 members optionally containing, in addition to the nitrogen, one or two additional heteroatoms selected from N, O and S, said monocyclic heterocycle is optionally substituted with one or more substituents selected from $R^1$;

$R^4$ is selected from H, ($C_1$-$C_6$)alkyl and O-alkyl, said alkyl is optionally substituted with one or more substituents selected from R';

$R^5$ is selected from H and ($C_1$-$C_6$)alkyl; or $R^5$ can be taken together with $R^1$ to form a monocyclic heterocycle with 4-7 members optionally containing, in addition to the nitrogen, one or two additional heteroatoms selected from N, O and S, said monocyclic heterocycle is optionally substituted with one or more substituents selected from R';

R' is independently selected from halogen, R", OR", CN, $CO_2R"$ and $CON(R")_2$;

R" is selected from H and ($C_1$-$C_6$)alkyl, wherein said alkyl is optionally substituted with one or more substituents selected from halogen and OH;

$L_1$ is a $C_4$-$C_{22}$ alkenyl, said alkenyl is optionally substituted with one or more substituents selected from R'; and $L_2$ is a $C_4$-$C_{22}$ alkenyl, said alkenyl is optionally substituted with one or more substituents selected from R';

or any pharmaceutically acceptable salt or stereoisomer thereof.

In some embodiments, an LNP described herein comprises a lipid, e.g., an ionizable lipid, disclosed in US Application publication US2017/0119904, which is incorporated by reference herein, in its entirety.

In some embodiments, an LNP described herein comprises a lipid, e.g., an ionizable lipid, disclosed in PCT Application publication WO2021/204179, which is incorporated by reference herein, in its entirety.

In some embodiments, an LNP described herein comprises a lipid, e.g., an ionizable lipid, disclosed in PCT Application PCT/US2022/031383, which is incorporated by reference herein, in its entirety.

In some embodiments, an LNP described herein comprises an ionizable lipid of Table 2:

TABLE 2

Exemplary Ionizable Lipids

| Compound # | Structure |
|---|---|
| L-1 | 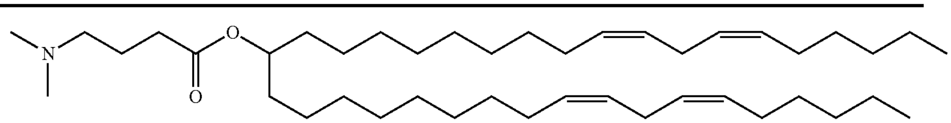 |

TABLE 2-continued

Exemplary Ionizable Lipids

| Compound # | Structure |
|---|---|
| L-2 | 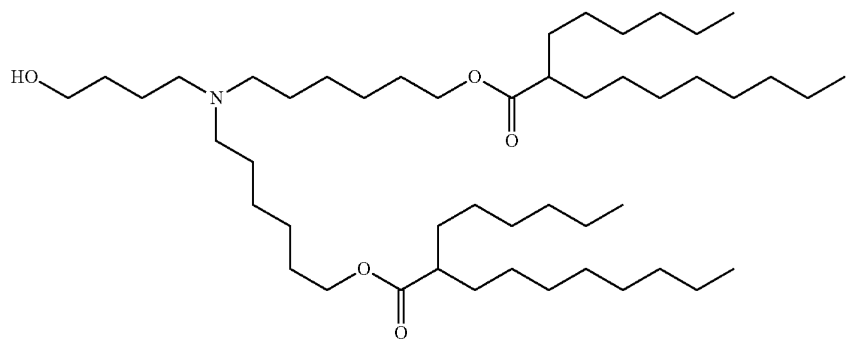 [SMILES: CCCCCCCCC(CCCCCC)C(=O)OCCCCCCN(CCCCO)CCCCCCOC(=O)C(CCCCCC)CCCCCCCC] |
| L-3 | 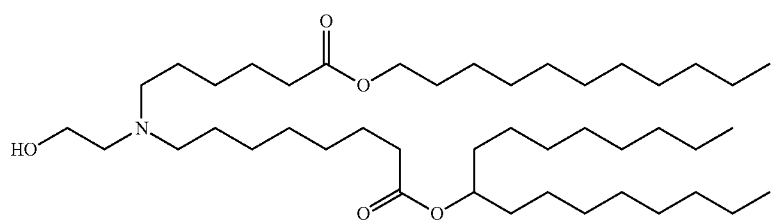 [SMILES: CCCCCCCCCCCOC(=O)CCCCCN(CCO)CCCCCCCC(=O)OC(CCCCCCCC)CCCCCCCC] |
| L-4 | 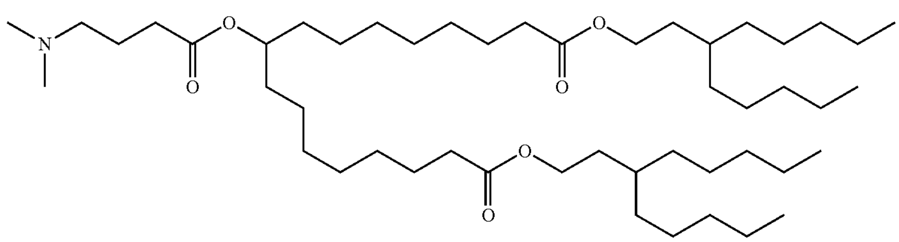 [SMILES: CCCCCC(CCCCC)CCOC(=O)CCCCCCCC(CCCCCCCC(=O)OCCC(CCCCC)CCCCC)OC(=O)CCCN(C)C] |
| L-5 | 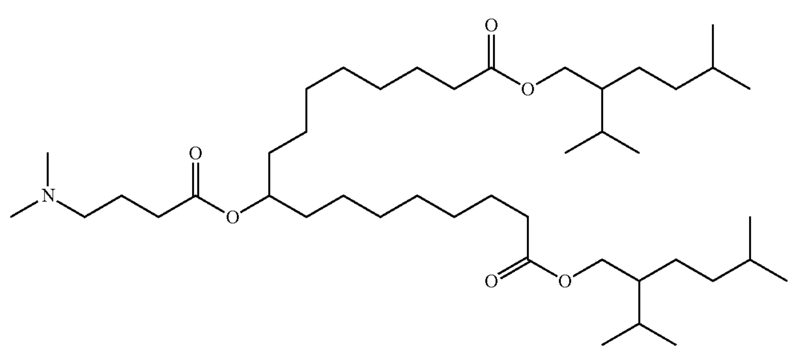 [SMILES: CC(C)CCC(COC(=O)CCCCCCCC(CCCCCCCC(=O)OCC(CCC(C)C)C(C)C)OC(=O)CCCN(C)C)C(C)C] |
| L-6 | 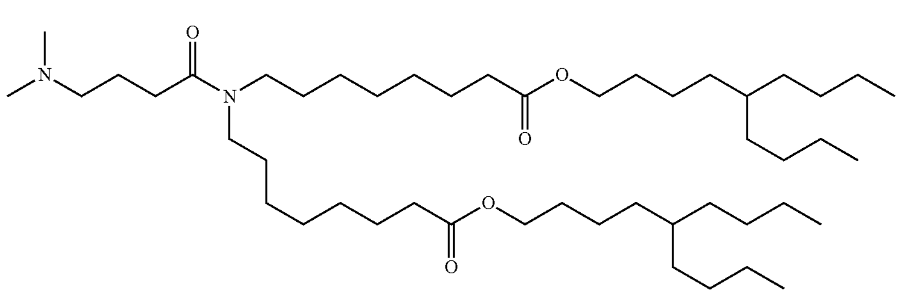 [SMILES: CCCCC(CCCC)CCCCOC(=O)CCCCCCCN(CCCCCCCC(=O)OCCCCC(CCCC)CCCC)C(=O)CCCN(C)C] |

TABLE 2-continued

Exemplary Ionizable Lipids

| Compound # | Structure |
|---|---|
| L-7 | 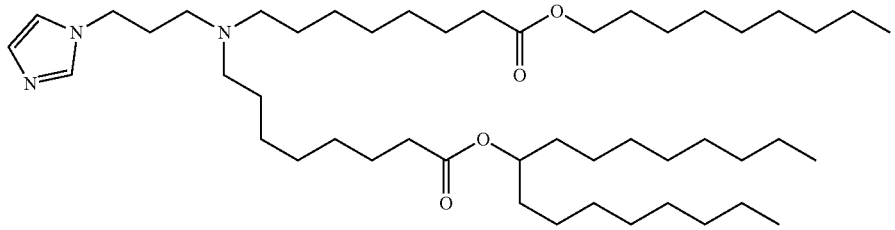 [SMILES: CCCCCCCCCOC(=O)CCCCCCCN(CCCCCCCC(=O)OC(CCCCCCCC)CCCCCCCC)CCCn1ccnc1] |
| L-8 | 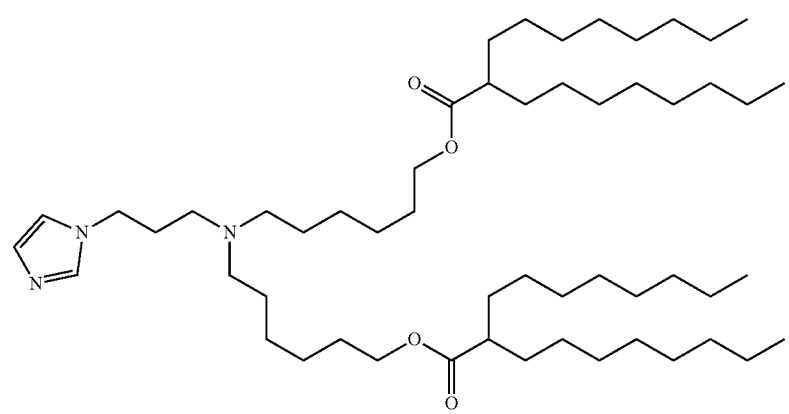 [SMILES: CCCCCCCCC(CCCCCCCC)C(=O)OCCCCCCN(CCCCCCOC(=O)C(CCCCCCCC)CCCCCCCC)CCCn1ccnc1] |
| L-9 | 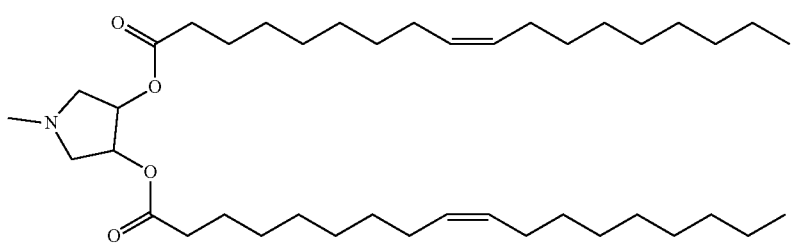 [SMILES: CCCCCCCC/C=C\CCCCCCCC(=O)OC1CN(C)CC1OC(=O)CCCCCCC/C=C\CCCCCCCC] |
| L-10 | 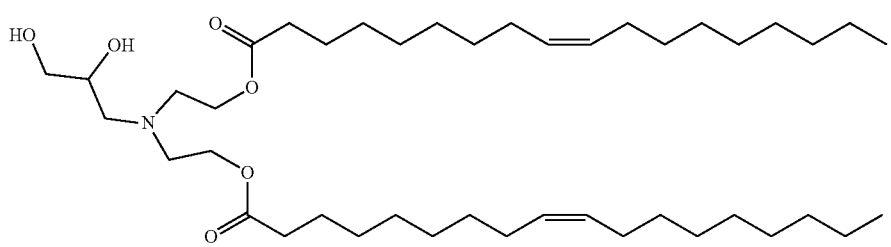 [SMILES: CCCCCCCC/C=C\CCCCCCCC(=O)OCCN(CCOC(=O)CCCCCCC/C=C\CCCCCCCC)CC(O)CO] | ii. Structural Lipids

In some embodiments, an LNP comprises a structural lipid. Structural lipids can be selected from the group consisting of, but are not limited to, cholesterol, fecosterol, fucosterol, beta sitosterol, sitosterol, ergosterol, campesterol, stigmasterol, brassicasterol, tomatidine, cholic acid, sitostanol, litocholic acid, tomatine, ursolic acid, alpha-tocopherol, and mixtures thereof. In some embodiments, the structural lipid is cholesterol. In some embodiments, the structural lipid includes cholesterol and a corticosteroid (such as prednisolone, dexamethasone, prednisone, and hydrocortisone), or any combinations thereof. In some embodiments, a structural lipid is described in international patent application WO2019152557A1, which is incorporated herein by reference in its entirety.

In some embodiments, a structural lipid is a cholesterol analog. Using a cholesterol analog may enhance endosomal escape as described in Patel et al., Naturally-occurring cholesterol analogues in lipid nanoparticles induce polymorphic shape and enhance intracellular delivery of mRNA, Nature Communications (2020), which is incorporated herein by reference.

In some embodiments, a structural lipid is a phytosterol. Using a phytosterol may enhance endosomal escape as described in Herrera et al., Illuminating endosomal escape of polymorphic lipid nanoparticles that boost mRNA delivery, Biomaterials Science (2020), which is incorporated herein by reference.

In some embodiments, a structural lipid contains plant sterol mimetics for enhanced endosomal release.

ii. PEGylated Lipids

A PEGylated lipid is a lipid modified with polyethylene glycol. In some embodiments, the LNP comprises a compound of Formula I or a pharmaceutically acceptable salt thereof, as described herein above. In some embodiments, the LNP comprises a compound of Formula II or a pharmaceutically acceptable salt thereof, as described herein above.

In some embodiments, an LNP comprises an additional PEGylated lipid or PEG-modified lipid. A PEGylated lipid may be selected from the non-limiting group consisting of PEG-modified phosphatidylethanolamines, PEG-modified phosphatidic acids, PEG-modified ceramides, PEG-modified dialkylamines, PEG-modified diacylglycerols, PEG-modified dialkylglycerols, and mixtures thereof. For example, a PEG lipid may be PEG-c-DOMG, PEG-DMG, PEG-DLPE, PEG-DMPE, PEG-DPPC, or a PEG-DSPE lipid.

In some embodiments, the LNP comprises a PEGylated lipid disclosed in one of US 2019/0240354; US 2010/0130588; US 2021/0087135; WO 2021/204179; US 2021/0128488; US 2020/0121809; US 2017/0119904; US 2013/0108685; US 2013/0195920; US 2015/0005363; US 2014/0308304; US 2013/0053572; WO 2019/232095A1; WO 2021/077067; WO 2019/152557; US 2015/0203446; US 2017/0210697; US 2014/0200257; or WO 2019/089828A1, each of which is incorporated by reference herein in their entirety.

v. Phospholipids

In some embodiments, an LNP of the present disclosure comprises a phospholipid. Phospholipids useful in the compositions and methods may be selected from the non-limiting group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), and sphingomyelin. In some embodiments, an LNP includes DSPC. In certain embodiments, an LNP includes DOPE. In some embodiments, an LNP includes both DSPC and DOPE.

In some embodiments, a phospholipid tail may be modified in order to promote endosomal escape as described in U.S. 2021/0121411, which is incorporated herein by reference.

In some embodiments, the LNP comprises a phospholipid disclosed in one of US 2019/0240354; US 2010/0130588; US 2021/0087135; WO 2021/204179; US 2021/0128488; US 2020/0121809; US 2017/0119904; US 2013/0108685; US 2013/0195920; US 2015/0005363; US 2014/0308304; US 2013/0053572; WO 2019/232095A1; WO 2021/077067; WO 2019/152557; US 2017/0210697; or WO 2019/089828A1, each of which is incorporated by reference herein in their entirety.

In some embodiments, phospholipids disclosed in US 2020/0121809 have the following structure:

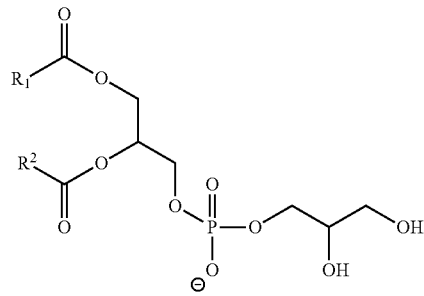

wherein $R_1$ and $R_2$ are each independently a branched or straight, saturated or unsaturated carbon chain (e.g., alkyl, alkenyl, alkynyl).

vi. Targeting Moieties

In some embodiments, the lipid nanoparticle further comprises a targeting moiety. The targeting moiety may be an antibody or a fragment thereof. The targeting moiety may be capable of binding to a target antigen.

In some embodiments, the pharmaceutical composition comprises a targeting moiety that is operably connected to a lipid nanoparticle. In some embodiments, the targeting moiety is capable of binding to a target antigen. In some embodiments, the target antigen is expressed in a target organ.

In some embodiments, the target antigen is expressed more in the target organ than it is in the liver.

In some embodiments, the targeting moiety is an antibody as described in WO2016189532A1, which is incorporated herein by reference. For example, in some embodiments, the targeted particles are conjugated to a specific anti-CD38 monoclonal antibody (mAb), which allows specific delivery of the siRNAs encapsulated within the particles at a greater percentage to B-cell lymphocytes malignancies (such as MCL) than to other subtypes of leukocytes.

In some embodiments, the lipid nanoparticles may be targeted when conjugated/attached/associated with a targeting moiety such as an antibody.

vii. Zwitterionic Amino Lipids

In some embodiments, an LNP comprises a zwitterionic lipid. In some embodiments, an LNP comprising a zwitterionic lipid does not comprise a phospholipid.

Zwitterionic amino lipids have been shown to be able to self-assemble into LNPs without phospholipids to load, stabilize, and release mRNAs intracellular as described in U.S. Patent Application 20210121411, which is incorporated herein by reference in its entirety. Zwitterionic, ionizable cationic and permanently cationic helper lipids enable tissue-selective mRNA delivery and CRISPR-Cas9 gene editing in spleen, liver and lungs as described in Liu et al., Membrane-destablizing ionizable phospholipids for organ-selective mRNA delivery and CRISPR-Cas gene editing, Nat Mater. (2021), which is incorporated herein by reference in its entirety.

The zwitterionic lipids may have head groups containing a cationic amine and an anionic carboxylate as described in Walsh et al., Synthesis, Characterization and Evaluation of Ionizable Lysine-Based Lipids for siRNA Delivery, Bioconjug Chem. (2013), which is incorporated herein by reference in its entirety. Ionizable lysine-based lipids containing a lysine head group linked to a long-chain dialkylamine through an amide linkage at the lysine α-amine may reduce immunogenicity as described in Walsh et al., Synthesis, Characterization and Evaluation of Ionizable Lysine-Based Lipids for siRNA Delivery, Bioconjug Chem. (2013).

viii. Additional Lipid Components

In some embodiments, the LNP compositions of the present disclosure further comprise one or more additional lipid components capable of influencing the tropism of the LNP. In some embodiments, the LNP further comprises at least one lipid selected from DDAB, EPC, 14PA, 18BMP, DODAP, DOTAP, and C12-200 (see Cheng, et al. *Nat Nanotechnol.* 2020 April; 15(4): 313-320.; Dillard, et al. PNAS 2021 Vol. 118 No. 52.).

ix. LNP pharmaceutical Compositions

In some embodiments, a nanoparticle includes an ionizable lipid, a phospholipid, a PEG lipid, and a structural lipid. In certain embodiments, the lipid component of the nanoparticle composition includes about 30 mol % to about 60 mol % ionizable lipid, about 0 mol % to about 30 mol % phospholipid, about 18.5 mol % to about 48.5 mol % structural lipid, and about 0 mol % to about 10 mol % of PEG lipid, provided that the total mol % does not exceed 100%. In some embodiments, the lipid component of the nanoparticle composition includes about 35 mol % to about 55 mol % ionizable lipid, about 5 mol % to about 25 mol % phospholipid, about 30 mol % to about 40 mol % structural lipid, and about 0 mol % to about 10 mol % of PEG lipid. In a particular embodiment, the lipid component includes about 50 mol % ionizable lipid, about 10 mol % phospholipid, about 38.5 mol % structural lipid, and about 1.5 mol % of PEG lipid. In another particular embodiment, the lipid component includes about 40 mol % ionizable lipid, about 20 mol % phospholipid, about 38.5 mol % structural lipid, and about 1.5 mol % of PEG lipid. In another particular embodiment, the lipid component includes about 48.5 mol % ionizable lipid, about 10 mol % phospholipid, about 40 mol % structural lipid, and about 1.5 mol % of PEG lipid. In another particular embodiment, the lipid component includes about 48.5 mol % ionizable lipid, about 10 mol % phospholipid, about 39 mol % structural lipid, and about 2.5 mol % of PEG lipid. In some embodiments, the phospholipid may be DOPE or DSPC. In other embodiments, the PEG lipid may be PEG-DMG and/or the structural lipid may be cholesterol. The amount of active agent in a nanoparticle composition may depend on the size, composition, desired target and/or application, or other properties of the nanoparticle composition as well as on the properties of the active agent. For example, the amount of active agent useful in a nanoparticle composition may depend on the size, sequence, and other characteristics of the active agent. The relative amounts of active agent and other elements (e.g., lipids) in a nanoparticle composition may also vary. In some embodiments, the wt/wt ratio of the lipid component to an enzyme in a nanoparticle composition may be from about 5:1 to about 60:1, such as 5:1, 6:1, 7:1, 8:1, 9:1, 10:1, 11:1, 12:1, 13:1, 14:1, 15:1, 16:1, 17:1, 18:1, 19:1, 20:1, 25:1, 30:1, 35:1, 40:1, 45:1, 50:1, and 60:1. The amount of a enzyme in a nanoparticle composition may, for example, be measured using absorption spectroscopy (e.g., ultraviolet-visible spectroscopy).

In some embodiments, a nanoparticle composition comprising an active agent of the present disclosure is formulated to provide a specific E:P ratio. The E:P ratio of the composition refers to the molar ratio of nitrogen atoms in one or more lipids to the number of phosphate groups in an RNA active agent. In general, a lower E:P ratio is preferred. The one or more enzymes, lipids, and amounts thereof may be selected to provide an E:P ratio from about 2:1 to about 30:1, such as 2:1, 3:1, 4:1, 5:1, 6:1, 7:1, 8:1, 9:1, 10:1, 12:1, 14:1, 16:1, 18:1, 20:1, 22:1, 24:1, 26:1, 28:1, or 30:1. In certain embodiments, the E:P ratio may be from about 2:1 to about 8:1. In other embodiments, the E:P ratio is from about 5:1 to about 8:1. For example, the E:P ratio may be about 5.0:1, about 5.5:1, about 5.67:1, about 6.0:1, about 6.5:1, or about 7.0:1.

The characteristics of a nanoparticle composition may depend on the components thereof. For example, a nanoparticle composition including cholesterol as a structural lipid may have different characteristics than a nanoparticle composition that includes a different structural lipid. Similarly, the characteristics of a nanoparticle composition may depend on the absolute or relative amounts of its components. For instance, a nanoparticle composition including a higher molar fraction of a phospholipid may have different characteristics than a nanoparticle composition including a lower molar fraction of a phospholipid. Characteristics may also vary depending on the method and conditions of preparation of the nanoparticle composition. Nanoparticle compositions may be characterized by a variety of methods. For example, microscopy (e.g., transmission electron microscopy or scanning electron microscopy) may be used to examine the morphology and size distribution of a nanoparticle composition. Dynamic light scattering or potentiometry (e.g., potentiometric titrations) may be used to measure Zeta potentials. Dynamic light scattering may also be utilized to determine particle sizes. Instruments such as the Zetasizer Nano ZS (Malvern Instruments Ltd, Malvern, Worcestershire, UK) may also be used to measure multiple characteristics of a nanoparticle composition, Such as particle size, polydispersity index, and Zeta potential.

The mean size of a nanoparticle composition may be between 10s of nm and 100s of nm, e.g., measured by dynamic light scattering (DLS). For example, the mean size may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the mean size of a nanoparticle composition may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In certain embodiments, the mean size of a nanoparticle composition may be from about 70 nm to about 100 nm. In a particular embodiment, the mean size may be about 80 nm. In other embodiments, the mean size may be about 100 nm.

A nanoparticle composition may be relatively homogenous. A polydispersity index may be used to indicate the homogeneity of a nanoparticle composition, e.g., the particle size distribution of the nanoparticle compositions. A small (e.g., less than 0.3) polydispersity index generally indicates a narrow particle size distribution. A nanoparticle composition may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25.

The Zeta potential of a nanoparticle composition may be used to indicate the electrokinetic potential of the composition. For example, the Zeta potential may describe the surface charge of a nanoparticle composition. Nanoparticle compositions with relatively low charges, positive or negative, are generally desirable, as more highly charged species may interact undesirably with cells, tissues, and other elements in the body. In some embodiments, the Zeta potential of a nanoparticle composition may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV, to about +20 mV, from about 0 mV to about +15 mV, from about 0 mV to about +10 mV, from about 0 mV to about +5 mV, from about +5 mV to about +20 mV, from about +5 mV, to about +15 mV, or from about +5 mV to about +10 mV.

The efficiency of encapsulation of a payload describes the amount of payload that is encapsulated or otherwise associated with a nanoparticle composition after preparation, relative to the initial amount provided. The encapsulation efficiency is desirably high (e.g., close to 100%). The encapsulation efficiency may be measured, for example, by comparing the amount of payload in a solution containing the nanoparticle composition before and after breaking up the nanoparticle composition with one or more organic solvents or detergents. Fluorescence may be used to measure the amount of free payload in a solution. For the nanoparticle compositions described herein, the encapsulation efficiency of a therapeutic and/or prophylactic may be at least 50%, for example 50%, 55%, 60%. 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In certain embodiments, the encapsulation efficiency may be at least 90%.

Lipids and their method of preparation are disclosed in, e.g., U.S. Pat. Nos. 8,569,256, 5,965,542 and U.S. Patent Publication Nos. 2016/0199485, 2016/0009637, 2015/0273068, 2015/0265708, 2015/0203446, 2015/0005363, 2014/0308304, 2014/0200257, 2013/086373, 2013/0338210, 2013/0323269, 2013/0245107, 2013/0195920, 2013/0123338, 2013/0022649, 2013/0017223, 2012/0295832, 2012/0183581, 2012/0172411, 2012/0027803, 2012/0058188, 2011/0311583, 2011/0311582, 2011/0262527, 2011/0216622, 2011/0117125, 2011/0091525, 2011/0076335, 2011/0060032, 2010/0130588, 2007/0042031, 2006/0240093, 2006/0083780, 2006/0008910, 2005/0175682, 2005/017054, 2005/0118253, 2005/0064595, 2004/0142025, 2007/0042031, 1999/009076 and PCT Pub. Nos. WO 99/39741, WO 2017/117528, WO 2017/004143, WO 2017/075531, WO 2015/199952, WO 2014/008334, WO 2013/086373, WO 2013/086322, WO 2013/016058, WO 2013/086373, WO2011/141705, and WO 2001/07548 and Semple et. al, Nature Biotechnology, 2010, 28, 172-176, the full disclosures of which are herein incorporated by reference in their entirety for all purposes.

A nanoparticle composition may include any substance useful in pharmaceutical compositions. For example, the nanoparticle composition may include one or more pharmaceutically acceptable excipients or accessory ingredients such as, but not limited to, one or more solvents, dispersion media, diluents, dispersion aids, suspension aids, granulating aids, disintegrants, fillers, glidants, liquid vehicles, binders, surface active agents, isotonic agents, thickening or emulsifying agents, buffering agents, lubricating agents, oils, preservatives, and other species. Excipients such as waxes, butters, coloring agents, coating agents, flavorings, and perfuming agents may also be included. Pharmaceutically acceptable excipients are well known in the art (see for example Remington's *The Science and Practice of Pharmacy,* 21$^{st}$ Edition, A. R. Gennaro: Lippincott, Williams & Wilkins, Baltimore, Md., 2006). Other different lipids or liposomal formulations including nanoparticles and methods of administration include, but are not limited to, U.S. Patent Publication 20030203865, 20020150626, 20030032615, and 20040048787, which are specifically incorporated by reference to the extent they disclose formulations and other related aspects of administration and delivery of nucleic acids. Methods used for forming particles are also disclosed in U.S. Pat. Nos. 5,844,107, 5,877,302, 6,008,336, 6,077, 835, 5,972,901, 6,200,801, and 5,972,900, which are incorporated by reference for those aspects.

In some embodiments, the LNP encapsulates the engineered retron, e.g., an engineered nucleic acid construct, ncRNA, vector system, RNA molecule, and/or engineered nucleic acid-enzyme construct as described herein.

In some embodiments, the lipid nanoparticle comprises: one or more ionizable lipids; one or more structural lipids; one or more PEGylated lipids; and one or more phospholipids. In some embodiments, the one or more ionizable lipids is selected from the group consisting of those disclosed in Table X.

In some embodiments, the one or more structural lipids are selected from the group consisting of cholesterol, fecosterol, beta sitosterol, sitosterol, ergosterol, campesterol, stigmasterol, brassicasterol, tomatidine, tomatine, ursolic acid, alpha-tocopherol, prednisolone, dexamethasone, prednisone, and hydrocortisone. In some embodiments, the one or more PEGylated lipids are selected from the group consisting of PEG-c-DOMG, PEG-DMG, PEG-DLPE, PEG-DMPE, PEG-DPPC, and PEG-DSPE.

In some embodiments, the one or more phospholipids are selected from the group consisting of 1,2-distearoyl-sn-glycero-3-phosphocholine (DSPC), 1,2-dioleoyl-sn-glycero-3-phosphoethanolamine (DOPE), 1,2-dilinoleoyl-sn-glycero-3-phosphocholine (DLPC), 1,2-dimyristoyl-sn-glycero-phosphocholine (DMPC), 1,2-dioleoyl-sn-glycero-3-phosphocholine (DOPC), 1,2-dipalmitoyl-sn-glycero-3-phosphocholine (DPPC), 1,2-diundecanoyl-sn-glycero-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-diphytanoylsn-glycero-3-phosphoethanolamine (ME 16.0 PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), and sphingomyelin. In some embodiments, the lipid nanoparticle comprises about 48.5 mol % ionizable lipid, about 10 mol % phospholipid, about 40 mol % structural lipid, and about 1.5 mol % of PEG lipid.

In some embodiments, the lipid nanoparticle comprises about 48.5 mol % ionizable lipid, about 10 mol % phospholipid, about 39 mol % structural lipid, and about 2.5 mol % of PEG lipid. In some embodiments, the LNP further comprises a targeting moiety operably connected to the LNP. In some embodiments, the LNP further comprises one or more additional components selected from the group consisting of DDAB, EPC, 14PA, 18BMP, DODAP, DOTAP, and C12-200.

In some embodiments, the engineered retron can be used for gene transfer, which may be performed under ex vivo or in vivo conditions. Ex vivo gene therapy refers to the isolation of cells from a subject, the delivery of a nucleic acid into cells in vitro, and the return of the modified cells back into the subject. This may involve the collection of a biological sample comprising cells from the subject. For example, blood can be obtained by venipuncture, and solid tissue samples can be obtained by surgical techniques according to methods well known in the art.

Usually, but not always, the subject who receives the cells (e.g., the recipient) is also the subject from whom the cells are harvested or obtained, which provides the advantage that the donated cells are autologous. However, cells can be obtained from another subject (e.g., a donor), a culture of cells from a donor, or from established cell culture lines. Accordingly, in some embodiments the cells are allogeneic to the recipient. Cells may be obtained from the same or a different species than the subject to be treated, but preferably are of the same species, and more preferably of the same immunological profile as the subject. Such cells can be obtained, for example, from a biological sample comprising cells from a close relative or matched donor, then transfected with nucleic acids (e.g., comprising an engineered retron), and administered to a subject in need of genome modification, for example, for treatment of a disease or condition.

In other embodiments, the engineered retron can be introduced in vivo (e.g., used in gene therapy) by physically delivering the engineered retron to a subject. Examples of physically introducing the engineered retron includes via injections, electroporation and transfection (e.g., calcium-mediated or liposome transfection, or the like).

K. Kits

Also provided are kits comprising engineered retrons (e.g., engineered nucleic acid constructs, or engineered nucleic acid-enzyme constructs) as described herein.

In some embodiments, the kit provides an engineered retron construct or a vector system comprising such a retron construct. In some embodiments, the engineered retron construct, included in the kit, comprises a heterologous sequence capable of providing a cell with a nucleic acid encoding a protein or regulatory RNA of interest, a cellular barcode, a donor polynucleotide suitable for use in gene editing, e.g., by homology directed repair (HDR) or recombination-mediated genetic engineering (recombineering), or a CRISPR protospacer DNA sequence for use in molecular recording. Other agents may also be included in the kit such as transfection agents, host cells, suitable media for culturing cells, buffers, and the like.

In the context of a kit, agents can be provided in liquid or solid form in any convenient packaging (e.g., stick pack, dose pack, etc.). The agents of a kit can be present in the same or separate containers. The kits may contain any one or more of the components described herein in one or more containers. The components may be prepared sterilely, packaged in a syringe and shipped refrigerated. Alternatively it may be housed in a vial or other container for storage. A second container may have other components prepared sterilely. Alternatively the kits may include the active agents premixed and shipped in a vial, tube, or other container.

The kits may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kits may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kits may also include other components, depending on the specific application, for example, containers, cell media, salts, buffers, reagents, syringes, needles, a fabric, such as gauze, for applying or removing a disinfecting agent, disposable gloves, a support for the agents prior to administration, etc. Some aspects of this disclosure provide kits comprising a nucleic acid construct comprising a nucleotide sequence encoding the various components of the retron-based editing system described herein.

In addition to the above components, the subject kits may further include (in some embodiments) instructions for practicing the subject methods. These instructions may be present in the subject kits in a variety of forms, one or more of which may be present in the kit. One form in which these instructions may be present is as printed information on a suitable medium or substrate, e.g., a piece or pieces of paper on which the information is printed, in the packaging of the kit, in a package insert, and the like. Yet another form of these instructions is a computer readable medium, e.g., diskette, compact disk (CD), flash drive, and the like, on which the information has been recorded. Yet another form of these instructions that may be present is a website address which may be used via the internet to access the information at a remote site. In some embodiments, information provided on the website is periodically updated to provide, for example, the most up-to-date information. The written instructions may be in a form prescribed by a governmental agency regulating the manufacture, use, or sale of pharmaceuticals or biological products, which can also reflect approval by the agency of manufacture, use or sale for animal administration. As used herein, "promoted" includes all methods of doing business including methods of education, hospital and other clinical instruction, scientific inquiry, drug discovery or development, academic research, pharmaceutical industry activity including pharmaceutical sales, and any advertising or other promotional activity including written, oral and electronic communication of any form, associated with the disclosure.

Other aspects of this disclosure provide kits comprising one or more nucleic acid constructs (e.g., one or more mRNA or circular RNA molecules encoding the components of the retron-based genome editing system) In various embodiments, all nucleic acid constructs can be based on RNA molecules, i.e., and "all-RNA system." For example, each of the components of the editing system could be expressed from a mRNA molecule, which would be delivered to a target cell by one more delivery methods (e.g., LNP delivery).

L. Cells

One aspect of the disclosure provides an isolated host cell that includes one or more of the compositions described herein, including, but not limited to, engineered retrons and/or retron components, engineered ncRNAs, engineered msDNA, engineered RT, nucleic acid molecules encoding the engineered retrons and/or retron components, and vector or vector systems encoding the engineered retrons and/or retron components, and any combinations thereof. In some embodiments, the host cell is a prokaryotic cell, an archaeal cell, or a eukaryotic host cell. In some embodiments, the eukaryotic host cell is a mammalian cell, such as a human cell, a non-human cell, or a non-human mammalian cell. In some embodiments, the host cell is an artificial cell or genetically modified cell. In some embodiments, the host cell is in vitro, such as a tissue culture cell. In some embodiments, the host cell is within a living host organism.

Cells that may contain any of the compositions described herein. The methods described herein are used to deliver recombinant retrons or components thereof into a eukaryotic cell (e.g., a mammalian cell, such as a human cell). In some embodiments, the cell is in vitro (e.g., cultured cell. In some embodiments, the cell is in vivo (e.g., in a subject such as a human subject). In some embodiments, the cell is ex vivo (e.g., isolated from a subject and may be administered back to the same or a different subject).

The present disclosure contemplates the use of any suitable host cell. For example, the cell host can be a mammalian cell. Mammalian cells of the present disclosure include human cells, primate cells (e.g., vero cells), rat cells (e.g., GH3 cells, OC23 cells) or mouse cells (e.g., MC3T3 cells). There are a variety of human cell lines, including, without limitation, human embryonic kidney (HEK) cells, HeLa cells, cancer cells from the National Cancer Institute's 60 cancer cell lines (NCI60), DU145 (prostate cancer) cells, Lncap (prostate cancer) cells, MCF-7 (breast cancer) cells, MDA-MB-438 (breast cancer) cells, PC3 (prostate cancer) cells, T47D (breast cancer) cells, THP-1 (acute myeloid leukemia) cells, U87 (glioblastoma) cells, SHSY5Y human neuroblastoma cells (cloned from a myeloma) and Saos-2 (bone cancer) cells. In some embodiments, the cells can be human embryonic kidney (HEK) cells (e.g., HEK 293 or HEK 293T cells). In some embodiments, the cells can be stem cells (e.g., human stem cells) such as, for example, pluripotent stem cells (e.g., human pluripotent stem cells including human induced pluripotent stem cells (hiPSCs)). A stem cell refers to a cell with the ability to divide for indefinite periods in culture and to give rise to specialized cells. A pluripotent stem cell refers to a type of stem cell that is capable of differentiating into all tissues of an organism, but not alone capable of sustaining full organismal development. A human induced pluripotent stem cell refers to a somatic (e.g., mature or adult) cell that has been reprogrammed to an embryonic stem cell-like state by being forced to express genes and factors important for maintaining the defining properties of embryonic stem cells (see, e.g., Takahashi and Yamanaka, Cell 126 (4): 663-76, 2006, incorporated by reference herein). Human induced pluripotent stem cells express stem cell markers and are capable of generating cells characteristic of all three germ layers (ectoderm, endoderm, mesoderm).

Some aspects of this disclosure provide cells comprising any of the compositions disclosed herein, including, but not limited to, engineered retrons and/or retron components, engineered ncRNAs, engineered msDNA, engineered RT, nucleic acid molecules encoding the engineered retrons and/or retron components, and vector or vector systems encoding the engineered retrons and/or retron components, and any combinations thereof. In some embodiments, a host cell is transiently or non-transiently transfected with one or more delivery systems described herein, including virus-based systems, virus-like particle systems, and non-virus-base delivery, including LNPs and liposomes. In some embodiments, a cell is transfected as it naturally occurs in a subject. In some embodiments, a cell that is transfected is taken from a subject, i.e., ex vivo transfection. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A 172, A20, A253, A431, A-549, ALC, B16, B35, BCP-1 cells, BEAS-2B, bEnd.3, BHK-21, BR 293. BxPC3. C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DUi45, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK 11, MOR/0.2R, MONO-MAC 6, MTD-IA, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof.

Cell lines are available from a variety of sources known to those with skill in the art (see, e.g., the American Type Culture Collection (ATCC) (Manassas, Va.)). In some embodiments, a cell transfected with one or more retron delivery systems described herein is used to establish a new cell line comprising one or more nucleic acid molecules encoding the recombinant retron-based gene editing systems described herein, or encoding at last a component of said systems (e.g., a recombinant ncRNA or a recombinant retron RT).

M. Pharmaceutical Compositions

The engineered retron-based genome editing systems described herein, or one or more components thereof (e.g., engineered ncRNAs, engineered msDNA, engineered RT, nucleic acid molecules encoding the engineered retrons and/or retron components, guide RNAs, programmable nucleases) may be provided as pharmaceutical compositions. For example, one or more LNPs or other non-virus-based delivery system comprising one or more circular or linear RNA molecules encoding each of the components of the retron-based genome editing system may be formulated as a pharmaceutical composition for administering to a subject in need (e.g., a human in need of gene editing).

Formulations can include, without limitation, saline, liposomes, lipid nanoparticles, polymers, peptides, proteins, cells transfected with viral vectors (e.g., for transfer or transplantation into a subject) and combinations thereof.

Formulations of the pharmaceutical compositions described herein may be prepared by any method known or hereafter developed in the art of pharmacology. As used herein the term "pharmaceutical composition" refers to compositions comprising at least one active ingredient and optionally one or more pharmaceutically acceptable excipients.

In general, such preparatory methods include the step of associating the active ingredient with an excipient and/or one or more other accessory ingredients. As used herein, the phrase "active ingredient" generally refers an engineered retron as described herein.

A pharmaceutical composition in accordance with the present disclosure may be prepared, packaged, and/or sold in bulk, as a single unit dose, and/or as a plurality of single unit doses. As used herein, a "unit dose" refers to a discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Other aspects of the present disclosure relate to pharmaceutical compositions comprising any of the various components of the recombinant retron-based genome editing systems described herein, including, but not limited to, engineered retrons and/or retron components, engineered ncRNAs, engineered msDNA, engineered RT, nucleic acid molecules encoding the engineered retrons and/or retron components, programmable nucleases (e.g., RNA-guided nucleases), guide RNAs, and vector or vector systems encoding the engineered retrons and/or retron components, and any combinations thereof. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseous, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249: 1527-1533; Sefton, 1989, CRC Crit. Ref Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105). Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal or LNP, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

Further, the pharmaceutical composition can be provided as a pharmaceutical kit comprising (a) a container containing a recombinant retron-based genome editing system or one or more components thereof in lyophilized form and (b) a second container containing a pharmaceutically acceptable diluent (e.g., sterile water) for injection. The pharmaceutically acceptable diluent can be used for reconstitution or dilution of the lyophilized system of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierce-able by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

N. Use and Methods of Use

The engineered retron comprising the heterologous nucleic acid sequence can be used in a variety of applications, several non-limiting examples of which are described herein. In general, the engineered retron can be used in any suitable organism. In some embodiments, the organism is a eukaryote.

In some embodiments, the organism is an animal. In some embodiments, the animal is a fish, an amphibian, a reptile, a mammal, or a bird. In some embodiments, the animal is a farm animal or agriculture animal. Non-limiting examples of farm and agriculture animals include horses, goats, sheep, swine, cattle, llamas, alpacas, and birds, e.g., chickens, turkeys, ducks, and geese. In some embodiments, the animal is a non-human primate, e.g., baboons, capuchin monkeys, chimpanzees, lemurs, macaques, marmosets, tamarins, spider monkeys, squirrel monkeys, and vervet monkeys. In some embodiments, the animal is a pet. Non-limiting examples of pets include dogs, cats horses, wolfs, rabbits, ferrets, gerbils, hamsters, chinchillas, fancy rats, guinea pigs, canaries, parakeets, and parrots.

In some embodiments, the organism is a plant. Plants that may be transfected with an engineered retron include monocots and dicots. Particular examples include, but are not limited to, corn (maize), sorghum, wheat, sunflower, potato, cotton, rice, soybean, sugarbeet, sugarcane, tobacco, barley, and oilseed rape, *Brassica* sp., alfalfa, rye, millet, safflower, peanuts, sweet potato, cassava, coffee, coconut, pineapple, citrus trees, cocoa, tea, banana, avocado, fig, guava, mango, olive, papaya, cashew, macadamia, almond, oats, vegetables, ornamentals, and conifers. Vegetables include, but are not limited to, crucifers, peppers, tomatoes, lettuce, green beans, lima beans, peas, and members of the genus *Cucumis* such as cucumber, cantaloupe, and musk melon. Ornamentals include, but are not limited to, azalea, hydrangea, hibiscus, roses, tulips, daffodils, petunias, carnation, poinsettia, and chrysanthemum.

In some embodiments, heterologous nucleic acid sequences can be added to the subject engineered retron to provide a cell with a heterologous nucleic acid encoding a protein or regulatory RNA of interest, a cellular barcode, a donor polynucleotide suitable for use in gene editing, e.g., by homology directed repair (HDR) or recombination-mediated genetic engineering (recombineering), or a CRISPR protospacer DNA sequence for use in molecular recording, as discussed further below. Such heterologous sequences may be inserted, for example, into the msr locus or the msd locus such that the heterologous sequence is transcribed by the retron reverse transcriptase as part of the msDNA product.

In some embodiments, the engineered retrons described herein may be used for research tools, such as kits, functional genomics assays, and generating engineered cell lines and animal models for research and drug screening. The kit may comprise one or more reagents in addition to the engineered retron, such as a buffer, a control reagent, a control vector, a control RNA polynucleotide, a reagent for in vitro production of the polypeptide from DNA, and adaptors for sequencing. A buffer can be, for example, a stabilization buffer, a reconstituting buffer, a diluting buffer, a wash buffer, or a buffer for introducing a polypeptide and/or polynucleotide of the kit into a cell. In some instances, a kit can comprise one or more additional reagents specific for plants. One or more additional reagents for plants can include, for example, soil, nutrients, plants, seeds, spores, *Agrobacterium*, a T-DNA vector, and a pBINAR vector.

Production of Protein or RNA

In some embodiments, the single-stranded msDNA generated by the engineered retron of the invention can be used to produce a desired product of interest in cells.

In some embodiments, the retron is engineered with a heterologous sequence encoding a polypeptide of interest to allow production of the polypeptide from the retron msDNA generated in a cell. The polypeptide of interest may be any type of protein/peptide including, without limitation, an enzyme, an extracellular matrix protein, a receptor, transporter, ion channel, or other membrane protein, a hormone, a neuropeptide, an antibody, or a cytoskeletal protein, a functional fragment thereof, or a biologically active domain of interest. In some embodiments, the protein is a therapeutic protein, therapeutic antibody for use in treatment of a disease, or a template to fix a mutation or mutated exon in the genome.

Non-limiting examples of polypeptides of interest include: growth hormones, insulin-like growth factors (IGF-1), Fat-1, Phytase, xylanase, beta-glucanase, Lysozyme or lysostaphin, Histone deacetylase such as HDAC6, CD163, etc.

In other embodiments, the retron is engineered with a heterologous sequence encoding an RNA of interest to allow production of the RNA from the retron in a cell. The RNA of interest may be any type of RNA including, without limitation, a RNA interference (RNAi) nucleic acid or regulatory RNA such as, but not limited to, a microRNA (miRNA), a small interfering RNA (siRNA), a short hairpin RNA (shRNA), a small nuclear RNA (snRNA), a long non-coding RNA (lncRNA), an antisense nucleic acid, and the like.

Gene Editing

In some embodiments, the retron is used for genome editing a desired site. A retron is engineered with a heterologous nucleic acid sequence encoding a donor polynucleotide suitable for use with nuclease genome editing system. The nuclease is designed to specifically target a location proximal to the desired edit (the nuclease should be designed such that it will not cut the target once the edit is properly installed). The nuclease (e.g., CAS or non-CAS) is linked to the retron, either by direct fusion to the RT or by fusion of the msDNA to the gRNA (only applicable for RNA-guided nucleases). A heterologous nucleic acid sequence is inserted into the retron msd. See for example FIG. 3 (SEQ ID NO: 19192), which shows a marker representing the edit.

In some embodiments, the heterologous nucleic acid sequence has 10-100 or more bp of homologous nucleic acid sequence to the genome on both sides of the desired edit. The desired edit (insertion, deletion, or mutation) is in between the homologous sequence.

In some embodiments, donor polynucleotides comprise a sequence comprising an intended genome edit flanked by a pair of homology arms responsible for targeting the donor polynucleotide to the target locus to be edited in a cell. The donor polynucleotide typically comprises a 5' homology arm that hybridizes to a 5' genomic target sequence and a 3' homology arm that hybridizes to a 3' genomic target sequence. The homology arms are referred to herein as 5' and 3' (i.e., upstream and downstream) homology arms, which relate to the relative position of the homology arms to the nucleotide sequence comprising the intended edit within the donor polynucleotide. The 5' and 3' homology arms hybridize to regions within the target locus in the genomic DNA to be modified, which are referred to herein as the "5' target sequence" and "3' target sequence," respectively.

The homology arm must be sufficiently complementary for hybridization to the target sequence to mediate homologous recombination between the donor polynucleotide and genomic DNA at the target locus. For example, a homology arm may comprise a nucleotide sequence having at least about 80-100% sequence identity to the corresponding genomic target sequence, including any percent identity within this range, such as at least 80%, 81%, 82%, 83%, 84%, 85%, 86%, 87%, 88%, 89%, 90%, 91%, 92%, 93%, 94%, 95%, 96%, 97%, 98%, 99% or 100% sequence identity thereto, wherein the nucleotide sequence comprising the intended edit can be integrated into the genomic DNA by HDR at the genomic target locus recognized (i.e., having sufficient complementary for hybridization) by the 5' and 3' homology arms.

In some embodiments, the corresponding homologous nucleotide sequences in the genomic target sequence (i.e., the "5' target sequence" and "3' target sequence") flank a specific site for cleavage and/or a specific site for introducing the intended edit. The distance between the specific cleavage site and the homologous nucleotide sequences (e.g., each homology arm) can be several hundred nucleotides. In some embodiments, the distance between a homology arm and the cleavage site is 200 nucleotides or less (e.g., 0, 10, 20, 30, 50, 75, 100, 125, 150, 175, and 200 nucleotides). In most cases, a smaller distance may give rise to a higher gene targeting rate. In some embodiments, the donor polynucleotide is substantially identical to the target genomic sequence, across its entire length except for the sequence changes to be introduced to a portion of the genome that encompasses both the specific cleavage site and the portions of the genomic target sequence to be altered.

A homology arm can be of any length, e.g. 10 nucleotides or more, 15 nucleotides or more, 20 nucleotides or more, 50 nucleotides or more, 100 nucleotides or more, 250 nucleotides or more, 300 nucleotides or more, 350 nucleotides or more, 400 nucleotides or more, 450 nucleotides or more, 500 nucleotides or more, 1000 nucleotides (1 kb) or more, 5000 nucleotides (5 kb) or more, 10000 nucleotides (10 kb) or more, etc. In some instances, the 5' and 3' homology arms are substantially equal in length to one another. However, in some instances the 5' and 3' homology arms are not necessarily equal in length to one another. For example, one homology arm may be 30% shorter or less than the other homology arm, 20% shorter or less than the other homology arm, 10% shorter or less than the other homology arm, 5% shorter or less than the other homology arm, 2% shorter or less than the other homology arm, or only a few nucleotides less than the other homology arm. In other instances, the 5' and 3' homology arms are substantially different in length from one another, e.g. one may be 40% shorter or more, 50% shorter or more, sometimes 60% shorter or more, 70% shorter or more, 80% shorter or more, 90% shorter or more, or 95% shorter or more than the other homology arm.

The donor polynucleotide may be used in combination with an RNA-guided nuclease, which is targeted to a particular genomic sequence (i.e., genomic target sequence to be modified) by a guide RNA. A target-specific guide RNA comprises a nucleotide sequence that is complementary to a genomic target sequence, and thereby mediates binding of the nuclease-gRNA complex by hybridization at the target site. For example, the gRNA can be designed with a sequence complementary to the sequence of a minor allele to target the nuclease-gRNA complex to the site of a mutation. The mutation may comprise an insertion, a deletion, or a substitution. For example, the mutation may include a single nucleotide variation, gene fusion, translocation, inversion, duplication, frameshift, missense, nonsense, or other mutation associated with a phenotype or disease of interest. The targeted minor allele may be a common genetic variant or a rare genetic variant. In some embodiments, the gRNA is designed to selectively bind to a minor allele with single base-pair discrimination, for example, to allow binding of the nuclease-gRNA complex to a single nucleotide polymorphism (SNP). In particular, the gRNA may be designed to target disease-relevant mutations of interest for the purpose of genome editing to remove the mutation from a gene. Alternatively, the gRNA can be designed with a sequence complementary to the sequence of a major or wild-type allele to target the nuclease-gRNA complex to the allele for the purpose of genome editing to introduces a mutation into a gene in the genomic DNA of the cell, such as an insertion, deletion, or substitution. Such genetically modified cells can be used, for example, to alter phenotype, confer new properties, or produce disease models for drug screening.

In some embodiments, the RNA-guided nuclease used for genome modification is a clustered regularly interspersed short palindromic repeats (CRISPR) system Cas nuclease. Any RNA-guided Cas nuclease capable of catalyzing site-directed cleavage of DNA to allow integration of donor polynucleotides by the HDR mechanism can be used in genome editing, including CRISPR system Class 1, Type I, II, or III Cas nucleases; Class 2, Type II nuclease (such as Cas9); a Class 2, Type V nuclease (such as Cpf1), or a Class 2, Type VI nuclease (such as C2c2). Examples of Cas proteins include Cas1, Cas1B, Cas2, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cul966, and homologs or modified versions thereof.

In some embodiments, a Class 1, type II CRISPR system Cas9 endonuclease is used. Cas9 nucleases from any species, or biologically active fragments, variants, analogs, or derivatives thereof that retain Cas9 endonuclease activity (i.e., catalyze site-directed cleavage of DNA to generate double-strand breaks) may be used to perform genome modification as described herein. The Cas9 need not be physically derived from an organism but may be synthetically or recombinantly produced. Cas9 sequences from a number of bacterial species are well known in the art and listed in the National Center for Biotechnology Information (NCBI) database. See, for example, NCBI entries for Cas9 from: *Streptococcus pyogenes* (WP 002989955, WP_038434062, WP_011528583); *Campylobacter jejuni* (WP_022552435, YP 002344900), *Campylobacter coli* (WP 060786116); *Campylobacter fetus* (WP 059434633); *Corynebacterium ulcerans* (NC_015683, NC_017317); *Corynebacterium diphtheria* (NC_016782, NC_016786); *Enterococcus faecalis* (WP 033919308); *Spiroplasma syrphidicola* (NC 021284); *Prevotella intermedia* (NC 017861); *Spiroplasma taiwanense* (NC 021846); *Streptococcus iniae* (NC 021314); *Belliella baltica* (NC 018010); *Psychroflexus torquisl* (NC O 18721); *Streptococcus thermophilus* (YP 820832), *Streptococcus mutans* (WP 061046374, WP 024786433); *Listeria innocua* (NP 472073); *Listeria monocytogenes* (WP 061665472); *Legionella pneumophila* (WP 062726656); *Staphylococcus aureus* (WP_001573634); *Francisella tularensis* (WP_032729892, WP_014548420), *Enterococcus faecalis* (WP 033919308); *Lactobacillus rhamnosus* (WP 048482595, WP_032965177); and *Neisseria meningitidis* (WP_061704949, YP_002342100); all of which sequences (as entered by the date of filing of this application) are herein incorporated by reference in their entireties. Any of these sequences or a variant thereof comprising a sequence having at least about 70-100% sequence identity thereto, including any percent identity within this range, such as 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% sequence identity thereto, can be used for genome editing, as described herein. See also Fonfara et al. (2014) Nucleic Acids Res. 42(4): 2577-90; Kapitonov et al. (2015) J. Bacterid. 198(5): 797-807, Shmakov et al. (2015) Mol. Cell. 60(3):385-397, and Chylinski et al. (2014) Nucleic Acids Res. 42(10):6091-6105); for sequence comparisons and a discussion of genetic diversity and phylogenetic analysis of Cas9.

The genomic target site will typically comprise a nucleotide sequence that is complementary to the gRNA and may further comprise a protospacer adjacent motif (PAM). In some embodiments, the target site comprises 20-30 base pairs in addition to a 3 or more base pair PAM. Typically, the first nucleotide of a PAM can be any nucleotide, while the two or more other nucleotides will depend on the specific Cas9 protein that is chosen. Exemplary PAM sequences are known to those of skill in the art and include, without limitation, NNG, NGN, NAG, and NGG, wherein N represents any nucleotide. In some embodiments, the allele targeted by a gRNA comprises a mutation that creates a PAM within the allele, wherein the PAM promotes binding of the Cas9-gRNA complex to the allele.

In some embodiments, the gRNA is 5-50 nucleotides, 10-30 nucleotides, 15-25 nucleotides, 18-22 nucleotides, or 19-21 nucleotides in length, or any length between the stated ranges, including, for example, 10, 11, 12, 13, 14, 15, 16, 17, 18, 19, 20, 21, 22, 23, 24, 25, 26, 27, 28, 29, 30, 31, 32, 33, 34, or 35 nucleotides in length. The guide RNA may be a single guide RNA comprising crRNA and tracrRNA sequences in a single RNA molecule, or the guide RNA may comprise two RNA molecules with crRNA and tracrRNA sequences residing in separate RNA molecules.

In another embodiment, the CRISPR nuclease from *Prevotella* and *Francisella* 1 (Cpf1, or Cas12a) is used. Cpf1 is another class II CRISPR/Cas system RNA-guided nuclease with similarities to Cas9 and may be used analogously. Unlike Cas9, Cpf1 does not require a tracrRNA and only depends on a crRNA in its guide RNA, which provides the advantage that shorter guide RNAs can be used with Cpf1 for targeting than Cas9. Cpf1 is capable of cleaving either DNA or RNA. The PAM sites recognized by Cpf1 have the sequences 5'-YTN-3' (where "Y" is a pyrimidine and "N" is any nucleobase) or 5'-TTN-3', in contrast to the G-rich PAM site recognized by Cas9. Cpf1 cleavage of DNA produces double-stranded breaks with a sticky-ends having a 4 or 5 nucleotide overhang. For a discussion of Cpf1, see, e.g., Ledford et al. (2015) Nature. 526 (7571):17-17, Zetsche et al. (2015) Cell. 163 (3):759-771, Murovec et al. (2017) Plant Biotechnol. J. 15(8):917-926, Zhang et al. (2017) Front. Plant Sci. 8:177, Fernandes et al. (2016) Postepy Biochem. 62(3):315-326; herein incorporated by reference.

C2c1 (Cas12b) is another class II CRISPR/Cas system RNA-guided nuclease that may be used. C2c1, similarly to Cas9, depends on both a crRNA and tracrRNA for guidance to target sites. See, e.g., Shmakov et al. (2015) Mol Cell. 60(3):385-397, Zhang et al. (2017) Front Plant Sci. 8:177; herein incorporated by reference.

In yet another embodiment, an engineered RNA-guided Fokl nuclease may be used. RNA-guided Fokl nucleases comprise fusions of inactive Cas9 (dCas9) and the Fokl endonuclease (FokI-dCas9), wherein the dCas9 portion confers guide RNA-dependent targeting on Fokl. For a description of engineered RNA-guided Fold nucleases, see, e.g., Havlicek et al. (2017) Mol. Ther. 25(2):342-355, Pan et al. (2016) Sci Rep. 6:35794, Tsai et al. (2014) Nat Biotechnol. 32(6):569-576; herein incorporated by reference.

In other embodiments, any other Cas enzymes and variants described in other sections of the application (all incorporated herein) can be used similarly.

In some embodiments, the RNA-guided nuclease is provided in the form of a protein, optionally where the nuclease is complexed with a gRNA to form a ribonucleoprotein (RNP) complex. In some embodiments, the RNA-guided nuclease is provided by a nucleic acid encoding the RNA-guided nuclease, such as an RNA (e.g., messenger RNA) or DNA (expression vector). In some embodiments, the RNA-guided nuclease and the gRNA are both provided by vectors, such as the vectors and the vector system described in other parts of the application (all incorporated herein by reference). Both can be expressed by a single vector or separately on different vectors. The vectors encoding the RNA-guided nuclease and gRNA may be included in the vector system comprising the engineered retron msr gene, msd gene and ret gene sequences. In some embodiments, the RNA-guided nuclease is fused to the RT and/or the msDNA.

The RNP complex may be administered to a subject or delivered into a cell by methods known in the art, such as those described in U.S. Pat. No. 11,390,884, which is incorporated by reference herein in its entirety. In some embodiments, the endonuclease/gRNA ribonucleoprotein (RNP) complexes are delivered to cells by electroporation. Direct delivery of the RNP complex to a subject or cell eliminates the need for expression from nucleic acids (e.g., transfection of plasmids encoding Cas9 and gRNA). It also eliminates unwanted integration of DNA segments derived from nucleic acid delivery (e.g., transfection of plasmids encoding Cas9 and gRNA). An endonuclease/gRNA ribonucleoprotein (RNP) complex usually is formed prior to administration.

Codon usage may be optimized to further improve production of an RNA-guided nuclease and/or reverse transcriptase (RT) in a particular cell or organism. For example, a nucleic acid encoding an RNA-guided nuclease or reverse transcriptase can be modified to substitute codons having a higher frequency of usage in a yeast cell, a bacterial cell, a human cell, a non-human cell, a mammalian cell, a rodent cell, a mouse cell, a rat cell, or any other host cell of interest, as compared to the naturally occurring polynucleotide sequence. When a nucleic acid encoding the RNA-guided nuclease or reverse transcriptase is introduced into cells, the protein can be transiently, conditionally, or constitutively expressed in the cell.

In some embodiments, the engineered retron used for genome editing with nuclease genome editing systems can further include accessory or enhancer proteins for recombination. Examples of recombination enhancers can include nonhomologous end joining (NHEJ) inhibitors (e.g., inhibitor of DNA ligase IV, a KU inhibitor (e.g., KU70 or KU80), a DNA-PKc inhibitor, or an artemis inhibitor) and homologous directed repair (HDR) promoters, or both, that can enhance or improve more precise genome editing and/or the efficiency of homologous recombination. In some embodiments, the recombination accessory or enhancers can comprise C-terminal binding protein interacting protein (CtIP), cyclinB2, Rad family members (e.g. Rad50, Rad51, Rad52, etc).

CtIP is a transcription factor containing C2H2 zinc fingers that are involved in early steps of homologous recombination. Mammalian CtTP and its orthologs in other eukaryotes promote the resection of DNA double-strand breaks and are essential for meiotic recombination. HDR may be enhanced by using Cas9 nuclease associated (e.g. fused) to an N-terminal domain of CtIP, an approach that forces CtIP to the cleavage site and increases transgene integration by HDR. In some embodiments, an N-terminal fragment of CtIP, called HE for HDR enhancer, may be sufficient for HDR stimulation and requires the CtIP multimerization domain and CDK phosphorylation sites to be active. HDR stimulation by the Cas9-HE fusion depends on the guide RNA used, and therefore the guide RNA will be designed accordingly.

Using the gene editing system described herein, any target gene or sequence in a host cell can be edited or modified for a desired trait, including but not limited to: Myostatin (e.g., GDF8) to increase muscle growth; Pc POLLED to induce hairlessness; KISSIR to induce bore taint; Dead end protein (dnd) to induce sterility; Nano2 and DDX to induce sterility; CD163 to induce PRRSV resistance; RELA to induce ASFV resilience; CD18 to induce Mannheimia (*Pasteurella*) *haemolytica* resilience; NRAMP1 to induce tuberculosis resilience; Negative regulators of muscle mass (e.g., Myostatin) to increase muscle mass.

Recombineering

Recombineering (recombination-mediated genetic engineering) can be used in modifying chromosomal as well as episomal replicons in cells, for example, to create gene replacements, gene knockouts, deletions, insertions, inversions, or point mutations. Recombineering can also be used to modify a plasmid or bacterial artificial chromosome (BAC), for example, to clone a gene or insert markers or tags.

The engineered retrons described herein can be used in recombineering applications to provide linear single-stranded or double-stranded DNA for recombination. Homologous recombination may be mediated by bacteriophage proteins such as RecE/RecT from Rac prophage or Redobd from bacteriophage lambda. The linear DNA should have sufficient homology at the 5' and 3' ends to a target DNA molecule present in a cell (e.g., plasmid, BAC, or chromosome) to allow recombination.

The linear double-stranded or single-stranded DNA molecule used in recombineering (i.e. donor polynucleotide) comprises a sequence having the intended edit to be inserted flanked by two homology arms that target the linear DNA molecule to a target site for homologous recombination. Homology arms for recombineering typically range in length from 13-300 nucleotides, or 20 to 200 nucleotides, including any length within this range such as 13, 14, 15, 16, 17, 18, 19, 20, 22, 24, 26, 28, 30, 32, 34, 36, 38, 40, 42, 44, 46, 48, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, or 200 nucleotides in length. In some embodiments, a homology arm is at least 15, at least 20, at least 30, at least 40, or at least 50 or more nucleotides in length. Homology arms ranging from 40-50 nucleotides in length generally have sufficient targeting efficiency for recombination; however, longer homology arms ranging from 150 to 200 bases or more may further improve targeting efficiency. In some embodiments, the 5' homology arm and the 3' homology arm differ in length. For example, the linear DNA may have about 50 bases at the 5' end and about 20 bases at the 3' end with homology to the region to be targeted.

The bacteriophage homologous recombination proteins can be provided to a cell as proteins or by one or more vectors encoding the recombination proteins, such as the vector or vector system. In some embodiments, one or more vectors encoding the bacteriophage recombination proteins are included in the vector system comprising the engineered retron msr gene, msd gene, and/or ret gene sequences. Additionally, a number of bacterial strains containing prophage recombination systems are available for recombineering, including, without limitation, DY380, containing a defective 1 prophage with recombination proteins exo, bet, and gam; EL250, derived from DY380, which in addition to the recombination genes found in DY380, also contains a tightly controlled arabinose-inducible flpe gene (flpe mediates recombination between two identical frt sites); EL350, also derived from DY380, which in addition to the recombination genes found in DY380, also contains a tightly controlled arabinose-inducible ere gene (ere mediates recombination between two identical loxP sites; SW102, derived from DY380, which is designed for BAC recombineering using a galK positive/negative selection; SW105, derived from EL250, which can also be used for galK positive/negative selection, but like EL250, contain an ara-inducible Flpe gene; and SW106, derived from EL350, which can be used for galK positive/negative selection, but like EL350, contains an ara-inducible Cre gene. Recombineering can be carried out by transfecting bacterial cells of such strains with an engineered retron comprising a heterologous sequence encoding a linear DNA suitable for recombineering. For a discussion of recombineering systems and protocols, see, e.g., Sharan et al. (2009) Nat Protoc. 4(2): 206-223, Zhang et al. (1998) Nature Genetics 20: 123-128, Muyrers et al. (1999) Nucleic Acids Res. 27: 1555-1557, Yu et al. (2000) Proc. Natl. Acad. Sci U.S.A. 97 (11):5978-5983; herein incorporated by reference.

Molecular Recording

In some embodiments, the heterologous sequence in the engineered retron construct comprises a synthetic CRISPR protospacer DNA sequence to allow molecular recording. The endogenous CRISPR Cas1-Cas2 system is normally utilized by bacteria and archaea to keep track of foreign DNA sequences originating from viral infections by storing short sequences (i.e., protospacers) that confer sequence-specific resistance to invading viral nucleic acids within genome-based arrays. These arrays not only preserve the spacer sequences but also record the order in which the sequences are acquired, generating a temporal record of acquisition events.

This system can be adapted to record arbitrary DNA sequences into a genomic CRISPR array in the form of "synthetic protospacers" that are introduced into cells using engineered retrons. Engineered retrons carrying the protospacer sequences can be used for integration of synthetic CRISPR protospacer sequences at a specific genomic locus by utilizing the CRISPR system Cas1-Cas2 complex. Molecular recording can be used to keep track of certain biological events by producing a stable genetic memory tracking code. See, e.g., Shipman et al. (2016) Science 353(6298): aafl 175 and International Patent Application Publication No. WO/2018/191525; herein incorporated by reference in their entireties.

In some embodiments, the CRISPR-Cas system is harnessed to record specific and arbitrary DNA sequences into a bacterial genome. The DNA sequences can be produced by an engineered retron within the cell. For example, the engineered retron can be used to produce the protospacers within the cell, which are inserted into a CRISPR array within the cell. The cell may be modified to include one or more engineered returns (or vector systems encoding them) that can produce one or more synthetic protospacers in the cell, wherein the synthetic protospacers are added to the CRISPR array. A record of defined sequences, recorded over many days, and in multiple modalities can be generated.

In some embodiments, the engineered retron comprises an msd protospacer nucleic acid region or an msr protospacer nucleic acid region. In the case of a msr protospacer nucleic acid region, the protospacer sequence is first incorporated into the msr RNA, which is reverse transcribed into protospacer DNA. Double stranded protospacer DNA is produced when two complementary protospacer DNA sequences having complementary sequences hybridize, or when a double-stranded structure (such as a hairpin) is formed in a single stranded protospacer DNA (e.g., a single msDNA can form an appropriate hairpin structure to provide the double stranded DNA protospacer).

In some embodiments, a single stranded DNA produced in vivo from a first engineered retron may be hybridized with a complementary single-stranded DNA produced in vivo from the same retron or a second engineered retron or may form a hairpin structure and then used as a protospacer sequence to be inserted into a CRISPR array as a spacer sequence. The engineered retron(s) should provide sufficient levels of the protospacer sequence within a cell for incorporation into the CRISPR array. The use of protospacers generated within the cell extends the in vivo molecular recording system from only capturing information known to a user, to capturing biological or environmental information that may be previously unknown to a user. For example, an msDNA protospacer sequence in an engineered retron construct may be driven by a promoter that is downstream of a sensor pathway for a biological phenomenon or environmental toxin. The capture and storage of the protospacer sequence in the CRISPR array records the event. If multiple msDNA protospacers are driven by different promoters, the activity of those promoters is recorded (along with anything that may be upstream of the promoters) as well as the relative order of promoter activity (based on the relative position of spacer sequences in the CRISPR array). At any point after the recording has taken place, the CRISPR array may be sequenced to determine whether a given biological or environmental event has taken place and the order of multiple events, given by the presence and relative position of msDNA-derived spacers in the CRISPR array.

In some embodiments, the synthetic protospacer further comprises an AAG PAM sequence at its 5' end. Protospacers including the 5' AAG PAM are acquired by the CRISPR array with greater efficiency than those that do not include a PAM sequence.

In some embodiments, Cas1 and Cas2 are provided by a vector that expresses the Cas1 and Cas2 at a level sufficient to allow the synthetic protospacer sequences produced by engineered retrons to be acquired by a CRISPR array in a cell. Such a vector system can be used to allow molecular recording in a cell that lacks endogenous Cas proteins.

Therapeutic Applications

Also provided herein are methods of diagnosing, prognosing, treating, and/or preventing a disease, state, or condition in or of a subject, using the engineered retron of the invention.

Generally, the methods of diagnosing, prognosing, treating, and/or preventing a disease, state, or condition in or of a subject can include modifying a polynucleotide in a subject or cell thereof using a composition, system, or component thereof of the engineered retron as described herein, and/or include detecting a diseased or healthy polynucleotide in a subject or cell thereof using a composition, system, or component thereof of the engineered retron as described herein.

In some embodiments, the method of treatment or prevention can include using a composition, system, or component of the engineered retron to modify a polynucleotide of an infectious organism (e.g. bacterial or virus) within a subject or cell thereof.

In some embodiments, the method of treatment or prevention can include using a composition, system, or component of the engineered retron to modify a polynucleotide of an infectious organism or symbiotic organism within a subject.

In some embodiments, the composition, system, and components of the engineered retron can be used to develop models of diseases, states, or conditions.

In some embodiments, the composition, system, and components of the engineered retron can be used to detect a disease state or correction thereof, such as by a method of treatment or prevention described herein.

In some embodiments, the composition, system, and components of the engineered retron can be used to screen and select cells that can be used, for example, as treatments or preventions described herein.

In some embodiments, the composition, system, and components thereof can be used to develop biologically active agents that can be used to modify one or more biologic functions or activities in a subject or a cell thereof.

In general, the method can include delivering a composition, system, and/or component of the engineered retron to a subject or cell thereof, or to an infectious or symbiotic organism by a suitable delivery technique and/or composition. Once administered, the components can operate as described elsewhere herein to elicit a nucleic acid modification event. In some embodiments, the nucleic acid modification event can occur at the genomic, epigenomic, and/or transcriptomic level. DNA and/or RNA cleavage, gene activation, and/or gene deactivation can occur.

The composition, system, and components of the engineered retron as described elsewhere herein can be used to treat and/or prevent a disease, such as a genetic and/or epigenetic disease, in a subject; to treat and/or prevent genetic infectious diseases in a subject, such as bacterial infections, viral infections, fungal infections, parasite infections, and combinations thereof, to modify the composition or profile of a microbiome in a subject, which can in turn modify the health status of the subject; to modify cells ex vivo, which can then be administered to the subject whereby the modified cells can treat or prevent a disease or symptom thereof; or to treat mitochondrial diseases, where the mitochondrial disease etiology involves a mutation in the mitochondrial DNA.

Also provided is a method of treating a subject, e.g., a subject in need thereof, comprising inducing gene editing by transforming the subject with the polynucleotide encoding one or more components of the composition, system, or complex or any of polynucleotides or vectors described herein of the engineered retron, and administering them to the subject.

Also provided is a method of treating a subject, e.g., a subject in need thereof, comprising inducing transcriptional activation or repression of multiple target gene loci by transforming the subject with the polynucleotides or vectors described herein, wherein said polynucleotide or vector encodes or comprises one or more components of composition, system, complex or component of the engineered retron, and comprising multiple Cas effectors.

Also provided is a method of treating a subject, e.g., a subject in need thereof, comprising inducing gene editing by transforming the subject with the Cas effector(s), and encoding and expressing in vivo the remaining portions of the composition, system, (e.g., RNA, guides), complex or component of the engineered retron. A suitable repair template may also be provided by the engineered retron as described herein elsewhere.

Also provided is a method of treating a subject, e.g., a subject in need thereof, comprising inducing transcriptional activation or repression by transforming the subject with the systems or compositions herein.

Also provided is a method of inducing one or more polynucleotide modifications in a eukaryotic or prokaryotic cell or component thereof (e.g. a mitochondria) of a subject, infectious organism, and/or organism of the microbiome of the subject. The modification can include the introduction, deletion, or substitution of one or more nucleotides at a target sequence of a polynucleotide of one or more cell(s). The modification can occur in vitro, ex vivo, in situ, or in vivo.

In some embodiments, the method of treating or inhibiting a condition or a disease caused by one or more mutations in a genomic locus in a eukaryotic organism or a non-human organism can include manipulation of a target sequence within a coding, non-coding or regulatory element of said genomic locus in a target sequence in a subject or a non-human subject in need thereof comprising modifying the subject or a non-human subject by manipulation of the target sequence and wherein the condition or disease is susceptible to treatment or inhibition by manipulation of the target sequence including providing treatment comprising delivering a composition comprising the particle delivery system or the delivery system or the virus particle of any one of the above embodiment or the cell of any one of the above embodiment.

Also provided herein is the use of the particle delivery system or the delivery system or the virus vector (in viral particle) of any one of the above embodiment or the cell of any one of the above embodiment in ex vivo or in vivo gene or genome editing; or for use in in vitro, ex vivo or in vivo gene therapy.

Also provided herein are particle delivery systems, non-viral delivery systems, and/or the virus particle of any one of the above embodiments or the cell of any one of the above embodiments used in the manufacture of a medicament for in vitro, ex vivo or in vivo gene or genome editing or for use in in vitro, ex vivo or in vivo gene therapy or for use in a method of modifying an organism or a non-human organism by manipulation of a target sequence in a genomic locus associated with a disease or in a method of treating or inhibiting a condition or disease caused by one or more mutations in a genomic locus in a eukaryotic organism or a non-human organism.

In some embodiments, target polynucleotide modification using the subject engineered retron and the associated composition, vectors, system and methods comprises addition, deletion, or substitution of 1-about 10 k nucleotides at each target sequence of said polynucleotide of said cell(s). The modification can include the addition, deletion, or substitution of at least 1, 5, 10, 11, 12, 13, 14, 15, 16, 17, 18, 19, 20, 21, 22, 23, 24, 25, 26, 27, 28, 29, 30, 35, 40, 45, 50, 75, 100, 200, 250, 300, 500, 1000, 1500, 2000, 2500, 3000, 3500, 4000, 5000, 6000, 7000, 8000, 9000, 10,000 or more nucleotides at each target sequence.

In some embodiments, formation of system or complex results in cleavage, nicking, and/or another modification of one or both strands in or near (e.g. within 1, 2, 3, 4, 5, 6, 7, 8, 9, 10, 20, 50, or more base pairs from) the target sequence.

In some embodiments, a method of modifying a target polynucleotide in a cell to treat or prevent a disease can include allowing a composition, system, or component of the subject engineered retron to bind to the target polynucleotide, e.g., to effect cleavage, nicking, or other modification as the composition, system, is capable of said target polynucleotide, thereby modifying the target polynucleotide, wherein the composition, system, or component thereof, complex with a guide sequence, and hybridize said guide sequence to a target sequence within the target polynucleotide, wherein said guide sequence is optionally linked to a tracr mate sequence, which in turn can hybridize to a tracr sequence. In some embodiments, modification can include cleaving or nicking one or two strands at the location of the target sequence by one or more components of the composition, system, or component thereof.

In some embodiments, the engineered retron and the associated compositions, systems, vectors, uses, and methods of use, can be used to treat diseases of the circulatory system. In some embodiments, the treatment can be carried out by using an AAV or a lentiviral vector to deliver the engineered retron, composition, system, and/or vector described herein to modify hematopoietic stem cells (HSCs) or iPSCs in vivo or ex vivo. In some embodiments, the treatment can be carried out by correcting HSCs or iPSCs as to the disease using a composition, system, herein or a component thereof, wherein the composition, system, optionally includes a suitable HDR repair template (e.g., a template in the msDNA of the engineered retron).

In some embodiments, the treatment or prevention for treating a circulatory system or blood disease can include modifying a human cord blood cell. In some embodiments, the treatment or prevention for treating a circulatory system or blood disease can include modifying a granulocyte colony-stimulating factor-mobilized peripheral blood cell (mPB) with any modification described herein. In some embodiments, the human cord blood cell or mPB can be CD34$^+$. In some embodiments, the cord blood cells or mPB cells modified are autologous. In some embodiments, the cord blood cells or mPB cells are allogenic. In addition to the modification of the disease genes, allogenic cells can be further modified using the composition, system, described herein to reduce the immunogenicity of the cells when delivered to the recipient. The modified cord blood cells or mPB cells can be optionally expanded in vitro. The modified cord blood cell(s) or mPB cells can be derived to a subject in need thereof using any suitable delivery technique.

The composition and system may be engineered to target genetic locus or loci in HSCs. In some embodiments, the components of the systems can be codon-optimized for a eukaryotic cell and especially a mammalian cell, e.g., a human cell, for instance, HSC, or iPSC and sgRNA targeting a locus or loci in HSC, such as circulatory disease, can be prepared. These may be delivered via particles, such as the lipid nanoparticle delivery system described herein. The particles may be formed by the components of the systems herein being admixed.

In some embodiments, after ex vivo modification the HSCs or iPCS can be expanded prior to administration to the subject. Expansion of HSCs can be via any suitable method such as that described by, Lee, "Improved ex vivo expansion of adult hematopoietic stem cells by overcoming CUL4-mediated degradation of HOXB4." Blood. 2013 May 16; 121(20):4082-9. doi: 10.1182/blood-2012-09-455204. Epub 2013 Mar. 21.

In some embodiments, the HSCs or iPSCs modified are autologous. In some embodiments, the HSCs or iPSCs are allogenic. In addition to the modification of the disease genes, allogenic cells can be further modified using the composition, system, described herein to reduce the immunogenicity of the cells when delivered to the recipient.

In some embodiments, the engineered retron and the associated compositions, systems, vectors, uses, and methods of use, can be used to treat neurological diseases. In some embodiments, the neurological diseases comprise diseases of the brain and CNS.

Delivery options for the diseases in the brain include encapsulation of the systems in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors or vector systems of the invention. In other embodiments, an artificial virus can be generated for CNS and/or brain delivery.

In some embodiments, the engineered retron and the associated compositions, systems, vectors, uses, and methods of use, can be used to treat hearing diseases or hearing loss in one or both ears. Deafness is often caused by lost or damaged hair cells that cannot relay signals to auditory neurons. In some embodiments, the composition, system, or modified cells can be delivered to one or both ears for treating or preventing hearing disease or loss by any suitable method or technique known in the art, such as US20120328580 (e.g., auricular administration), by intratympanic injection (e.g., into the middle ear), and/or injections into the outer, middle, and/or inner ear; administration in situ, via a catheter or pump (U.S. 2006/0030837) and Jacobsen (U.S. Pat. No. 7,206,639). Also see US20120328580. Cells resulting from such methods can then be transplanted or implanted into a patient in need of such treatment.

In some embodiments, the engineered retron and the associated compositions, systems, vectors, uses, and methods of use, can be used to treat diseases in non-dividing cells. Exemplary non-dividing cells include muscle cells or neurons. In such cells, homologous recombination (HR) is generally suppressed in the G1 cell-cycle phase, but can be turned back on using art-recognized methods, such as Orthwein et al. (Nature. 2015 Dec. 17; 528(7582): 422-426).

In some embodiments, the engineered retron and the associated compositions, systems, vectors, uses, and methods of use, can be used to treat diseases of the eye.

In some embodiments, the engineered retron and the associated compositions, systems, vectors, uses, and methods of use, can be used to treat muscle diseases and cardiovascular diseases.

In some embodiments, the engineered retron and the associated compositions, systems, vectors, uses, and methods of use, can be used to treat diseases of the liver and kidney.

In some embodiments, the engineered retron and the associated compositions, systems, vectors, uses, and methods of use, can be used to treat epithelial and lung diseases.

In some embodiments, the engineered retron and the associated compositions, systems, vectors, uses, and methods of use, can be used to treat diseases of the skin.

In some embodiments, the engineered retron and the associated compositions, systems, vectors, uses, and methods of use, can be used to treat cancer.

In some embodiments, the engineered retron and the associated compositions, systems, vectors, uses, and methods of use, can be used in adoptive cell therapy.

In some embodiments, the engineered retron and the associated compositions, systems, vectors, uses, and methods of use, can be used to treat infectious diseases.

In some embodiments, the engineered retron and the associated compositions, systems, vectors, uses, and methods of use, can be used to treat mitochondrial diseases.

All publications, published patent documents, and patent applications cited herein are hereby incorporated by reference to the same extent as though each individual publication, published patent document, or patent application was specifically and individually indicated as being incorporated by reference.

O. Sequences

The instant Specification discloses and claims recombinant retrons and components thereof (e.g., recombinant ncRNAs and recombinant retron RTs), as well as genome modification systems comprising said recombinant retrons and/or recombinant components thereof. Without limitation, such systems include recombinant retron-based genome editing systems, recombineering systems, and cell-recording systems. The Specification also discloses and claims the various components and aspects making up the systems, as well as their uses and applications, including without limitation: (a) recombinant nucleic acid molecules encoding recombinant retrons and retron-based genome modification systems, (b) vector systems (including viral and non-viral) comprising one or more components of said retron-based genome modification systems, including all-DNA vector systems, all-RNA vector systems, and DNA/RNA vector systems, (c) delivery systems for delivering said vector systems and/or components of the retron-based genome modification systems (e.g., lipid particles, lipid nanoparticles, and other delivery vehicle formats), (d) formulations comprising any of the aforementioned components for delivery to cells and/or tissues, including in vitro, in vivo, and ex vivo delivery, (e) cells modified by the recombinant retron-based genome modification systems and methods described herein, and (f) methods of modifying cells by conducting genome editing, recombineering, or cell recording using the herein disclosed retron-based genome modification systems, (g) methods of making the recombinant retrons, retron-based genome modification systems, vectors, and formulations described herein, and (h) pharmaceutical compositions and kits for modifying cells under in vitro, in vivo, and ex vivo conditions.

The recombinant retrons and retron-based genome modification systems described herein can be made, in various embodiments, by introducing one or more modifications into a known retron, e.g., a retron that is publicly known (Group I retrons) or a novel retron that is found in nature but which has not previously been recognized or described (Group II retrons). Examples of such retron sequences (and in some cases sequences of their components) are disclosed herein and summarized below:

Table X: Previously Known Retron Reverse Transcriptases

Table X provides non-limiting examples of 1928 retron reverse transcriptases (AA sequences associated with each NCBI Accession No. assigned to sequence identifiers SEQ ID NO: 19413-21341) that may be modified in accordance with the herein methods to obtain a recombinant retron reverse transcriptase for use in the compositions, systems, and methods described herein. These retron sequences were reported in Mestre et al., "Systematic Prediction of Genes Functionally Associated with Bacterial Retrons and Classification of The Encoded Tripartite Systems," Nucleic Acids Research, Volume 48, Issue 22, 16 Dec. 2020, Pages 12632-12647, the contents of which are incorporated herein by reference. In some embodiments, the Table X retrons are meant to be excluded from the scope of the claimed subject matter.

| NCBI Accession[a] | Species/strain | Retron name (if applicable) | SEQ ID NO: 19413-to-21341 |
|---|---|---|---|
| fig\|670897.3.peg.2382 | Escherichia coli 2362-75 | | 19413 |
| WP_000111473.1 | Escherichia coli | Retron-Eco7 (Ec78) | |
| fig\|286156.4.peg.5031 | Photorhabdus australis | | |
| fig\|171439.3.peg.1995 | Photorhabdus luminescens subsp. luminescens | | |
| fig\|1004151.3.peg.110 | Photorhabdus khanii NC19 | | |
| fig\|1736225.3.peg.2969 | Erwinia sp. Leaf53 | | |
| fig\|1897730.3.peg.2912 | Citrobacter sp. CFSAN044567 | | |
| fig\|286156.4.peg.5031 | Aeromonas australiensis | | |
| fig\|1460083.3.peg.4429 | Serratia liquefaciens FK01 | | |
| fig\|585.10.peg.2369 | Proteus vulgaris | | |
| WP_140315795.1 | Vibrio parahaemolyticus | Retron-Vpa1 (Vp96) [g] | |
| fig\|670.147.peg.3463 | Vibrio parahaemolyticus | | |
| fig\|1516159.4.peg.4737 | Vibrio coralliirubri | | |
| fig\|190893.12.peg.246 | Vibrio coralliilyticus | | |
| fig\|643674.5.peg.820 | Paenalcaligenes hominis | | |
| fig\|1122619.3.peg.2381 | Oligella ureolytica DSM 18253 | | |
| fig\|29489.5.peg.3423 | Aeromonas enteropelogenes | | |
| fig\|1899355.18.peg.3566 | Oceanospirillaceae bacterium | | |
| fig\|49186.3.peg.4362 | Marinobacterium stanieri | | |
| fig\|672.375.peg.4377 | Vibrio vulnificus | | |
| fig\|584.202.peg.1668 | Proteus mirabilis | | |
| fig\|394935.10.peg.4407 | Chromobacterium haemolyticum | | |
| fig\|1196083.117.peg.637 | Snodgrassella alvi | | |
| fig\|1196083.120.peg.2046 | Snodgrassella alvi | | |
| fig\|1196083.114.peg.825 | Snodgrassella alvi | | |
| fig\|550.250.peg.2975 | Enterobacter cloacae | | |
| fig\|680.27.peg.793 | Vibrio campbellii | | |
| fig\|1348393.3.peg.352 | Pseudoalteromonas sp. H105 | | |
| fig\|644.85.peg.4392 | Aeromonas hydrophila | | |
| fig\|1234128.4.peg.4777 | Vibrio parahaemolyticus SNUVpS-1 | | |

-continued

| NCBI Accession[a] | Species/strain | Retron name (if applicable) | SEQ ID NO: 19413-to-21341 |
|---|---|---|---|
| fig\|69219.6.peg.2213 | *Enterobacter cloacae* subsp. *dissolvens* | | |
| fig\|208224.13.peg.2962 | *Enterobacter kobei* | | |
| fig\|672.332.peg.2758 | *Vibrio vulnificus* | | |
| fig\|1777131.3.peg.2267 | *Chromobacterium* sp. F49 | | |
| fig\|945550.3.peg.1167 | *Vibrio sinaloensis* DSM 21326 | | |
| fig\|648.75.peg.922 | *Aeromonas caviae* | | |
| fig\|1238221.3.peg.2053 | *Vibrio parahaemolyticus* VPTS-2009 | | |
| fig\|56192.3.peg.3860 | *Photobacterium iliopiscarium* | | |
| fig\|1806667.7.peg.3169 | *Marinomonas gallaica* | | |
| fig\|272773.3.peg.1019 | *Salinivibrio costicola* subsp. *alcaliphilus* | | |
| WP_073265166.1 | *Pseudomonas punonensis* | | |
| fig\|1946584.3.peg.2789 | *Halomonas* sp. UBA3074 | | |
| fig\|2030880.3.peg.665 | SAR86 cluster bacterium | | |
| fig\|80854.14.peg.530 | *Moritella viscosa* | | |
| fig\|1902503.3.peg.1072 | *Marinomonas* sp. QM202 | | |
| fig\|1122212.3.peg.1985 | *Marinospirillum minutulum* DSM 6287 | | |
| fig\|40576.4.peg.4387 | *Xenorhabdus bovienii* | | |
| fig\|287094.3.peg.78 | *Alteromonas addita* | | |
| fig\|1805633.3.peg.1469 | *Acinetobacter* sp. SFA | | |
| fig\|1945927.3.peg.1017 | *Acinetobacter* sp. UBA1497 | | |
| fig\|202956.9.peg.1680 | *Acinetobacter towneri* | | |
| fig\|1811612.3.peg.155 | Moraxellaceae bacterium REDSEA-S32_B1 | | |
| fig\|573.14330.peg.438 | *Klebsiella pneumoniae* | | |
| fig\|470.1294.peg.971 | *Acinetobacter baumannii* | | |
| fig\|762966.3.peg.2452 | *Parasutterella excrementihominis* YIT 11859 | | |
| fig\|470.3514.peg.1550 | *Acinetobacter baumannii* | | |
| fig\|470.2538.peg.3022 | *Acinetobacter baumannii* | | |
| fig\|48296.130.peg.276 | *Acinetobacter pittii* | | |
| fig\|663.91.peg.4688 | *Vibrio alginolyticus* | | |
| fig\|296199.3.peg.4813 | *Vibrio gigantis* | | |
| fig\|1367490.3.peg.3583 | *Aliivibrio fischeri* ETJB5C | | |
| fig\|326537.3.peg.3698 | *Colwellia polaris* | | |
| fig\|1175631.4.peg.4191 | *Pectobacterium wasabiae* CFBP 3304 | | |
| WP_001403504.1 | *Escherichia coli* | Retron-Eco4 (Ec83) | |
| fig\|549.21.peg.1734 | *Pantoea agglomerans* | | |
| fig\|140100.3.peg.2972 | *Vibrio cholerae* | | |
| fig\|693153.4.peg.1176 | *Vibrio atlanticus* | | |
| fig\|1238430.3.peg.1911 | *Vibrio nigripulchritudo* AM115 | | |
| fig\|1123036.3.peg.144 | *Psychromonas arctica* DSM 14288 | | |
| fig\|173990.3.peg.3319 | *Rheinheimera pacifica* | | |
| fig\|1869214.4.peg.3809 | *Rheinheimera* sp. | | |
| fig\|1898113.7.peg.1514 | Idiomarinaceae bacterium | | |
| fig\|29484.39.peg.1876 | *Yersinia frederiksenii* | | |
| fig\|1761793.3.peg.274 | *Marinobacter* sp. DSM 26671 | | |
| fig\|587.48.peg.2666 | *Providencia rettgeri* | | |
| fig\|573.4147.peg.1684 | *Klebsiella pneumoniae* | | |
| fig\|1263833.3.peg.2872 | *Serratia marcescens* VGH107 | | |
| fig\|1690502.3.peg.467 | *Pantoea* sp. CFSAN033090 | | |
| fig\|1029989.3.peg.5037 | *Salmonella enterica* subsp. *enterica* serovar *Agona* str. 0292 | | |
| fig\|211759.3.peg.770 | *Serratia marcescens* | | |
| fig\|29483.5.peg.2283 | *Yersinia aldovae* | | |
| fig\|1268238.3.peg.3466 | *Escherichia coli* O5:K4(L):H4 str. ATCC 23502 | | |
| fig\|548.121.peg.2368 | *Klebsiella aerogenes* | | |
| fig\|196024.6.peg.1825 | *Aeromonas dhakensis* | | |
| fig\|386429.3.peg.3784 | *Pseudoalteromonas* sp. BSi20495 | | |
| fig\|666.2089.peg.3167 | *Vibrio cholerae* | | |
| WP_159353404.1 | *Vibrio cholerae* | Retron-Vch1 (Vc95) | |
| fig\|670.362.peg.2186 | *Vibrio parahaemolyticus* | | |
| fig\|615.398.peg.1671 | *Serratia marcescens* | | |
| fig\|571.188.peg.5401 | *Klebsiella oxytoca* | | |
| fig\|1389422.3.peg.2794 | *Klebsiella pneumoniae* LAU-KP1 | | |
| fig\|1082704.3.peg.1242 | *Lonsdalea britannica* | | |
| fig\|1686379.3.peg.3365 | *Citrobacter* sp. MGH104 | | |
| fig\|83655.55.peg.221 | *Leclercia adecarboxylata* | | |
| fig\|550.532.peg.617 | *Enterobacter cloacae* | | |
| fig\|349965.6.peg.153 | *Yersinia intermedia* ATCC 29909 | | |

-continued

| NCBI Accession[a] | Species/strain | Retron name (if applicable) | SEQ ID NO: 19413-to-21341 |
|---|---|---|---|
| fig\|1947028.3.peg.31 | *Pantoea* sp. UBA2708 | | |
| fig\|29484.34.peg.3725 | *Yersinia frederiksenii* | | |
| fig\|314608.4.peg.222 | *Shewanella benthica* KT99 | | |
| fig\|585.16.peg.3620 | *Proteus vulgaris* | | |
| fig\|1117313.3.peg.4128 | *Pseudoalteromonas arctica* A 37-1-2 | | |
| fig\|1236543.3.peg.1328 | *Shewanella putrefaciens* JCM 20190 = NBRC 3908 | | |
| fig\|550.520.peg.1818 | *Enterobacter cloacae* | | |
| fig\|592316.4.peg.43 | *Pantoea* sp. At-9b | | |
| fig\|1903177.3.peg.4556 | *Vibrio* sp. 10N.261.45.E1 | | |
| fig\|1435069.3.peg.925 | *Vibrio tritonius* | | |
| fig\|666.3258.peg.1211 | *Vibrio cholerae* | | |
| fig\|1579504.3.peg.1822 | *Shewanella* sp. ECSMB14102 | | |
| fig\|727.548.peg.1576 | *Haemophilus influenzae* | | |
| EIJ70524.1 | *Haemophilus parahaemolyticus* HK385 | | |
| fig\|1121935.3.peg.14 | *Hahella ganghwensis* DSM 17046 | | |
| fig\|400668.8.peg.2509 | *Marinomonas* sp. MWYL1 | | |
| fig\|1777491.3.peg.1212 | *Alteromonas* sp. Mac1 | | |
| fig\|2013797.3.peg.1728 | Gammaproteobacteria bacterium HGW-Gammaproteobacteria-15 | | |
| fig\|1008297.7.peg.4158 | *Salmonella enterica* subsp. *enterica* serovar *Typhimurium* str. 798 | | |
| EDM6246721.1 | *Salmonella enterica* subsp. *enterica* serovar *Typhimurium* | Retron-Sen2 (St85) | |
| fig\|421.19.peg.3278 | *Methylomonas methanica* | | |
| fig\|758.17.peg.102 | *Rodentibacter pneumotropicus* | | |
| fig\|726.60.peg.864 | *Haemophilus haemolyticus* | | |
| fig\|1035188.3.peg.348 | *Haemophilus pittmaniae* HK 85 | | |
| fig\|670.79.peg.3738 | *Vibrio parahaemolyticus* | | |
| fig\|1481663.12.peg.913 | *Vibrio metoecus* | | |
| fig\|1123402.3.peg.611 | *Thorsellia anophelis* DSM 18579 | | |
| fig\|668.83.peg.3088 | *Aliivibrio fischeri* | | |
| fig\|290110.6.peg.2319 | *Xenorhabdus budapestensis* | | |
| fig\|568766.10.peg.822 | *Dickeya* sp. NCPPB 3274 | | |
| fig\|470.4268.peg.2217 | *Acinetobacter baumannii* | | |
| fig\|1977881.3.peg.1569 | *Acinetobacter* sp. ANC 4470 | | |
| fig\|548.171.peg.2395 | *Klebsiella aerogenes* | | |
| fig\|584.105.peg.1823 | *Proteus mirabilis* | | |
| fig\|1275975.3.peg.1756 | *Salmonella enterica* subsp. *enterica* serovar *Newport* str. Henan_3 | | |
| fig\|615.474.peg.3994 | *Serratia marcescens* | | |
| fig\|61647.13.peg.3699 | *Pluralibacter gergoviae* | | |
| fig\|549.22.peg.222 | *Pantoea agglomerans* | | |
| fig\|991944.3.peg.3216 | *Vibrio cholerae* HE-25 | | |
| WP_001022871.1 | *Vibrio cholerae* | Retron-Vch2 (Vc81) | |
| fig\|1638949.3.peg.1051 | *Vibrio* sp. ECSMB14106 | | |
| fig\|73010.3.peg.2815 | *Aeromonas encheleia* | | |
| fig\|1444141.3.peg.3893 | *Escherichia coli* 3-373-03_S3_C1 | | |
| fig\|232.5.peg.1080 | *Alteromonas* sp. | | |
| fig\|1175295.3.peg.21 | *Pseudoalteromonas* sp. PAMC 22718 | | |
| fig\|265726.7.peg.3430 | *Photobacterium halotolerans* | | |
| WP_009585554.1 | *Acinetobacter* | | |
| fig\|2004649.3.peg.1632 | *Acinetobacter* sp. WCHA29 | | |
| fig\|1324350.3.peg.2817 | *Acinetobacter equi* | | |
| fig\|2048003.3.peg.1682 | *Alteromonas flava* | | |
| fig\|571.171.peg.5963 | *Klebsiella oxytoca* | | |
| fig\|573.4060.peg.3574 | *Klebsiella pneumoniae* | | |
| fig\|1173850.3.peg.2995 | *Salmonella enterica* subsp. *enterica* serovar *Indiana* str. ATCC 51959 | | |
| fig\|1123516.3.peg.1267 | *Hydrogenovibrio halophilus* DSM 15072 | | |
| fig\|1981674.3.peg.1814 | *Pseudomonas* sp. R9(2017) | | |
| fig\|1947311.3.peg.2053 | *Pseudomonas* sp. UBA2684 | | |
| fig\|1198309.3.peg.4291 | *Pseudomonas fluorescens* ICMP 11288 | | |
| fig\|715451.3.peg.1743 | *Alteromonas naphthalenivorans* | | |
| fig\|316.285.peg.730 | *Pseudomonas stutzeri* | | |
| fig\|1190606.3.peg.313 | *Enterovibrio calviensis* 1F-211 | | |
| WP_009176189.1 | | | |
| WP_097050713.1 | *Thalassospira xiamenensis* | | |
| fig\|1208323.3.peg.893 | *Celeribacter baekdonensis* B30 | | |
| KZK95863.1 | *Pseudovibrio* sp. Ad46 | | |
| fig\|101571.310.peg.3956 | *Burkholderia ubonensis* | | |

| NCBI Accession[a] | Species/strain | Retron name (if applicable) | SEQ ID NO: 19413-to-21341 |
|---|---|---|---|
| fig\|1882791.3.peg.1790 | Burkholderia sp. CF099 | | |
| fig\|1736536.3.peg.4809 | Variovorax sp. Root434 | | |
| PIG30812.1 | Janthinobacterium sp. 35 | | |
| fig\|1798244.3.peg.1046 | Gallionellales bacterium GWA2_55_18 | | |
| fig\|1131551.3.peg.1124 | Methylotenera sp. 1P/1 | | |
| fig\|1843082.3.peg.1574 | Macromonas sp. BK-30 | | |
| fig\|279058.16.peg.4721 | Collimonas arenae | | |
| fig\|1548123.6.peg.1144 | Pusillimonas sp. T2 | | |
| fig\|380394.4.peg.276 | Acidithiobacillus ferrooxidans ATCC 53993 | | |
| WP_080292858.1 | | | |
| fig\|101571.162.peg.3605 | Burkholderia ubonensis | | |
| fig\|1382803.3.peg.22 | Chromobacterium amazonense | | |
| fig\|930.4.peg.3851 | Acidithiobacillus thiooxidans | | |
| fig\|1261658.3.peg.1787 | Bibersteinia trehalosi Y31 | | |
| fig\|1679001.3.peg.631 | Pasteurellaceae bacterium NI1060 | | |
| fig\|1334187.3.peg.653 | Haemophilus influenzae KR494 | | |
| fig\|1581107.3.peg.1286 | Neisseria sp. HMSC15G01 | | |
| fig\|486.24.peg.152 | Neisseria lactamica | | |
| fig\|1953412.3.peg.1956 | bacterium UBP10 UBA1160 | | |
| WP_090322045.1 | Nitrosomonas oligotropha | | |
| fig\|2013740.3.peg.1400 | Deltaproteobacteria bacterium HGW-Deltaproteobacteria-13 | | |
| fig\|1907413.3.peg.3170 | Rhizobium sp. RU33A | | |
| fig\|1817963.3.peg.856 | Roseomonas deserti | | |
| fig\|2035448.3.peg.1752 | Rhizobium sp. C5 | | |
| WP_014077019.1 | | | |
| fig\|1648404.4.peg.2797 | Erythrobacter atlanticus | | |
| fig\|359.11.peg.6331 | Agrobacterium rhizogenes | | |
| fig\|887144.4.peg.573 | Rhizobium taibaishanense | | |
| fig\|1116389.3.peg.333 | Devosia insulae DS-56 | | |
| fig\|121719.10.peg.3421 | Pannonibacter phragmitetus | | |
| fig\|34002.6.peg.3570 | Paracoccus alcaliphilus | | |
| fig\|1940281.4.peg.1560 | Hoeflea sp. | | |
| fig\|1040981.5.peg.1561 | Mesorhizobium ciceri WSM4083 | | |
| fig\|410764.3.peg.807 | Rhizobium multihospitium | | |
| fig\|1825934.3.peg.3111 | Rhizobium anhuiense | | |
| fig\|1952824.3.peg.3061 | Rhodobiaceae bacterium UBA3976 | | |
| fig\|1871086.3.peg.2153 | Brevundimonas sp. | | |
| fig\|588932.9.peg.647 | Brevundimonas naejangsanensis | | |
| fig\|1951751.3.peg.1538 | Erythrobacteraceae bacterium UBA1460 | | |
| fig\|1843368.3.peg.904 | Sphingobium sp. RAC03 | | |
| fig\|155892.10.peg.3219 | Caulobacter vibrioides | | |
| fig\|43057.4.peg.4537 | Rhodobacter azotoformans | | |
| fig\|1514904.3.peg.974 | Ahrensia marina | | |
| fig\|1338034.3.peg.722 | Vibrio parahaemolyticus O1:Kuk str. FDA R31 | | |
| fig\|150340.18.peg.1837 | Vibrio antiquarius | | |
| fig\|196024.5.peg.3821 | Aeromonas dhakensis | | |
| fig\|244366.32.peg.1886 | Klebsiella variicola | | |
| fig\|180957.35.peg.1654 | Pectobacterium brasiliense | | |
| fig\|55601.149.peg.665 | Vibrio anguillarum | | |
| fig\|121723.5.peg.2901 | Photobacterium sp. SKA34 | | |
| fig\|584.170.peg.837 | Proteus mirabilis | | |
| fig\|40324.136.peg.3276 | Stenotrophomonas maltophilia | | |
| fig\|1122188.5.peg.411 | Lysobacter spongiicola DSM 21749 | | |
| fig\|2032566.3.peg.2826 | Xanthomonadaceae bacterium NML93-0792 | | |
| fig\|287.1731.peg.2578 | Pseudomonas aeruginosa | | |
| fig\|251702.3.peg.1529 | Pseudomonas syringae pv. antirrhini | | |
| fig\|1960829.3.peg.5912 | Pseudomonas sp. MF6394 | | |
| fig\|76759.17.peg.5093 | Pseudomonas monteilii | | |
| fig\|1981678.3.peg.5241 | Pseudomonas sp. R45(2017) | | |
| fig\|1699620.3.peg.3028 | Pseudomonas sp. RIT-PI-r | | |
| fig\|191391.4.peg.2140 | Pseudomonas salomonii | | |
| fig\|1844093.4.peg.7190 | Pseudomonas sp. 22 E 5 | | |
| fig\|287.1744.peg.1414 | Pseudomonas aeruginosa | | |
| fig\|287.1987.peg.910 | Pseudomonas aeruginosa | | |
| fig\|287.4372.peg.4481 | Pseudomonas aeruginosa | | |
| fig\|1856685.4.peg.2159 | Pseudomonas sp. TCU-HL1 | | |
| fig\|1718920.3.peg.3357 | Pseudomonas sp. ICMP 8385 | | |
| fig\|1781066.3.peg.2816 | Duganella sp. HH101 | | |
| fig\|95485.5.peg.60 | Burkholderia stabilis | | |

-continued

| NCBI Accession[a] | Species/strain | Retron name (if applicable) | SEQ ID NO: 19413-to-21341 |
|---|---|---|---|
| fig\|1572871.6.peg.588 | Janthinobacterium sp. BJB304 | | |
| WP_034208069.1 | Burkholderia cepacia | | |
| WP_074283015.1 | Burkholderia sp. GAS332 | | |
| fig\|1168169.3.peg.2570 | Methylomonas sp. 11b | | |
| fig\|1899355.16.peg.1328 | Oceanospirillaceae bacterium | | |
| WP_093197597.1 | Variovorax sp. YR750 | | |
| fig\|1660091.3.peg.1650 | Bordetella sp. SCN 67-23 | | |
| fig\|134375.17.peg.4387 | Achromobacter sp. | | |
| fig\|426114.10.peg.1990 | Thiomonas arsenitoxydans | | |
| fig\|1947551.3.peg.1903 | Stenotrophomonas sp. UBA2302 | | |
| fig\|1914330.4.peg.2242 | Salinisphaera sp. | | |
| fig\|1947037.3.peg.890 | Pantoea sp. UBA5707 | | |
| WP_094422719.1 | Kosakonia cowanii | | |
| WP_079496884.1 | | | |
| WP_088126255.1 | Enterobacter kobei | | |
| WP_049614309.1 | Yersinia | | |
| WP_048263135.1 | Pectobacterium peruviense | | |
| WP_040197602.1 | Klebsiella pneumoniae | | |
| fig\|669.34.peg.1586 | Vibrio harveyi | | |
| fig\|672.219.peg.1032 | Vibrio vulnificus | | |
| fig\|670.1028.peg.1775 | Vibrio parahaemolyticus | | |
| WP_065207673.1 | Photobacterium phosphoreum | | |
| fig\|1869214.3.peg.2231 | Rheinheimera sp. | | |
| WP_029795910.1 | Vibrio parahaemolyticus | | |
| fig\|1191302.3.peg.1081 | Vibrio crassostreae 9ZC77 | | |
| fig\|668.70.peg.1192 | Aliivibrio fischeri | | |
| fig\|28229.4.peg.4229 | Colwellia psychrerythraea | | |
| fig\|1855726.3.peg.270 | Burkholderia sp. KK1 | | |
| fig\|1674888.3.peg.829 | Burkholderiales bacterium Beta_02 | | |
| fig\|687412.4.peg.1108 | Pseudorhodobacter aquimaris | | |
| WP_092465129.1 | Donghicola eburneus | | |
| fig\|1120653.3.peg.5479 | Ensifer sp. LC384 | | |
| fig\|121719.5.peg.401 | Pannonibacter phragmitetus | | |
| fig\|1798804.3.peg.1597 | Rhizobium sp. 58 | | |
| fig\|1946675.3.peg.3089 | Kordiimonas sp. UBA4487 | | |
| fig\|36861.5.peg.1400 | Thiobacillus denitrificans | | |
| fig\|1115835.3.peg.1003 | Methylotenera versatilis 79 | | |
| fig\|1797188.3.peg.1508 | Acidobacteria bacterium RIFCSPLOWO2_12_FULL_60_22 | | |
| fig\|57320.3.peg.123 | Pseudodesulfovibrio profundus | | |
| fig\|1267534.3.peg.1238 | Acidobacteriaceae bacterium KBS 89 | | |
| fig\|1951344.3.peg.527 | Acidobacteriaceae bacterium UBA1307 | | |
| WP_006226461.1 | Achromobacter marplatensis | | |
| fig\|1503054.4.peg.5764 | Burkholderia stagnalis | | |
| WP_006159686.1 | Cupriavidus basilensis | | |
| WP_090191767.1 | unclassified Duganella | | |
| fig\|539.8.peg.1698 | Eikenella corrodens | | |
| fig\|1946925.3.peg.2129 | Micavibrio sp. UBA5701 | | |
| WP_047031309.1 | Hoeflea sp. IMCC20628 | | |
| fig\|1946134.3.peg.1092 | Brevundimonas sp. UBA6547 | | |
| WP_093914930.1 | Sulfitobacter marinus | | |
| fig\|1862950.3.peg.1234 | Rhizobiales bacterium NRL2 | | |
| fig\|1166078.4.peg.1483 | Aureimonas phyllosphaerae | | |
| fig\|709015.3.peg.734 | Pontibacter actiniarum DSM 19842 | | |
| WP_092160028.1 | Desulfovibrio ferrireducens | | |
| fig\|2026749.3.peg.3364 | Ignavibacteriae bacterium | | |
| WP_033771991.1 | Pantoea agglomerans | | |
| WP_097097099.1 | unclassified Enterobacteriaceae (miscellaneous) | | |
| fig\|1444151.3.peg.2733 | Escherichia coli 2-177-06_S3_C2 | | |
| WP_137545672.1 | Escherichia coli | Retron-Eco3 (Ec73) | |
| fig\|573.14856.peg.3852 | Klebsiella pneumoniae | | |
| WP_072021595.1 | Serratia marcescens | | |
| fig\|29571.3.peg.478 | Halomonas subglaciescola | | |
| WP_004534676.1 | | | |
| WP_095622523.1 | Halomonas sp. WRN001 | | |
| fig\|376427.4.peg.3223 | Halomonas gudaonensis | | |
| fig\|862908.3.peg.745 | Halobacteriovorax marinus SJ | | |
| SCJ40239.1 | uncultured Clostridium sp. | | |
| fig\|717962.3.peg.287 | Coprococcus catus GD/7 | | |
| WP_014642259.1 | Halobacillus halophilus | | |
| fig\|2009042.3.peg.2106 | Pseudomonas sp. Irchel 3H7 | | |

-continued

| NCBI Accession[a] | Species/strain | Retron name (if applicable) | SEQ ID NO: 19413-to-21341 |
|---|---|---|---|
| fig\|1981718.3.peg.4346 | *Pseudomonas* sp. B39(2017) | | |
| fig\|665135.13.peg.1401 | *Pseudomonas* sp. In5 | | |
| fig\|1949067.3.peg.5629 | *Pseudomonas* sp. PICF141 | | |
| WP_007948552.1 | *Pseudomonas* sp. GM21 | | |
| SFB61662.1 | *Delftia tsuruhatensis* | | |
| WP_011615687.1 | | | |
| WP_014778098.1 | | | |
| fig\|1429083.4.peg.2612 | *Pseudomonas hussainii* | | |
| WP_095024014.1 | *Pseudomonas* | | |
| WP_090203690.1 | *Pseudomonas asplenii* | | |
| fig\|564423.8.peg.1646 | *Pseudomonas tolaasii* NCPPB 2192 | | |
| WP_078802277.1 | *Pseudomonas fluorescens* | | |
| WP_090453229.1 | *Pseudomonas* | | |
| fig\|1306420.5.peg.1032 | *Burkholderia pseudomallei* MSHR5848 | | |
| fig\|1357270.3.peg.1923 | *Pseudomonas syringae* UB246 | | |
| fig\|2018067.3.peg.2950 | *Pseudomonas* sp. FDAARGOS_380 | | |
| fig\|317.311.peg.3241 | *Pseudomonas syringae* | | |
| fig\|287.2309.peg.126 | *Pseudomonas aeruginosa* | | |
| WP_039522442.1 | *Pectobacterium brasiliense* | | |
| WP_080861357.1 | *Klebsiella pneumoniae* | | |
| WP_014542745.1 | *Erwinia* sp. Ejp617 | | |
| OSL25696.1 | *Escherichia coli* TA255 | | |
| fig\|1125693.3.peg.761 | *Proteus mirabilis* WGLW4 | | |
| KMK80587.1 | *Pectobacterium atrosepticum* ICMP 1526 | | |
| fig\|550.717.peg.2037 | *Enterobacter cloacae* | | |
| ACS86154.1 | *Dickeya paradisiaca* Ech703 | | |
| WP_050122514.1 | *Yersinia frederiksenii* | | |
| WP_081334048.1 | *Alteromonas macleodii* | | |
| WP_055016254.1 | *Pseudoalteromonas* sp. P1-13-1a | | |
| fig\|56799.5.peg.478 | *Colwellia* sp. | | |
| fig\|666.3375.peg.2486 | *Vibrio cholerae* | | |
| PIW62005.1 | *Shewanella* sp. CG12_big_fil_rev_8_21_14_0_65_47_15 | | |
| OCA54994.1 | *Photorhabdus namnaonensis* | | |
| CNK75559.1 | *Yersinia frederiksenii* | | |
| WP_024248662.1 | *Escherichia* | | |
| WP_088618141.1 | *Methylovulum psychrotolerans* | | |
| WP_051669880.1 | | | |
| PCJ98666.1 | Alteromonadaceae bacterium | | |
| WP_081919471.1 | *Acidithiobacillus ferrivorans* | | |
| WP_055769167.1 | *Stenotrophomonas* | | |
| WP_039422954.1 | *Xanthomonas vesicatoria* | | |
| WP_078568253.1 | *Xanthomonas campestris* | | |
| WP_093486747.1 | unclassified *Pseudoxanthomonas* | | |
| WP_077445058.1 | *Rhodanobacter* sp. C05 | | |
| WP_092576562.1 | *Achromobacter* sp. NFACC18-2 | | |
| fig\|1330528.3.peg.2198 | *Escherichia coli* NCCP 15656 | | |
| fig\|83655.67.peg.2965 | *Leclercia adecarboxylata* | | |
| fig\|573.10044.peg.2850 | *Klebsiella pneumoniae* | | |
| WP_071888955.1 | Enterobacterales | | |
| fig\|1799789.3.peg.4357 | *Paraglaciecola hydrolytica* | | |
| fig\|2024839.8.peg.1563 | *Marinovum* sp. | | |
| fig\|1381081.7.peg.1167 | *Vibrio panuliri* | | |
| fig\|670.908.peg.3444 | *Vibrio parahaemolyticus* | | |
| fig\|626887.3.peg.2431 | *Marinobacter nanhaiticus* D15-8W | | |
| fig\|1913989.101.peg.1616 | Gammaproteobacteria bacterium | | |
| fig\|262489.9.peg.2938 | delta proteobacterium MLMS-1 | | |
| fig\|2035207.3.peg.545 | *Janthinobacterium* sp. 67 | | |
| fig\|28095.13.peg.1040 | *Burkholderia gladioli* | | |
| fig\|941449.3.peg.1262 | *Desulfovibrio* sp. X2 | | |
| fig\|1768806.3.peg.778 | Rhodospirillaceae bacterium CCH5-H10 | | |
| WP_083634830.1 | *Desulfovibrio* sp. DV | | |
| fig\|1231.4.peg.574 | *Nitrosospira multiformis* | | |
| fig\|604089.3.peg.1142 | *Flavobacterium sinopsychrotolerans* | | |
| fig\|357523.3.peg.1851 | *Flavobacterium* sp. 11 | | |
| fig\|1423323.5.peg.321 | *Flavobacterium* sp. AED | | |
| fig\|178356.3.peg.502 | *Flavobacterium xinjiangense* | | |
| fig\|1946545.3.peg.3457 | *Flavobacterium* sp. UBA4120 | | |
| fig\|150146.3.peg.2822 | *Flavobacterium gillisiae* | | |
| fig\|229203.4.peg.1981 | *Flavobacterium degerlachei* | | |
| fig\|280093.5.peg.432 | *Flavobacterium granuli* | | |
| fig\|728056.4.peg.1154 | *Flavobacterium oncorhynchi* | | |
| fig\|143224.8.peg.2343 | *Zobellia uliginosa* | | |

-continued

| NCBI Accession[a] | Species/strain | Retron name (if applicable) | SEQ ID NO: 19413-to-21341 |
|---|---|---|---|
| fig\|1225176.3.peg.4300 | Cecembia lonarensis LW9 | | |
| fig\|1434700.3.peg.581 | Moheibacter sediminis | | |
| fig\|996.47.peg.468 | Flavobacterium columnare | | |
| fig\|172045.56.peg.2231 | Elizabethkingia miricola | | |
| fig\|2024823.3.peg.2086 | Altibacter sp. | | |
| fig\|2026728.18.peg.4090 | Crocinitomicaceae bacterium | | |
| fig\|980584.3.peg.2930 | Aquimarina agarivorans | | |
| fig\|1946744.3.peg.1682 | Leeuwenhoekiella sp. UBA1003 | | |
| fig\|1046627.3.peg.2526 | Bizionia argentinensis JUB59 | | |
| fig\|906888.15.peg.37 | Nonlabens ulvanivorans | | |
| fig\|407022.4.peg.2865 | Olivibacter domesticus | | |
| fig\|1500282.3.peg.3713 | Chryseobacterium sp. CF365 | | |
| WP_084550290.1 | Chryseobacterium scophthalmum | | |
| fig\|190304.8.peg.741 | Fusobacterium nucleatum subsp. nucleatum ATCC 25586 | | |
| fig\|1352.1731.peg.603 | Enterococcus faecium | | |
| fig\|1428.658.peg.666 | Bacillus thuringiensis | | |
| fig\|1497681.3.peg.3095 | Listeria newyorkensis | | |
| fig\|1396.1440.peg.4237 | Bacillus cereus | | |
| fig\|1917876.3.peg.2997 | Blautia sp. Marseille-P3087 | | |
| fig\|1952168.3.peg.215 | Lachnospiraceae bacterium UBA7480 | | |
| fig\|1907659.3.peg.1085 | Blautia sp. Marseille-P3201T | | |
| fig\|1265309.16.peg.461 | Epibacterium mobile F1926 | | |
| fig\|853.163.peg.215 | Faecalibacterium prausnitzii | | |
| fig\|1264.5.peg.4 | Ruminococcus albus | | |
| fig\|1500289.3.peg.4469 | Chryseobacterium sp. OV705 | | |
| fig\|1197728.3.peg.2386 | Prevotella conceptionensis 9403948 | | |
| fig\|1947486.3.peg.2515 | Sphingobacterium sp. UBA1897 | | |
| fig\|529.12.peg.1303 | Ochrobactrum anthropi | | |
| fig\|1523429.3.peg.2936 | Rhizobium sp. AAP116 | | |
| fig\|1761878.3.peg.469 | Paenibacillus sp. cl6col | | |
| fig\|1462996.4.peg.2634 | Paenibacillus yonginensis | | |
| fig\|582475.4.peg.4724 | Lysinibacillus xylanilyticus | | |
| fig\|1773.7915.peg.7638 | Mycobacterium tuberculosis | | |
| fig\|360310.3.peg.4853 | Bacillus sp. CDB3 | | |
| fig\|1396.515.peg.2936 | Bacillus cereus | | |
| fig\|662367.4.peg.242 | Spirosoma endophyticum | | |
| fig\|1895719.3.peg.2950 | Bacteroidales bacterium 45-6 | | |
| fig\|906888.9.peg.926 | Nonlabens ulvanivorans | | |
| fig\|694433.3.peg.2346 | Saprospira grandis DSM 2844 | | |
| fig\|1167006.5.peg.2941 | Desulfocapsa sulfexigens DSM 10523 | | |
| fig\|649724.3.peg.304 | Clostridium sp. ATCC BAA-442 | | |
| fig\|1505.32.peg.2959 | Paeniclostridium sordellii | | |
| fig\|1953142.3.peg.1858 | Bacteroidetes bacterium UBA1947 | | |
| fig\|2029590.3.peg.2754 | Mucilaginibacter sp. MD40 | | |
| fig\|29581.33.peg.2300 | Janthinobacterium lividum | | |
| fig\|40324.292.peg.236 | Stenotrophomonas maltophilia | | |
| fig\|1403329.3.peg.287 | Listeria monocytogenes Lm25180 | | |
| fig\|1121865.3.peg.1262 | Enterococcus columbae DSM 7374 = ATCC 51263 | | |
| fig\|1120746.3.peg.3113 | bacterium MS4 | | |
| fig\|1952299.3.peg.221 | Ruminococcaceae bacterium UBA2656 | | |
| fig\|1965604.3.peg.686 | Anaeromassilibacillus sp. An250 | | |
| fig\|1673717.3.peg.805 | Anaeromassilibacillus senegalensis | | |
| WP_116884683.1 | Victivallis vadensis | | |
| fig\|1948697.3.peg.196 | Lentisphaeria bacterium UBA4640 | | |
| fig\|1232460.3.peg.46 | Clostridiales bacterium VE202-28 | | |
| WP_007864340.1 | Clostridiales | | |
| WP_055649738.1 | Hungatella hathewayi | | |
| fig\|1226325.3.peg.2005 | Clostridium sp. KLE 1755 | | |
| fig\|1432052.10.peg.3166 | Eisenbergiella tayi | | |
| fig\|208479.8.peg.4376 | Enterocloster bolteae | | |
| fig\|1298920.3.peg.1959 | [Desulfotomaculum] guttoideum DSM 4024 | | |
| fig\|1776047.3.peg.4241 | Clostridium sp. C105KSO15 | | |
| fig\|1946596.3.peg.2399 | Hungatella sp. UBA4396 | | |
| fig\|1946603.3.peg.924 | Hungatella sp. UBA7603 | | |
| fig\|1410651.3.peg.407 | [Clostridium] aerotolerans DSM 5434 | | |
| fig\|1697784.3.peg.9617 | Clostridia bacterium UC5.1-1D4 | | |
| fig\|1745713.3.peg.3865 | Bariatricus massiliensis | | |
| fig\|180332.3.peg.1515 | Robinsoniella peoriensis | | |
| WP_072851604.1 | Lactonifactor longoviformis | | |
| WP_003507561.1 | Clostridiales | | |
| fig\|1111728.3.peg.587 | Budvicia aquatica DSM 5075 = ATCC 35567 | | |

-continued

| NCBI Accession[a] | Species/strain | Retron name (if applicable) | SEQ ID NO: 19413-to-21341 |
|---|---|---|---|
| fig\|1122977.4.peg.2473 | *Pragia fontium* DSM 5563 = ATCC 49100 | | |
| fig\|1950915.3.peg.189 | Clostridiales bacterium UBA644 | | |
| fig\|1950927.3.peg.912 | Clostridiales bacterium UBA7187 | | |
| ERK60856.1 | *Oscillibacter* sp. KLE 1728 | | |
| WP_009260579.1 | *Flavonifractor plautii* | | |
| fig\|1235797.3.peg.2409 | *Oscillibacter* sp. 1-3 | | |
| fig\|1520815.3.peg.1262 | Ruminococcaceae bacterium D5 | | |
| fig\|1855302.3.peg.1138 | *Pseudobutyrivibrio* sp. JW11 | | |
| fig\|43305.5.peg.3631 | *Butyrivibrio proteoclasticus* | | |
| fig\|411463.15.peg.1791 | *Eubacterium ventriosum* ATCC 27560 | | |
| fig\|1235792.3.peg.3837 | *Lachnospiraceae bacterium* M18-1 | | |
| fig\|97139.3.peg.669 | *Schaedlerella arabinosiphila* | | |
| fig\|1291051.3.peg.1165 | *Mediterraneibacter glycyrrhizinilyticus* JCM 13369 | | |
| fig\|1532.6.peg.4793 | *Blautia coccoides* | | |
| fig\|1121114.4.peg.5478 | *Blautia producta* ATCC 27340 = DSM 2950 | | |
| fig\|1262776.3.peg.1908 | *Clostridium* sp. CAG:149 | | |
| fig\|1262792.3.peg.1164 | *Clostridium* sp. CAG:299 | | |
| fig\|1262995.3.peg.2852 | Firmicutes bacterium CAG:646 | | |
| fig\|537007.17.peg.3146 | *Blautia hansenii* DSM 20583 | | |
| fig\|1965569.3.peg.1928 | *Lachnoclostridium* sp. An169 | | |
| fig\|1952411.3.peg.2018 | Ruminococcaceae bacterium UBA6353 | | |
| fig\|1965578.3.peg.1947 | *Pseudoflavonifractor* sp. An187 | | |
| WP_001775049.1 | *Escherichia coli* | Retron-Eco5 (Ec107) | |
| WP_012602583.1 | | | |
| WP_015962464.1 | Enterobacteriaceae bacterium strain FGI 57 | | |
| fig\|1005999.3.peg.3342 | *Leminorella grimontii* ATCC 33999 = DSM 5078 | | |
| fig\|1378073.3.peg.795 | *Enterobacter* sp. CC120223-11 | | |
| fig\|911023.3.peg.138 | *Yokenella regensburgei* ATCC 49455 | | |
| fig\|1834193.3.peg.4113 | *Enterococcus* sp. 9E7_DIV0242 | | |
| fig\|1649188.10.peg.406 | *Listeria goaensis* | | |
| fig\|1430899.3.peg.278 | *Listeria fleischmannii* 1991 | | |
| fig\|1211844.4.peg.748 | *Candidatus Stoquefichus massiliensis* AP9 | | |
| fig\|1658109.3.peg.34 | *Candidatus Stoquefichus* sp. SB1 | | |
| fig\|1262793.3.peg.950 | *Clostridium* sp. CAG:302 | | |
| fig\|1262908.3.peg.1120 | *Mycoplasma* sp. CAG:956 | | |
| fig\|1674844.3.peg.242 | Clostridiales bacterium Firm_06 | | |
| fig\|1410672.3.peg.2823 | *Ruminococcus flavefaciens* ND2009 | | |
| fig\|1947424.3.peg.1718 | *Ruminococcus* sp. UBA4310 | | |
| fig\|1265.9.peg.2602 | *Ruminococcus flavefaciens* | | |
| fig\|1336236.3.peg.1817 | *Ruminococcus flavefaciens* ATCC 19208 | | |
| CDC65895.1 | *Ruminococcus* sp. CAG:57 | | |
| WP_092946213.1 | Ruminococcaceae bacterium YRB3002 | | |
| fig\|1307.1644.peg.1532 | *Streptococcus suis* | | |
| WP_050516365.1 | *Escherichia coli* | | |
| WP_097505494.1 | *Escherichia coli* | Retron-Eco6 (Ec48) | |
| fig\|573.15585.peg.2343 | *Klebsiella pneumoniae* | | |
| WP_023581669.1 | *Proteus hauseri* | | |
| WP_079656969.1 | *Serratia marcescens* | | |
| WP_090085157.1 | *Phytobacter* sp. SCO41 | | |
| fig\|573.15584.peg.1543 | *Klebsiella pneumoniae* | | |
| WP_023330997.1 | *Enterobacter cloacae* complex | | |
| fig\|72407.673.peg.2552 | *Klebsiella pneumoniae* subsp. *pneumoniae* | | |
| CNM01182.1 | *Yersinia pseudotuberculosis* | | |
| CNG88012.1 | *Yersinia enterocolitica* | | |
| fig\|1925763.3.peg.649 | *Marinobacter salexigens* | | |
| PKW24121.1 | *Marinobacter* sp. LV10R510-8 | | |
| WP_045597342.1 | *Vibrio vulnificus* | | |
| WP_098972386.1 | *Aeromonas* sp. CU5 | | |
| WP_005172873.1 | *Yersinia enterocolitica* | | |
| WP_052979504.1 | Enterobacteriaceae | | |
| WP_083069261.1 | *Pantoea vagans* | | |
| WP_053911905.1 | *Pseudoalteromonas* sp. SW0106-04 | | |
| fig\|1916082.18.peg.39 | Alteromonadaceae bacterium | | |
| WP_046555216.1 | *Arsukibacterium* sp. MJ3 | | |
| KPW01986.1 | *Pseudoalteromonas* sp. P1-8 | | |

| NCBI Accession[a] | Species/strain | Retron name (if applicable) | SEQ ID NO: 19413-to-21341 |
|---|---|---|---|
| WP_094277737.1 | *Oceanimonas baumannii* | | |
| fig\|1414654.3.peg.2005 | *Oceanisphaera psychrotolerans* | | |
| WP_008133621.1 | unclassified *Pseudoalteromonas* | | |
| KQA22543.1 | *Vibrio metoecus* | | |
| WP_000284440.1 | *Vibrio cholerae* | | |
| WP_011261677.1 | *Aliivibrio fischeri* | | |
| KEE40622.1 | | | |
| WP_012982829.1 | | | |
| ALL66139.1 | *Paraburkholderia caribensis* MBA4 | | |
| WP_093223969.1 | *Pseudomonas vancouverensis* | | |
| fig\|2015553.3.peg.2940 | *Pseudomonas* sp. PGPPP1 | | |
| WP_096082869.1 | *Pseudomonas aeruginosa* | | |
| ONM67687.1 | *Pseudomonas aeruginosa* | | |
| fig\|316.213.peg.2906 | *Pseudomonas stutzeri* | | |
| WP_078734267.1 | *Pseudomonas fluorescens* | | |
| WP_079384669.1 | *Pseudomonas aeruginosa* | | |
| WP_095948157.1 | *Variovorax boronicumulans* | | |
| WP_011625020.1 | *Shewanella* sp. MR-7 | | |
| WP_100292553.1 | *Aeromonas cavernicola* | | |
| WP_055021484.1 | *Pseudoalteromonas* sp. P1-26 | | |
| PHS01491.1 | *Oceanobacter* sp. | | |
| fig\|2024618.3.peg.1141 | *Acinetobacter* sp. BS1 | | |
| WP_114139108.1 | *Klebsiella pneumoniae* | | |
| WP_077749737.1 | *Pseudomonas* sp. FSL W5-0299 | | |
| WP_078451378.1 | *Pseudomonas aeruginosa* | | |
| WP_007245785.1 | *Pseudomonas syringae* group | | |
| fig\|316.280.peg.1454 | *Pseudomonas stutzeri* | | |
| WP_086822222.1 | *Pseudomonas aeruginosa* | | |
| WP_073268605.1 | *Pseudomonas punonensis* | | |
| WP_095280108.1 | *Lelliottia jeotgali* | | |
| WP_095715328.1 | *Citrobacter* sp. TSA-1 | | |
| WP_050111525.1 | *Yersinia* | | |
| WP_013724211.1 | *Aeromonas veronii* | | |
| WP_021140819.1 | *Aeromonas salmonicida* | | |
| fig\|1094342.5.peg.1611 | *Alcanivorax xenomutans* | | |
| fig\|1932666.4.peg.1886 | *Haliea* sp. | | |
| WP_087148323.1 | *Crenothrix polyspora* | | |
| WP_064022638.1 | *Methylomonas* sp. DH-1 | | |
| PIY64876.1 | *Shewanella* sp. CG_4_10_14_0_8_um_filter_42_13 | | |
| WP_006710190.1 | *Vibrio ichthyoenteri* | | |
| WP_045040928.1 | *Photobacterium iliopiscarium* | | |
| WP_054543201.1 | *Vibrio splendidus* | | |
| WP_080540293.1 | *Vibrio vulnificus* | | |
| fig\|2032624.3.peg.2540 | *Halomonas* sp. WN018 | | |
| KJT50308.1 | *Salmonella enterica* subsp. *enterica* serovar *Heidelberg* str. RI-11-014588 | Retron-Sen1 (Se72) | |
| WP_005761319.1 | | | |
| ODQ05744.1 | *Shigella* sp. FC130 | | |
| KKW01006.1 | Candidatus Saccharibacteria bacterium GW2011_GWC2_48_9 | | |
| KMZ12260.1 | Candidatus *Burkholderia humilis* | | |
| SFQ04394.1 | *Ralstonia* sp. NFACC01 | | |
| WP_025373922.1 | *Advenella mimigardefordensis* | | |
| WP_093341200.1 | *Variovorax* sp. PDC80 | | |
| WP_091453700.1 | *Giesbergeria anulus* | | |
| SAY51889.1 | *Neisseria weaveri* | | |
| WP_065255232.1 | *Moraxella lacunata* | | |
| WP_049330876.1 | *Neisseria* | | |
| fig\|1196095.197.peg.151 | *Gilliamella apicola* | | |
| WP_072956843.1 | *Vibrio gazogenes* | | |
| fig\|857087.3.peg.3286 | *Methylomonas methanica* MC09 | | |
| fig\|1952222.3.peg.1307 | Methylococcaceae bacterium UBA3127 | | |
| WP_039486261.1 | *Vibrio sinaloensis* | | |
| WP_065545234.1 | *Vibrio scophthalmi* | | |
| WP_033094845.1 | *Colwellia psychrerythraea* | | |
| WP_057552475.1 | *Vibrio cholerae* | | |
| WP_004726393.1 | *Vibrio furnissii* | | |
| fig\|2020862.3.peg.1934 | *Halobacteriovorax* sp. | | |
| fig\|624.1260.peg.1437 | *Shigella sonnei* | | |
| WP_011516221.1 | Burkholderiales | | |
| fig\|1947370.3.peg.1923 | *Pusillimonas* sp. UBA4517 | | |
| WP_038400955.1 | *Yersinia pseudotuberculosis* | | |

-continued

| NCBI Accession[a] | Species/strain | Retron name (if applicable) | SEQ ID NO: 19413-to-21341 |
|---|---|---|---|
| fig\|1951903.3.peg.117 | Halieaceae bacterium UBA3099 | | |
| WP_024914507.1 | Chania multitudinisentens | | |
| WP_042893228.1 | Enterobacteriaceae | | |
| WP_038238211.1 | Xenorhabdus szentirmaii | | |
| EXI65661.1 | Candidatus Accumulibacter sp. SK-12 | | |
| WP_016452106.1 | Delftia | | |
| WP_013517170.1 | Alicycliphilus denitrificans | | |
| OXC73828.1 | Caballeronia sordidicola | | |
| AIO65205.1 | Burkholderia oklahomensis | | |
| WP_013234866.1 | Herbaspirillum seropedicae | | |
| WP_082884385.1 | Piscirickettsiaceae bacterium NZ-RLO1 | | |
| fig\|2006849.4.peg.371 | Xanthomonadales bacterium | | |
| WP_074262787.1 | Paraburkholderia phenazinium | | |
| WP_009906786.1 | Burkholderia thailandensis | | |
| WP_022524328.1 | | | |
| WP_081817450.1 | Halomonas sp. HL-48 | | |
| WP_020312233.1 | Pseudomonas syringae | | |
| KPY75916.1 | Pseudomonas amygdali pv. tabaci | | |
| fig\|1793966.3.peg.180 | Pseudomonas fluvialis | | |
| fig\|1891229.16.peg.2033 | Pseudomonadales bacterium | | |
| WP_099454886.1 | Pseudomonas putida | | |
| WP_092400423.1 | Pseudomonas sp. NFACC39-1 | | |
| WP_012315430.1 | Pseudomonas putida | | |
| WP_020799819.1 | Pseudomonas sp. G5(2012) | | |
| WP_004574016.1 | | | |
| fig\|1435425.3.peg.787 | Pseudomonas sp. QTF5 | | |
| WP_045490543.1 | Pseudomonas sp. StFLB209 | | |
| WP_011506503.1 | Chromohalobacter salexigens | | |
| fig\|1609967.3.peg.3047 | Halomonas sp. HG01 | | |
| fig\|1492738.3.peg.2698 | Flavobacterium seoulense | | |
| WP_092849245.1 | Algibacter pectinivorans | | |
| WP_025835957.1 | Bacteroides | | |
| fig\|2025877.3.peg.668 | Parabacteroides sp. AT13 | | |
| fig\|246787.6.peg.2081 | Bacteroides cellulosilyticus | | |
| fig\|1339287.3.peg.1113 | Bacteroides fragilis str. 3986 T (B) 9 | | |
| fig\|1946017.3.peg.1516 | Alistipes sp. UBA940 | | |
| WP_038655380.1 | Mucinivorans hirudinis | | |
| WP_093669272.1 | Tenacibaculum sp. MAR_2009_124 | | |
| WP_073241067.1 | Flavobacterium flevense | | |
| WP_096193803.1 | Cytophagales bacterium TFI 002 | | |
| WP_076357635.1 | | | |
| WP_073238193.1 | Pedobacter caeni | | |
| WP_076451370.1 | | | |
| WP_091906542.1 | Porphyromonadaceae bacterium KH3R12 | | |
| WP_051365712.1 | Flavobacterium saliperosum | | |
| fig\|1938609.3.peg.1765 | Flavobacterium sp. LM4 | | |
| SDJ72221.1 | Flavobacterium noncentrifugens | | |
| fig\|1985174.3.peg.2584 | Chitinophagaceae bacterium IBVUCB2 | | |
| WP_092737749.1 | Riemerella columbipharyngis | | |
| fig\|192149.3.peg.42 | Muricauda sp. | | |
| fig\|418630.3.peg.1685 | Rhodobacter megalophilus | | |
| fig\|1915314.3.peg.3469 | Thioclava sp. DLFJ5-1 | | |
| fig\|2030815.3.peg.2725 | Marinosulfonomonas sp. | | |
| fig\|2035451.3.peg.4632 | Rhizobium sp. L18 | | |
| WP_043872258.1 | Celeribacter indicus | | |
| WP_055683826.1 | Jannaschia rubra | | |
| fig\|1947537.3.peg.498 | Sphingopyxis sp. UBA6198 | | |
| WP_069065961.1 | Sphingobium sp. RAC03 | | |
| WP_084280100.1 | Novosphingobium sp. B1 | | |
| fig\|1895845.3.peg.487 | Sphingobium sp. 66-54 | | |
| GAK73419.1 | Agrobacterium rubi TR3 = NBRC 13261 | | |
| WP_090966398.1 | Aureimonas phyllosphaerae | | |
| WP_091860144.1 | Bosea robiniae | | |
| WP_085092006.1 | Azospirillum oryzae | | |
| fig\|1528100.4.peg.28 | Methylomagnum ishizawai | | |
| fig\|32057.3.peg.9515 | Calothrix sp. PCC 7103 | | |
| fig\|103690.10.peg.3571 | Nostoc sp. PCC 7120 = FACHB-418 | | |
| fig\|1137095.11.peg.15 | Scytonema sp. HK-05 | | |
| CDZ48826.1 | Neorhizobium galegae bv. officinalis | | |
| WP_072340070.1 | Devosia enhydra | | |
| OYR18277.1 | Ochrobactrum thiophenivorans | | |
| WP_093509439.1 | Sphingopyxis sp. YR583 | | |
| WP_081799025.1 | Novosphingobium resinovorum | | |

-continued

| NCBI Accession[a] | Species/strain | Retron name (if applicable) | SEQ ID NO: 19413-to-21341 |
|---|---|---|---|
| PIY55545.1 | Zetaproteobacteria bacterium CG_4_10_14_0_8_um_filter_49_80 | | |
| SDT44912.1 | *Bradyrhizobium canariense* | | |
| WP_096350346.1 | | | |
| WP_074962594.1 | *Jannaschia rubra* | | |
| WP_038724888.1 | *Burkholderia pseudomallei* | | |
| WP_012217410.1 | *Burkholderia multivorans* | | |
| WP_100428762.1 | *Janthinobacterium* sp. 67 | | |
| WP_082161008.1 | Candidatus *Competibacter denitrificans* | | |
| AFL73219.1 | *Thiocystis violascens* DSM 198 | | |
| WP_014427842.1 | | | |
| fig\|364030.3.peg.3554 | *Thiomonas delicata* | | |
| KGW20495.1 | *Burkholderia pseudomallei* MSHR2451 | | |
| SFE83076.1 | *Variovorax* sp. OK212 | | |
| WP_013028226.1 | *Sideroxydans lithotrophicus* | | |
| WP_080311424.1 | *Burkholderia pseudomallei* | | |
| fig\|337.13.peg.3872 | *Burkholderia glumae* | | |
| WP_082643860.1 | *Pseudomonas* | | |
| CKH90039.1 | *Pseudomonas aeruginosa* | | |
| WP_083287254.1 | unclassified *Janthinobacterium* | | |
| WP_122648546.1 | *Burkholderia pseudomallei* | | |
| WP_082706753.1 | unclassified *Pseudomonas* | | |
| WP_080936076.1 | *Klebsiella pneumoniae* | | |
| WP_000746343.1 | Enterobacteriaceae | | |
| EMX54653.1 | *Escherichia coli* MP020980.2 | | |
| WP_053270700.1 | *Escherichia coli* | | |
| fig\|1736224.3.peg.3731 | *Serratia* sp. Leaf51 | | |
| fig\|1175299.4.peg.709 | *Dickeya zeae* ZJU1202 | | |
| WP_001461245.1 | Enterobacteriaceae | | |
| fig\|617145.3.peg.3535 | *Vibrio splendidus* 1F-157 | | |
| fig\|1440054.3.peg.3851 | *Vibrio* sp. OY15 | | |
| fig\|617135.3.peg.594 | *Aliivibrio fischeri* ZF-211 | | |
| WP_023267764.1 | *Shewanella decolorationis* | | |
| fig\|1481663.36.peg.3628 | *Vibrio metoecus* | | |
| fig\|670.893.peg.2716 | *Vibrio parahaemolyticus* | | |
| fig\|680.33.peg.5391 | *Vibrio campbellii* | | |
| fig\|298386.8.peg.4344 | *Photobacterium profundum* SS9 | | |
| fig\|663.73.peg.714 | *Vibrio alginolyticus* | | |
| fig\|1333511.3.peg.3208 | *Pseudoalteromonas haloplanktis* TAB23 | | |
| WP_064574154.1 | *Hafnia paralvei* | | |
| WP_064645509.1 | *Obesumbacterium proteus* | | |
| fig\|630.105.peg.4248 | *Yersinia enterocolitica* | | |
| fig\|400673.7.peg.1969 | *Legionella pneumophila* str. *Corby* | | |
| WP_092678546.1 | *Rosenbergiella nectarea* | | |
| WP_069476513.1 | *Raoultella ornithinolytica* | | |
| fig\|1267535.3.peg.2394 | Bryobacterales bacterium KBS 96 | | |
| WP_000446053.1 | *Acinetobacter baumannii* | | |
| fig\|1948587.3.peg.786 | Gammaproteobacteria bacterium UBA1902 | | |
| WP_014949305.1 | *Alteromonas macleodii* | | |
| fig\|1797397.3.peg.2386 | Bdellovibrionales bacterium RIFOXYC1 FULL 54 43 | | |
| fig\|1386968.3.peg.847 | *Francisella tularensis* subsp. *novicida* PA10-7858 | | |
| WP_074900850.1 | | | |
| fig\|1975705.3.peg.898 | *Psychrobacter* sp. FDAARGOS_221 | | |
| WP_066184577.1 | Arcobacter | | |
| fig\|1780380.4.peg.4010 | Eubacteriaceae bacterium CHKCI004 | | |
| fig\|556261.3.peg.2546 | *Clostridium* sp. D5 | | |
| fig\|1193534.6.peg.2375 | uncultured *Flavonifractor* sp. | | |
| fig\|1042163.3.peg.3771 | *Brevibacillus laterosporus* LMG 15441 | | |
| WP_062492190.1 | *Paenibacillus* sp. 320-W | | |
| WP_081674606.1 | *Lactobacillus harbinensis* | | |
| WP_050781686.1 | *Lactobacillus coryniformis* | | |
| WP_021109137.1 | *Enterococcus faecium* | | |
| WP_046309803.1 | *Staphylococcus* | | |
| CBL03706.1 | *Gordonibacter pamelaeae* 7-10-1-b | | |
| WP_090944285.1 | *Pelosinus propionicus* | | |
| WP_077305443.1 | *Clostridium beijerinckii* | | |
| fig\|410072.5.peg.40 | *Coprococcus comes* | | |
| WP_011669870.1 | *Leptospira borgpetersenii* | | |
| WP_015565235.1 | *Faecalibacterium prausnitzii* | | |
| CUO23478.1 | *Faecalibacterium prausnitzii* | | |

-continued

| NCBI Accession[a] | Species/strain | Retron name (if applicable) | SEQ ID NO: 19413-to-21341 |
|---|---|---|---|
| WP_085748688.1 | *Rhizobacter gummiphilus* | | |
| WP_093270014.1 | *Psychrobacillus* sp. OK032 | | |
| SHE86352.1 | *Atopostipes suicloacalis* DSM 15692 | | |
| WP_000346292.1 | unclassified *Streptococcus* | | |
| WP_080465410.1 | *Lactobacillus plantarum* | | |
| WP_080662531.1 | *Lactobacillus brevis* | | |
| WP_093131554.1 | *Salinibacillus kushneri* | | |
| WP_093336905.1 | *Salibacterium halotolerans* | | |
| fig\|1974627.3.peg.386 | Candidatus Levybacteria bacterium CG_4_9_14_0_2_um_filter_35_21 | | |
| fig\|1802603.3.peg.453 | Candidatus Woykebacteria bacterium RIFCSPHIGHO2_12_FULL_45_10 | | |
| fig\|392734.5.peg.3006 | *Terriglobus roseus* | | |
| AGL61879.1 | Candidatus *Saccharimonas aalborgensis* | | |
| fig\|319224.16.peg.2726 | *Shewanella putrefaciens* CN-32 | | |
| fig\|1720343.3.peg.1263 | *Pseudoalteromonas* sp. 1_2015MBL_MicDiv | | |
| fig\|1136158.3.peg.3691 | *Vibrio cyclitrophicus* 1F97 | | |
| fig\|666.3017.peg.1000 | *Vibrio cholerae* | | |
| fig\|1909458.3.peg.2277 | *Salinivibrio* sp. ML198 | | |
| fig\|1638949.3.peg.831 | *Vibrio* sp. ECSMB14106 | | |
| fig\|493915.3.peg.158 | *Pseudoalteromonas* sp. NJ631 | | |
| BAC94535.1 | *Vibrio vulnificus* YJ016 | | |
| fig\|1191313.3.peg.1135 | *Vibrio splendidus* 1S-124 | | |
| fig\|670.1244.peg.3807 | *Vibrio parahaemolyticus* | | |
| fig\|1659714.3.peg.4264 | *Citrobacter braakii* | | |
| fig\|1192730.4.peg.1976 | *Salmonella enterica* subsp. *enterica* serovar Kintambo | | |
| fig\|550.1216.peg.4296 | *Enterobacter cloacae* | | |
| WP_072269713.1 | *Serratia* | | |
| WP_053898075.1 | *Escherichia coli* | | |
| fig\|624.1264.peg.1635 | *Shigella sonnei* | | |
| fig\|1181777.3.peg.78 | *Escherichia coli* KTE233 | | |
| fig\|1802256.3.peg.310 | *Sulfurimonas* sp. RIFOXYB12_FULL_35_9 | | |
| PHR73342.1 | *Arcobacter* sp. | | |
| fig\|2014260.3.peg.3813 | bacterium (Candidatus Blackallbacteria) CG13_big_fil_rev_8_21_14_2_50_49_14 | | |
| WP_042497590.1 | *Vibrio maritimus* | | |
| WP_063522799.1 | *Vibrio* sp. HI00D65 | | |
| WP_004186757.1 | Enterobacteriaceae | | |
| WP_040122746.1 | *Vibrio* | | |
| WP_086046550.1 | *Vibrio harveyi* group | | |
| WP_063849005.1 | *Enterobacter cloacae* | | |
| WP_023486614.1 | Enterobacteriaceae | | |
| WP_070992278.1 | *Pseudoalteromonas byunsanensis* | | |
| fig\|1005665.3.peg.2532 | *Kosakonia oryzendophytica* | | |
| fig\|1219066.3.peg.3636 | *Vibrio parahaemolyticus* NBRC 12711 | | |
| fig\|1225184.4.peg.1222 | *Pantoea* sp. A4 | | |
| fig\|675814.3.peg.1256 | *Vibrio coralliilyticus* ATCC BAA-450 | | |
| SFR59865.1 | *Pseudobutyrivibrio* sp. NOR37 | | |
| fig\|853.16.peg.1112 | *Faecalibacterium prausnitzii* | | |
| fig\|1965572.3.peg.1423 | *Pseudoflavonifractor* sp. An176 | | |
| fig\|588581.3.peg.3589 | *Ruminiclostridium papyrosolvens* DSM 2782 | | |
| fig\|1396.1409.peg.4169 | *Bacillus cereus* | | |
| fig\|1428.538.peg.4047 | *Bacillus thuringiensis* | | |
| fig\|1465.16.peg.946 | *Brevibacillus laterosporus* | | |
| WP_087385137.1 | | | |
| AIF42417.1 | *Virgibacillus* sp. SK37 | | |
| WP_076543941.1 | *Halanaerobium kushneri* | | |
| fig\|1121093.3.peg.3089 | *Bacillus panaciterrae* DSM 19096 | | |
| fig\|29367.3.peg.2029 | *Clostridium puniceum* | | |
| WP_089719707.1 | *Halanaerobium congolense* | | |
| fig\|307249.3.peg.3585 | uncultured *Sporomusa* sp. | | |
| WP_072949666.1 | *Ruminococcus flavefaciens* | | |
| CCX81854.1 | *Ruminococcus* sp. CAG:108 | | |
| fig\|1491.669.peg.2217 | *Clostridium botulinum* | | |
| fig\|1872455.3.peg.401 | *Alkaliphilus* sp. | | |
| fig\|576117.5.peg.4005 | *Celeribacter halophilus* | | |
| fig\|1225647.3.peg.1829 | *Phaeobacter* sp. 11ANDIMAR09 | | |
| fig\|1380380.4.peg.1574 | *Ahrensia* sp. 13_GOM-1096m | | |

-continued

| NCBI Accession[a] | Species/strain | Retron name (if applicable) | SEQ ID NO: 19413-to-21341 |
|---|---|---|---|
| fig\|293.7.peg.2956 | *Brevundimonas diminuta* | | |
| WP_095437634.1 | *Rhizobium* sp. 11515TR | | |
| fig\|1912891.7.peg.702 | *Sphingobium* sp. | | |
| fig\|1736574.3.peg.4024 | *Pseudoxanthomonas* sp. Root630 | | |
| fig\|227946.13.peg.4105 | *Xanthomonas translucens* pv. *poae* | | |
| fig\|1761791.3.peg.4793 | *Lysobacter* sp. yr284 | | |
| fig\|1560195.5.peg.485 | *Janthinobacterium* sp. BJB301 | | |
| fig\|1503054.43.peg.6257 | *Burkholderia stagnalis* | | |
| fig\|1207504.10.peg.4279 | *Burkholderia pseudomultivorans* | | |
| WP_092172515.1 | unclassified *Pseudomonas* | | |
| WP_074815429.1 | *Pseudomonas syringae* | | |
| fig\|150146.3.peg.3162 | *Flavobacterium gillisiae* | | |
| fig\|76832.8.peg.3775 | *Myroides odoratimimus* | | |
| fig\|1202724.3.peg.994 | *Flavobacterium akiainvivens* | | |
| fig\|1805473.3.peg.3678 | *Chryseobacterium timonianum* | | |
| fig\|253.33.peg.3826 | *Chryseobacterium indologenes* | | |
| WP_076561634.1 | *Chryseobacterium indoltheticum* | | |
| fig\|2024823.3.peg.95 | *Altibacter* sp. | | |
| fig\|1250278.4.peg.3462 | *Salegentibacter* sp. Hel_I_6 | | |
| fig\|1797342.3.peg.689 | Bacteroidetes bacterium GWF2_33_38 | | |
| WP_084184261.1 | *Chryseobacterium ureilyticum* | | |
| fig\|1948560.3.peg.3003 | Deltaproteobacteria bacterium UBA6106 | | |
| fig\|1392.364.peg.2564 | *Bacillus anthracis* | | |
| fig\|872970.3.peg.1713 | *Amphibacillus marinus* | | |
| fig\|1385514.3.peg.313 | *Pontibacillus yanchengensis* Y32 | | |
| fig\|76853.4.peg.2614 | *Solibacillus silvestris* | | |
| fig\|1423774.3.peg.1262 | *Lactobacillus nantensis* DSM 16982 | | |
| fig\|1410670.3.peg.2844 | *Ruminococcus flavefaciens* MA2007 | | |
| fig\|169435.7.peg.1348 | *Anaerotruncus colihominis* | | |
| fig\|1946597.3.peg.2104 | *Hungatella* sp. UBA4568 | | |
| fig\|1948087.3.peg.796 | Firmicutes bacterium UBA6113 | | |
| fig\|642492.3.peg.2638 | *Cellulosilyticum lentocellum* DSM 5427 | | |
| fig\|1950841.3.peg.2383 | Clostridiales bacterium UBA2436 | | |
| fig\|555512.3.peg.1251 | *Salipiger marinus* | | |
| fig\|383381.3.peg.2538 | *Erythrobacter* sp. JL475 | | |
| WP_081629462.1 | | | |
| fig\|1736258.3.peg.3392 | *Methylobacterium* sp. Leaf112 | | |
| fig\|1950192.3.peg.426 | Anaerolineales bacterium UBA2232 | | |
| fig\|170623.6.peg.4661 | *Azotobacter beijerinckii* | | |
| fig\|170623.7.peg.704 | *Azotobacter beijerinckii* | | |
| fig\|1981099.3.peg.513 | *Niveispirillum lacus* | | |
| fig\|1250539.3.peg.3491 | *Pelagibaca abyssi* | | |
| fig\|1947582.3.peg.2979 | *Sulfitobacter* sp. UBA1132 | | |
| fig\|1909294.17.peg.3456 | Rhizobiales bacterium | | |
| fig\|1735583.3.peg.1657 | *Pseudovibrio* sp. W64 | | |
| fig\|670.1220.peg.4688 | *Vibrio parahaemolyticus* | | |
| fig\|1004786.3.peg.925 | *Alteromonas mediterranea* DE1 | | |
| fig\|2013797.3.peg.2109 | Gammaproteobacteria bacterium HGW-Gammaproteobacteria-15 | | |
| fig\|1948580.3.peg.3400 | Gammaproteobacteria bacterium UBA1012 | | |
| fig\|1714300.3.peg.306 | *Marinobacterium profundum* | | |
| fig\|1961547.3.peg.1371 | Desulfobulbaceae bacterium UBA2273 | | |
| fig\|441162.10.peg.6621 | *Burkholderia oklahomensis* C6786 | | |
| fig\|615.307.peg.4666 | *Serratia marcescens* | | |
| fig\|631.3.peg.1883 | *Yersinia intermedia* | | |
| fig\|1763535.3.peg.1547 | *Hydrogenophaga crassostreae* | | |
| fig\|43263.5.peg.2702 | *Pseudomonas alcaligenes* | | |
| fig\|244366.46.peg.3595 | *Klebsiella variicola* | | |
| fig\|1224150.8.peg.3856 | *Dickeya paradisiaca* NCPPB 2511 | | |
| fig\|61645.10.peg.2019 | *Enterobacter asburiae* | | |
| fig\|1948706.3.peg.2225 | Opitutae bacterium UBA1333 | | |
| fig\|2026771.13.peg.1697 | Opitutae bacterium | | |
| fig\|2026771.11.peg.1955 | Opitutae bacterium | | |
| fig\|2026772.5.peg.424 | Opitutales bacterium | | |
| fig\|2026801.20.peg.1798 | Verrucomicrobiales bacterium | | |
| fig\|2026801.14.peg.1176 | Verrucomicrobiales bacterium | | |
| fig\|1951369.3.peg.1157 | Akkermansiaceae bacterium UBA6946 | | |
| fig\|1977087.12.peg.1918 | Proteobacteria bacterium | | |
| fig\|2026779.14.peg.4171 | Planctomycetaceae bacterium | | |
| fig\|2026779.28.peg.3264 | Planctomycetaceae bacterium | | |
| fig\|2026779.30.peg.3181 | Planctomycetaceae bacterium | | |
| fig\|2026779.29.peg.2310 | Planctomycetaceae bacterium | | |

-continued

| NCBI Accession[a] | Species/strain | Retron name (if applicable) | SEQ ID NO: 19413-to-21341 |
|---|---|---|---|
| fig\|1797235.3.peg.3 | *Acinetobacter* sp. RIFCSPHIGHO2_12_41_5 | | |
| fig\|316.284.peg.937 | *Pseudomonas stutzeri* | | |
| fig\|296.11.peg.442 | *Pseudomonas fragi* | | |
| fig\|1981714.3.peg.993 | *Pseudomonas* sp. B5(2017) | | |
| fig\|50340.44.peg.6020 | *Pseudomonas fuscovaginae* | | |
| fig\|1761897.3.peg.509 | *Pseudomonas* sp. ok272 | | |
| fig\|1402514.3.peg.154 | *Pseudomonas aeruginosa* BWHPSA014 | | |
| fig\|1938440.3.peg.5997 | *Pseudomonas* sp. T | | |
| fig\|1566250.3.peg.959 | *Pseudomonas* sp. NFACC02 | | |
| fig\|316.357.peg.479 | *Pseudomonas stutzeri* | | |
| fig\|287.4433.peg.2945 | *Pseudomonas aeruginosa* | | |
| fig\|1970515.3.peg.709 | Hydrogenophilales bacterium 12-61-10 | | |
| fig\|95486.85.peg.1748 | *Burkholderia cenocepacia* | | |
| fig\|292.61.peg.8104 | *Burkholderia cepacia* | | |
| fig\|1408450.3.peg.3766 | *Methylobacter tundripaludum* 21/22 | | |
| fig\|157910.3.peg.5727 | *Paraburkholderia tuberum* | | |
| fig\|279058.16.peg.4239 | *Collimonas arenae* | | |
| fig\|1537272.3.peg.1916 | *Janthinobacterium* sp. HH100 | | |
| fig\|1218081.3.peg.1751 | *Paraburkholderia kururiensis* subsp. *thiooxydans* NBRC 107107 | | |
| fig\|573.14059.peg.3113 | *Klebsiella pneumoniae* | | |
| fig\|40324.192.peg.51 | *Stenotrophomonas maltophilia* | | |
| fig\|1219041.3.peg.4613 | *Sphingomonas azotifigens* NBRC 15497 | | |
| fig\|1561196.3.peg.560 | *Burkholderia* sp. E7m39 | | |
| fig\|1882750.3.peg.1035 | *Burkholderia* sp. GAS332 | | |
| fig\|1736266.3.peg.1145 | *Duganella* sp. Leaf126 | | |
| fig\|2015350.3.peg.1640 | *Burkholderia* sp. AU18528 | | |
| fig\|58133.4.peg.815 | *Nitrosospira* sp. NpAV | | |
| fig\|1691980.3.peg.1912 | Rhodocyclaceae bacterium Paddy-1 | | |
| fig\|305.393.peg.1023 | *Ralstonia solanacearum* | | |
| fig\|56449.3.peg.3604 | *Xanthomonas bromi* | | |
| fig\|1281282.5.peg.1894 | *Xanthomonas campestris* pv. *campestris* str. CN14 | | |
| fig\|40324.334.peg.1103 | *Stenotrophomonas maltophilia* | | |
| fig\|1349793.3.peg.2529 | *Hydrogenophaga taeniospiralis* NBRC 102512 | | |
| fig\|1842727.3.peg.1491 | *Rhodoferax koreense* | | |
| fig\|1619952.3.peg.5158 | Burkholderiaceae bacterium 16 | | |
| fig\|1970380.3.peg.1914 | *Halothiobacillus* sp. 14-55-98 | | |
| fig\|2015568.3.peg.2963 | Burkholderiales bacterium PBB6 | | |
| fig\|1752215.3.peg.2312 | Gammaproteobacteria bacterium Ga0077554 | | |
| fig\|1706231.5.peg.3125 | *Janthinobacterium* sp. CG23_2 | | |
| fig\|2013716.3.peg.2169 | Betaproteobacteria bacterium HGW-Betaproteobacteria-4 | | |
| fig\|1946997.3.peg.3049 | *Nitrospira* sp. UBA7655 | | |
| fig\|765913.3.peg.2527 | *Thiorhodococcus drewsii* AZ1 | | |
| fig\|1743159.3.peg.1891 | *Polynucleobacter yangtzensis* | | |
| fig\|1597955.3.peg.3923 | *Limnohabitans* sp. DM1 | | |
| fig\|1184267.3.peg.1626 | *Bdellovibrio exovorus* JSS | | |
| fig\|101571.190.peg.3007 | *Burkholderia ubonensis* | | |
| fig\|123899.5.peg.1710 | *Bordetella trematum* | | |
| fig\|463035.3.peg.3900 | *Bordetella genomo* sp. 12 | | |
| fig\|1395608.4.peg.211 | *Bordetella genomo* sp. 5 | | |
| fig\|1947379.3.peg.2784 | *Rhodoferax* sp. UBA5149 | | |
| WP_074294985.1 | *Paraburkholderia phenazinium* | | |
| fig\|1324617.3.peg.820 | *Paraburkholderia aspalathi* | | |
| fig\|80868.3.peg.3458 | *Acidovorax cattleyae* | | |
| fig\|1388764.3.peg.1840 | *Pseudogulbenkiania ferrooxidans* EGD-HP2 | | |
| fig\|251747.15.peg.4695 | *Chromobacterium subtsugae* | | |
| fig\|670.1020.peg.382 | *Vibrio parahaemolyticus* | | |
| fig\|1055803.3.peg.1434 | *Pseudoalteromonas* sp. TB51 | | |
| fig\|1201036.3.peg.177 | *Pseudochrobactrum* sp. AO18b | | |
| fig\|1220581.4.peg.1434 | *Agrobacterium rhizogenes* NBRC 13257 | | |
| fig\|398.6.peg.6695 | *Rhizobium tropici* | | |
| fig\|931866.6.peg.8184 | *Bradyrhizobium ottawaense* | | |
| fig\|142585.3.peg.1658 | *Bradyrhizobium* sp. C9 | | |
| fig\|1082933.13.peg.1537 | *Mesorhizobium amorphae* CCNWGS0123 | | |
| fig\|1768789.3.peg.791 | *Methylobacterium* sp. CCH7-A2 | | |
| fig\|1381123.3.peg.3819 | *Aliihoeflea* sp. 2WW | | |
| fig\|1297570.3.peg.1970 | *Mesorhizobium* sp. STM 4661 | | |
| fig\|935546.3.peg.3816 | *Mesorhizobium loti* NZP2037 | | |

-continued

| NCBI Accession[a] | Species/strain | Retron name (if applicable) | SEQ ID NO: 19413-to- 21341 |
|---|---|---|---|
| fig\|1128253.3.peg.1960 | *Bradyrhizobium japonicum* CCBAU 15354 | | |
| fig\|1444315.4.peg.3983 | *Lysobacter capsici* AZ78 | | |
| fig\|1185327.3.peg.1608 | *Xanthomonas axonopodis* pv. *manihotis* str. Xam668 | | |
| fig\|1881043.3.peg.2597 | *Pseudoxanthomonas* sp. GM95 | | |
| ALN84423.1 | *Lysobacter capsici* | | |
| fig\|56460.15.peg.1977 | *Xanthomonas vesicatoria* | | |
| fig\|1317116.6.peg.2759 | *Oceanicola* sp. 22II-s10i | | |
| fig\|564137.3.peg.4320 | *Roseicitreum antarcticum* | | |
| fig\|1952800.3.peg.3583 | Rhodobacteraceae bacterium UBA2553 | | |
| fig\|218673.12.peg.3041 | *Sulfitobacter dubius* | | |
| fig\|1912092.3.peg.2119 | *Nioella sediminis* | | |
| fig\|1736558.3.peg.5006 | *Ensifer* sp. Root558 | | |
| fig\|91360.5.peg.3717 | *Desulforhopalus singaporensis* | | |
| fig\|1948756.3.peg.2576 | Spirochaetia bacterium UBA2205 | | |
| fig\|1855322.3.peg.103 | *Bradyrhizobium* sp. Rc3b | | |
| fig\|1437360.11.peg.2429 | *Bradyrhizobium erythrophlei* | | |
| fig\|1871052.3.peg.1026 | *Afipia* sp. | | |
| fig\|1038860.3.peg.8756 | *Bradyrhizobium elkanii* WSM2783 | | |
| fig\|1898112.54.peg.3758 | Rhodospirillaceae bacterium | | |
| fig\|1660129.3.peg.4854 | *Phenylobacterium* sp. SCN 70-31 | | |
| fig\|1482074.3.peg.4109 | *Hartmannibacter diazotrophicus* | | |
| fig\|1970306.3.peg.552 | *Acidocella* sp. 35-58-6 | | |
| fig\|1686310.5.peg.1409 | *Bartonella apis* | | |
| fig\|1798192.3.peg.1953 | *Thalassospira* sp. KO164 | | |
| fig\|1235461.17.peg.11 | *Sinorhizobium meliloti* GR4 | | |
| fig\|442.12.peg.222 | *Gluconobacter oxydans* | | |
| fig\|1938607.3.peg.1954 | *Sphingomonas* sp. LM7 | | |
| fig\|1231624.3.peg.39 | *Asaia bogorensis* NBRC 16594 | | |
| fig\|1121271.3.peg.4112 | *Gemmobacter nectariphilus* DSM 15620 | | |
| fig\|33059.16.peg.1690 | *Acidithiobacillus caldus* | | |
| fig\|502025.10.peg.925 | *Haliangium ochraceum* DSM 14365 | | |
| fig\|1734406.3.peg.691 | Alphaproteobacteria bacterium BRH_c36 | | |
| fig\|1979207.3.peg.4304 | *Parvularcula* sp. | | |
| fig\|1953057.3.peg.74 | Parvularculaceae bacterium UBA4496 | | |
| fig\|858423.3.peg.10004 | *Bradyrhizobium arachidis* | | |
| fig\|267128.3.peg.2015 | *Sphingopyxis granuli* | | |
| fig\|582667.3.peg.5553 | *Methylobacterium pseudosasicola* | | |
| fig\|1187852.3.peg.2712 | *Methylobacterium tarhaniae* | | |
| fig\|582675.3.peg.1247 | *Methylobacterium gossipiicola* | | |
| fig\|1951640.3.peg.515 | Deferribacteraceae bacterium UBA6799 | | |
| fig\|1948417.4.peg.1606 | Alphaproteobacteria bacterium UBA6187 | | |
| fig\|45074.5.peg.981 | *Legionella santicrucis* | | |
| fig\|1434232.4.peg.2927 | *Magnetofaba australis* IT-1 | | |
| fig\|1945950.3.peg.3568 | *Acinetobacter* sp. UBA6526 | | |
| fig\|106654.22.peg.994 | *Acinetobacter nosocomialis* | | |
| fig\|1977883.3.peg.3023 | *Acinetobacter* sp. ANC 3903 | | |
| fig\|1945948.3.peg.700 | *Acinetobacter* sp. UBA5984 | | |
| fig\|1226327.3.peg.2796 | *Acinetobacter kookii* | | |
| fig\|1879049.4.peg.5949 | *Acinetobacter* sp. WCHAc010034 | | |
| fig\|1945955.3.peg.1951 | *Acinetobacter* sp. UBA7614 | | |
| fig\|1675530.3.peg.2149 | *Acinetobacter genomo* sp. 33YU | | |
| fig\|1310638.3.peg.1006 | *Acinetobacter baumannii* 1437282 | | |
| fig\|1400001.4.peg.34 | *Necropsobacter massiliensis* | | |
| fig\|1132496.5.peg.136 | *Pasteurella multocida* subsp. *multocida* str. HN06 | | |
| fig\|1908263.4.peg.2604 | *Rodentibacter trehalosifermentans* | | |
| fig\|375432.4.peg.200 | *Haemophilus influenzae* R3021 | | |
| fig\|400668.8.peg.3776 | *Marinomonas* sp. MWYL1 | | |
| fig\|1913989.193.peg.841 | Gammaproteobacteria bacterium | | |
| fig\|856793.5.peg.1975 | *Micavibrio aeruginosavorus* ARL-13 | | |
| SBW23286.1 | *Citrobacter europaeus* | | |
| fig\|1736225.3.peg.985 | *Erwinia* sp. Leaf53 | | |
| fig\|29486.12.peg.818 | *Yersinia ruckeri* | | |
| fig\|914128.3.peg.2502 | *Serratia symbiotica* str. *Tucson* | | |
| fig\|1796497.3.peg.952 | *Grimontia celer* | | |
| fig\|1095649.3.peg.3298 | *Vibrio cholerae* O1 str. EM-1676A | | |
| fig\|137584.4.peg.1627 | *Thalassomonas viridans* | | |
| fig\|173990.3.peg.1773 | *Rheinheimera pacifica* | | |

-continued

| NCBI Accession[a] | Species/strain | Retron name (if applicable) | SEQ ID NO: 19413-to-21341 |
|---|---|---|---|
| fig\|1720343.3.peg.3189 | Pseudoalteromonas sp. 1_2015MBL_MicDiv | | |
| fig\|1202962.4.peg.1481 | Moritella marina ATCC 15381 | | |
| fig\|669.50.peg.2993 | Vibrio harveyi | | |
| fig\|691.32.peg.1517 | Vibrio natriegens | | |
| fig\|156578.3.peg.2521 | Alteromonadales bacterium TW-7 | | |
| fig\|661.14.peg.380 | Photobacterium angustum | | |
| fig\|654.94.peg.1733 | Aeromonas veronii | | |
| fig\|703.9.peg.319 | Plesiomonas shigelloides | | |
| fig\|589873.36.peg.1971 | Alteromonas australica | | |
| fig\|28107.3.peg.3571 | Pseudoalteromonas espejiana | | |
| fig\|1547444.3.peg.4264 | Pseudoalteromonas sp. PLSV | | |
| fig\|629266.7.peg.847 | Pseudomonas syringae pv. actinidiae str. M302091 | | |
| fig\|251722.19.peg.4059 | Pseudomonas amygdali pv. aesculi | | |
| fig\|587851.4.peg.1470 | Pseudomonas chlororaphis subsp. aureofaciens | | |
| fig\|1265490.3.peg.2330 | Pseudomonas sp. URMO17WK12:I8 | | |
| fig\|316.101.peg.3534 | Pseudomonas stutzeri | | |
| fig\|1916993.3.peg.4917 | Pseudomonas putida | | |
| fig\|1628833.3.peg.2448 | Pseudomonas sp. ES3-33 | | |
| fig\|1283291.4.peg.1991 | Pseudomonas sp. URMO17WK12:I11 | | |
| fig\|83963.5.peg.3885 | Pseudomonas syringae pv. papulans | | |
| fig\|1206777.3.peg.4334 | Pseudomonas sp. Lz4W | | |
| fig\|113268.3.peg.3785 | Bathymodiolus platifrons methanotrophic gill symbiont | | |
| fig\|1131284.3.peg.1562 | zeta proteobacterium SCGC AB-137-C09 | | |
| fig\|2026807.7.peg.2258 | Zetaproteobacteria bacterium | | |
| fig\|281689.4.peg.2060 | Desulfuromonas acetoxidans DSM 684 | | |
| fig\|1188231.4.peg.1200 | Mariprofundus ferrooxydans M34 | | |
| fig\|1367489.3.peg.682 | Aliivibrio fischeri SA1G | | |
| fig\|1873135.3.peg.4249 | Shewanella sp. SACH | | |
| fig\|663.73.peg.2465 | Vibrio alginolyticus | | |
| fig\|1588629.3.peg.1134 | Aeromonas sp. L_1B5_3 | | |
| fig\|1121922.3.peg.3454 | Glaciecola pallidula DSM 14239 = ACAM 615 | | |
| fig\|351745.9.peg.2506 | Shewanella sp. W3-18-1 | | |
| fig\|29497.20.peg.3798 | Vibrio splendidus | | |
| fig\|1367486.3.peg.187 | Aliivibrio fischeri CB37 | | |
| fig\|511062.4.peg.1890 | Oceanimonas sp. GK1 | | |
| fig\|654.12.peg.188 | Aeromonas veronii | | |
| fig\|29497.21.peg.4482 | Vibrio splendidus | | |
| fig\|1659713.3.peg.560 | Enterobacter bugandensis | | |
| fig\|1124991.3.peg.3617 | Morganella morganii subsp. morganii KT | | |
| fig\|104623.3.peg.1381 | Serratia sp. ATCC 39006 | | |
| fig\|1256989.3.peg.902 | Providencia alcalifaciens R90-1475 | | |
| fig\|1125694.3.peg.1143 | Proteus mirabilis WGLW6 | | |
| fig\|574096.6.peg.2693 | Pantoea allii | | |
| fig\|1095774.3.peg.2623 | Pantoea ananatis PA13 | | |
| fig\|869692.4.peg.2910 | Escherichia coli 3003 | | |
| WP_140159440.1 | Escherichia coli | Retron-Eco2 (Ec67) | |
| fig\|550.437.peg.1444 | Enterobacter cloacae | | |
| fig\|573.13605.peg.2600 | Klebsiella pneumoniae | | |
| fig\|550.285.peg.3783 | Enterobacter cloacae | | |
| fig\|1265672.3.peg.3869 | Salmonella enterica subsp. enterica serovar Agona str. 70.E.05 | | |
| fig\|573.10028.peg.542 | Klebsiella pneumoniae | | |
| fig\|749537.3.peg.218 | Escherichia coli MS 115-1 | | |
| ANK06786.1 | Escherichia coli O25b:H4 | | |
| fig\|670.880.peg.975 | Vibrio parahaemolyticus | | |
| fig\|1192730.4.peg.3 | Salmonella enterica subsp. enterica serovar Kintambo | | |
| fig\|1224144.4.peg.4030 | Dickeya sp. CSL RW240 | | |
| fig\|568766.10.peg.2937 | Dickeya sp. NCPPB 3274 | | |
| fig\|1076549.3.peg.4260 | Pantoea rodasii | | |
| fig\|548.102.peg.3401 | Klebsiella aerogenes | | |
| fig\|630.90.peg.1795 | Yersinia enterocolitica | | |
| fig\|79883.5.peg.266 | Bacillus horikoshii | | |
| fig\|180861.3.peg.3762 | Bacillus thuringiensis serovar sumiyoshiensis | | |
| fig\|1390.157.peg.339 | Bacillus amyloliquefaciens | | |

-continued

| NCBI Accession[a] | Species/strain | Retron name (if applicable) | SEQ ID NO: 19413-to-21341 |
|---|---|---|---|
| fig\|293386.15.peg.304 | *Bacillus stratosphericus* | | |
| fig\|1053181.3.peg.3820 | *Bacillus cereus* BAG2X1-3 | | |
| fig\|1884375.3.peg.681 | *Paenibacillus* sp. PDC88 | | |
| fig\|334735.5.peg.923 | *Sporosarcina koreensis* | | |
| fig\|79884.3.peg.1120 | *Bacillus pseudalcaliphilus* | | |
| fig\|1628206.3.peg.4802 | *Bacillus* sp. LK2 | | |
| fig\|1396.1605.peg.6235 | *Bacillus cereus* | | |
| fig\|182710.3.peg.317 | *Oceanobacillus iheyensis* | | |
| fig\|860.10.peg.486 | *Fusobacterium periodonticum* | | |
| fig\|1855308.3.peg.1467 | *Trichococcus ilyis* | | |
| fig\|931626.3.peg.151 | *Acetobacterium woodii* DSM 1030 | | |
| fig\|1965575.3.peg.2547 | *Lachnoclostridium* sp. An181 | | |
| fig\|1352.2757.peg.71 | *Enterococcus faecium* | | |
| fig\|1299895.3.peg.900 | *Listeria monocytogenes* CFSAN002349 | | |
| fig\|53346.29.peg.1591 | *Enterococcus mundtii* | | |
| fig\|1649188.10.peg.1545 | *Listeria goaensis* | | |
| fig\|158847.6.peg.432 | *Megamonas hypermegale* | | |
| fig\|1121289.3.peg.2775 | *Clostridiisalibacter paucivorans* DSM 22131 | | |
| fig\|1950885.3.peg.858 | Clostridiales bacterium UBA4693 | | |
| fig\|1965576.3.peg.1978 | *Pseudoflavonifractor* sp. An184 | | |
| fig\|1952416.3.peg.1629 | Ruminococcaceae bacterium UBA642 | | |
| fig\|1262803.3.peg.8 | *Clostridium* sp. CAG:413 | | |
| fig\|28037.216.peg.60 | *Streptococcus mitis* | | |
| fig\|1074052.3.peg.33 | *Streptococcus sobrinus* TCI-9 | | |
| fig\|1304.207.peg.1536 | *Streptococcus salivarius* | | |
| fig\|1154859.3.peg.955 | *Streptococcus agalactiae* LMG 14609 | | |
| fig\|1080071.3.peg.332 | *Streptococcus orisasini* | | |
| fig\|1139219.3.peg.2194 | *Enterococcus dispar* ATCC 51266 | | |
| fig\|1834176.3.peg.811 | *Enterococcus* sp. 3G1_DIV0629 | | |
| fig\|1622.15.peg.947 | *Lactobacillus murinus* | | |
| fig\|565651.6.peg.1942 | *Enterococcus faecalis* ARO1/DG | | |
| fig\|1473546.3.peg.703 | *Lysinibacillus* sp. BF-4 | | |
| fig\|37734.13.peg.137 | *Enterococcus casseliflavus* | | |
| fig\|492670.92.peg.623 | *Bacillus velezensis* | | |
| fig\|1639.1907.peg.2641 | *Listeria monocytogenes* | | |
| fig\|1123489.3.peg.170 | *Veillonella magna* DSM 19857 | | |
| fig\|1280687.3.peg.1880 | *Butyrivibrio fibrisolvens* YRB2005 | | |
| fig\|1262889.3.peg.680 | *Eubacterium* sp. CAG:38 | | |
| fig\|1235800.3.peg.2226 | Lachnospiraceae bacterium 10-1 | | |
| fig\|1897035.3.peg.445 | Firmicutes bacterium GAG:552_39_19 | | |
| fig\|199.588.peg.774 | *Campylobacter concisus* | | |
| fig\|1111133.4.peg.219 | *Peptoniphilus* sp. BV3AC2 | | |
| fig\|936589.3.peg.875 WP_070600378.1 | *Veillonella* sp. AS16 | | |
| fig\|1896998.3.peg.1750 | *Coprococcus* sp. CAG:131-related_45_246 | | |
| fig\|41170.3.peg.3013 | *Exiguobacterium acetylicum* | | |
| fig\|59620.44.peg.897 | uncultured *Clostridium* sp. | | |
| fig\|1262843.3.peg.313 | *Clostridium* sp. CAG:813 | | |
| fig\|1262834.3.peg.1287 | *Clostridium* sp. CAG:715 | | |
| fig\|1256219.3.peg.760 | *Lactobacillus paracasei* subsp. *paracasei* Lpp230 | | |
| fig\|115778.31.peg.1994 | *Leuconostoc gelidum* subsp. *gasicomitatum* | | |
| fig\|29385.174.peg.531 | *Staphylococcus saprophyticus* | | |
| fig\|1295.21.peg.75 | *Staphylococcus schleiferi* | | |
| fig\|148814.13.peg.1360 | *Lactobacillus kunkeei* | | |
| fig\|1282.1242.peg.673 | *Staphylococcus epidermidis* | | |
| fig\|1581078.3.peg.1186 | *Staphylococcus* sp. HMSC10C03 | | |
| fig\|1891097.3.peg.280 WP_080703103.1 | *Macrococcus goetzii* | | |
| fig\|1214184.3.peg.1129 | *Streptococcus suis* 22083 | | |
| fig\|1154771.3.peg.209 | *Streptococcus agalactiae* FSL C1-487 | | |
| fig\|1415765.3.peg.1578 | *Streptococcus mitis* 21/39 | | |
| fig\|1581074.3.peg.720 | *Granulicatella* sp. HMSC31F03 | | |
| fig\|1349.233.peg.712 | *Streptococcus uberis* | | |
| fig\|1946281.3.peg.392 | *Catabacter* sp. UBA5893 | | |
| fig\|1328309.5.peg.1889 | *Lactobacillus plantarum* IPLA88 | | |
| fig\|1214190.3.peg.2034 | *Streptococcus suis* YS17 | | |
| fig\|29385.135.peg.2098 | *Staphylococcus saprophyticus* | | |
| fig\|1715184.3.peg.1265 | *Aerococcus* sp. HMSC035B07 | | |

-continued

| NCBI Accession[a] | Species/strain | Retron name (if applicable) | SEQ ID NO: 19413-to-21341 |
|---|---|---|---|
| fig\|1881068.3.peg.2940 | *Sphingomonas* sp. OV641 | | |
| fig\|1522072.3.peg.3829 | *Sphingobium* sp. ba1 | | |
| fig\|1802172.3.peg.237 | *Sphingopyxis* sp. RIFCSPHIGHO2_12_FULL_65_19 | | |
| fig\|1128204.3.peg.2189 | *Bradyrhizobium elkanii* CCBAU 43297 | | |
| fig\|1708715.5.peg.4517 | *Ensifer aridi* | | |
| fig\|195105.3.peg.2062 | *Haematobacter massiliensis* | | |
| fig\|1283312.3.peg.4182 | *Sphingomonas wittichii* DC-6 | | |
| fig\|1120654.4.peg.406 | *Ensifer* sp. LC499 | | |
| fig\|529.36.peg.3144 | *Ochrobactrum anthropi* | | |
| fig\|1194716.3.peg.4774 | *Sinorhizobium meliloti* AK75 | | |
| fig\|1660088.4.peg.2967 | *Agrobacterium* sp. SCN 61-19 | | |
| fig\|1951259.3.peg.2515 | Sphingomonadales bacterium UBA6174 | | |
| fig\|1912891.5.peg.2102 | *Sphingobium* sp. | | |
| fig\|1670800.3.peg.1844 | *Mesorhizobium oceanicum* | | |
| fig\|2032658.3.peg.157 | Alphaproteobacteria bacterium WMHbin7 | | |
| fig\|1819565.5.peg.2208 | *Flavimaricola marinus* | | |
| fig\|1245469.3.peg.1160 | *Bradyrhizobium oligotrophicum* S58 | | |
| fig\|1615890.4.peg.173 | *Bradyrhizobium* sp. LTSP849 | | |
| fig\|56454.3.peg.3464 | *Xanthomonas hortorum* | | |
| fig\|40324.384.peg.1060 | *Stenotrophomonas maltophilia* | | |
| fig\|1801972.3.peg.1832 | Planctomycetes bacterium RBG_19FT_COMBO_48_8 | | |
| fig\|1978765.3.peg.3488 | *Nitrospira* sp. ST-bin5 | | |
| fig\|2009322.3.peg.2770 | *Leptolyngbya ohadii* IS1 | | |
| fig\|1325564.3.peg.3733 | *Nitrospira japonica* | | |
| fig\|43662.9.peg.1688 | *Pseudoalteromonas piscicida* | | |
| fig\|670.134.peg.4439 | *Vibrio parahaemolyticus* | | |
| fig\|998520.3.peg.3325 | *Pseudoalteromonas agarivorans* | | |
| fig\|1723759.3.peg.401 | *Pseudoalteromonas* sp. P1-26 | | |
| fig\|672.133.peg.585 | *Vibrio vulnificus* | | |
| fig\|1324960.19.peg.585 | *Aeromonas salmonicida* subsp. *pectinolytica* 34mel | | |
| fig\|196024.16.peg.3965 | *Aeromonas dhakensis* | | |
| fig\|654.27.peg.4266 | *Aeromonas veronii* | | |
| fig\|1802253.3.peg.1045 | *Sulfurimonas* sp. RIFCSPLOWO2_12_36_12 | | |
| fig\|636.16.peg.3905 | *Edwardsiella tarda* | | |
| fig\|1124958.3.peg.5012 | *Salmonella enterica* subsp. *enterica* serovar *Muenster* str. 0315 | | |
| fig\|573.10007.peg.225 | *Klebsiella pneumoniae* | | |
| fig\|1946737.3.peg.4002 | *Leclercia* sp. UBA1284 | | |
| fig\|1398203.3.peg.3712 | *Xenorhabdus bovienii* str. *kraussei* Quebec | | |
| fig\|615.247.peg.2151 | *Serratia marcescens* | | |
| fig\|52441.3.peg.3752 | *Nitrosomonas aestuarii* | | |
| fig\|1951948.3.peg.242 | Hyphomonadaceae bacterium UBA2389 | | |
| fig\|165186.29.peg.27 | uncultured *Ruminococcus* sp. | | |
| fig\|2013842.3.peg.1881 | Synergistetes bacterium HGW-Synergistetes-1 | | |
| fig\|411484.7.peg.436 | *Clostridium* sp. SS2/1 | | |
| fig\|460384.4.peg.447 | *Enterocloster lavalensis* | | |
| fig\|1761781.3.peg.2961 | *Clostridium* sp. DSM 8431 | | |
| fig\|1451.25.peg.614 | *Paenibacillus amylolyticus* | | |
| fig\|1776378.3.peg.2009 | *Paenibacillus phocaensis* | | |
| fig\|1866315.3.peg.2122 | *Bacillus* sp. N35-10-4 | | |
| fig\|1034836.4.peg.4077 | *Bacillus amyloliquefaciens* XH7 | | |
| fig\|1397.14.peg.5097 | *Bacillus circulans* | | |
| fig\|1497681.5.peg.772 | *Listeria newyorkensis* | | |
| fig\|1053224.3.peg.4333 | *Bacillus cereus* VD021 | | |
| fig\|1374.4.peg.2798 | *Pianococcus kocurii* | | |
| fig\|458233.11.peg.419 | *Macrococcus caseolyticus* JCSC5402 | | |
| fig\|417368.6.peg.944 | *Enterococcus thailandicus* | | |
| fig\|1353.16.peg.736 | *Enterococcus gallinarum* | | |
| fig\|1639.1307.peg.2578 | *Listeria monocytogenes* | | |
| fig\|1649188.4.peg.450 | *Listeria goaensis* | | |
| fig\|333990.5.peg.1279 | *Carnobacterium* sp. AT7 | | |
| fig\|1121085.3.peg.4805 | *Bacillus aidingensis* DSM 18341 | | |
| fig\|659243.6.peg.1163 | *Bacillus siamensis* | | |
| fig\|1965645.3.peg.1428 | *Alistipes* sp. An54 | | |
| fig\|1950664.3.peg.363 | Bacteroidales bacterium UBA5918 | | |
| fig\|681398.3.peg.1596 | *Paludibacter jiangxiensis* | | |

-continued

| NCBI Accession[a] | Species/strain | Retron name (if applicable) | SEQ ID NO: 19413-to-21341 |
|---|---|---|---|
| fig\|1947481.3.peg.1596 | Sphingobacterium sp. UBA1498 | | |
| fig\|1946424.3.peg.2345 | Dysgonomonas sp. UBA4861 | | |
| fig\|188932.3.peg.968 | Pedobacter cryoconitis | | |
| fig\|505249.7.peg.1802 | Arcobacter marinus | | |
| fig\|1802259.3.peg.374 | Sulfurimonas sp. RIFOXYD12_FULL_33_39 | | |
| fig\|1872629.13.peg.663 | Arcobacter sp. | | |
| fig\|497650.4.peg.949 | Sulfurovum sp. enrichment culture clone C5 | | |
| fig\|1981711.3.peg.707 | Pseudomonas sp. B8(2017) | | |
| fig\|287.926.peg.3808 | Pseudomonas aeruginosa | | |
| fig\|157782.3.peg.183 | Pseudomonas parafulva | | |
| fig\|1225174.5.peg.576 | Pseudomonas mendocina S5.2 | | |
| fig\|237610.8.peg.4301 | Pseudomonas psychrotolerans | | |
| fig\|1116369.3.peg.182 | Hoeflea sp. 108 | | |
| WP_080858354.1 | | | |
| fig\|1679460.3.peg.2715 | Marinibacterium profundimaris | | |
| fig\|1811547.3.peg.510 | Maritimibacter sp. REDSEA-S28_B5 | | |
| fig\|93684.8.peg.518 | Roseivivax halotolerans | | |
| EMZ69714.1 | Escherichia coli 174900 | | |
| fig\|103796.87.peg.3165 | Pseudomonas syringae pv. actinidiae | | |
| WP_078828851.1 | Pantoea ananatis | | |
| fig\|2018067.3.peg.1734 | Pseudomonas sp. FDAARGOS 380 | | |
| fig\|294.255.peg.5151 | Pseudomonas fluorescens | | |
| fig\|287.4271.peg.5445 | Pseudomonas aeruginosa | | |
| fig\|46677.3.peg.3237 | Pseudomonas agarici | | |
| fig\|83964.10.peg.849 | Pseudomonas coronafaciens pv. porri | | |
| fig\|1932113.4.peg.2793 | Pseudomonas sp. PA1(2017) | | |
| fig\|1712677.3.peg.189 | Pseudomonas sp. 2822-15 | | |
| fig\|1479235.3.peg.2741 | Halomonas sp. HL-48 | | |
| fig\|227946.12.peg.3247 | Xanthomonas translucens pv. poae | | |
| fig\|40324.220.peg.2801 | Stenotrophomonas maltophilia | | |
| fig\|227946.13.peg.35 | Xanthomonas translucens pv. poae | | |
| fig\|487909.15.peg.4212 | Xanthomonas translucens pv. undulosa | | |
| fig\|40324.145.peg.2120 | Stenotrophomonas maltophilia | | |
| fig\|1182783.3.peg.8 | Xanthomonas campestris JX | | |
| fig\|1736581.3.peg.4144 | Lysobacter sp. Root667 | | |
| fig\|470.4256.peg.2128 | Acinetobacter baumannii | | |
| fig\|1804984.3.peg.4735 | Burkholderia sp. OLGA172 | | |
| fig\|1882792.3.peg.5959 | Burkholderia sp. CF145 | | |
| fig\|1458357.5.peg.7849 | Caballeronia jiangsuensis | | |
| fig\|674703.3.peg.3992 | Rhodoplanes sp. Z2-YC6860 | | |
| fig\|1230476.3.peg.595 | Bradyrhizobium sp. DFCI-1 | | |
| fig\|1752222.3.peg.1730 | Rhizobiales bacterium Ga0077525 | | |
| fig\|1948848.3.peg.320 | Patescibacteria group bacterium UBA6220 | | |
| fig\|1860092.3.peg.3966 | Alphaproteobacteria bacterium MedPE-SWcel | | |
| fig\|398.7.peg.3301 | Rhizobium tropici | | |
| fig\|418630.3.peg.960 | Rhodobacter megalophilus | | |
| fig\|56.40.peg.5712 | Sorangium cellulosum | | |
| fig\|1660160.3.peg.2510 | Acidobacteria bacterium SCN 69-37 | | |
| fig\|1661042.3.peg.2224 | Pseudomonas sp. NBRC 111127 | | |
| fig\|1712678.3.peg.4198 | Pseudomonas sp. 2822-17 | | |
| fig\|1736561.3.peg.128 | Pseudomonas sp. Root562 | | |
| fig\|76760.8.peg.1730 | Pseudomonas rhodesiae | | |
| fig\|1295133.4.peg.7170 | Pseudomonas putida JCM 18798 | | |
| fig\|1718917.3.peg.3132 | Pseudomonas sp. ICMP 460 | | |
| fig\|237306.3.peg.591 | Pseudomonas syringae pv. persicae | | |
| fig\|1079060.3.peg.1479 | Pseudomonas savastanoi pv. phaseolicola 1644R | | |
| fig\|1981714.3.peg.1068 | Pseudomonas sp. B5(2017) | | |
| fig\|1419583.3.peg.4516 | Pseudomonas mandelii PD30 | | |
| fig\|1718918.3.peg.4166 | Pseudomonas sp. ICMP 561 | | |
| fig\|64988.7.peg.76 | Alcanivorax jadensis | | |
| fig\|1961564.3.peg.685 | Desulfovibrionaceae bacterium UBA5546 | | |
| fig\|2004648.3.peg.1747 | Acinetobacter sp. WCHA39 | | |
| fig\|1080187.3.peg.399 | Cupriavidus sp. UYPR2.512 | | |
| fig\|76114.8.peg.258 | Aromatoleum aromaticum EbN1 | | |
| fig\|196367.9.peg.6286 | Caballeronia sordidicola | | |
| fig\|1217418.3.peg.694 | Cupriavidus sp. HPC(L) | | |

-continued

| NCBI Accession[a] | Species/strain | Retron name (if applicable) | SEQ ID NO: 19413-to-21341 |
|---|---|---|---|
| fig\|1752216.3.peg.4007 | Nitrosomonadales bacterium Ga0074132 | | |
| fig\|1249621.3.peg.3614 | Cupriavidus sp. HMR-1 | | |
| fig\|179879.8.peg.6514 | Burkholderia anthina | | |
| fig\|1246301.3.peg.4482 | Variovorax paradoxus B4 | | |
| WP_092746164.1 | Acidovorax valerianellae | | |
| fig\|536.30.peg.857 | Chromobacterium violaceum | | |
| fig\|1961112.3.peg.115 | Planctomycetes bacterium UTPLA1 | | |
| fig\|44574.5.peg.4575 | Nitrosomonas communis | | |
| fig\|265901.4.peg.190 | Photobacterium sp. J15 | | |
| fig\|80852.21.peg.1289 | Aliivibrio wodanis | | |
| fig\|1136159.3.peg.2534 | Vibrio cyclitrophicus 1F111 | | |
| fig\|24.6.peg.4539 | Shewanella putrefaciens | | |
| fig\|888433.3.peg.1974 | Pseudoalteromonas sp. GutCa3 | | |
| fig\|196024.6.peg.3651 | Aeromonas dhakensis | | |
| fig\|1352943.3.peg.5028 | Vibrio harveyi E385 | | |
| WP_088124663.1 | Vibrio cholerae | | |
| fig\|29497.15.peg.1220 | Vibrio splendidus | | |
| fig\|670.413.peg.1227 | Vibrio parahaemolyticus | | |
| fig\|584.91.peg.3337 | Proteus mirabilis | | |
| fig\|263819.5.peg.201 | Yersinia aleksiciae | | |
| fig\|1656094.3.peg.1449 | Alteromonas confluentis | | |
| fig\|634.5.peg.607 | Yersinia bercovieri | | |
| fig\|630.85.peg.4080 | Yersinia enterocolitica | | |
| fig\|1212491.3.peg.1847 | Legionella fallonii LLAP-10 | | |
| fig\|1498499.3.peg.2812 | Legionella norrlandica | | |
| fig\|1844092.4.peg.3143 | Pseudomonas sp. 8 R 14 | | |
| fig\|1441629.3.peg.2119 | Pseudomonas cichorii JBC1 | | |
| WP_092369835.1 | Pseudomonas seleniipraecipitans | | |
| fig\|477228.3.peg.2040 | Pseudomonas stutzeri TS44 | | |
| fig\|317.249.peg.4299 | Pseudomonas syringae | | |
| fig\|1597.16.peg.2055 | Lactobacillus paracasei | | |
| fig\|1184720.6.peg.2708 | Rhizobium anhuiense | | |
| fig\|1566263.3.peg.185 | Rhizobium sp. NFR03 | | |
| fig\|1951216.3.peg.1622 | Rhizobiales bacterium UBA1909 | | |
| fig\|1219052.3.peg.3572 | Sphingomonas pruni NBRC 15498 | | |
| fig\|376620.8.peg.122 | Gluconobacter japonicus | | |
| fig\|1736587.3.peg.2638 | Devosia sp. Root685 | | |
| WP_011269850.1 | Xanthomonas campestris | | |
| fig\|1195246.3.peg.467 | Alishewanella agri BL06 | | |
| fig\|1931276.3.peg.1294 | Haliangium sp. UPWRP_2 | | |
| fig\|1931204.4.peg.12 | Confluentimicrobium sp. | | |
| fig\|2052957.3.peg.3497 | Pseudorhodobacter sp. MZDSW-24AT | | |
| fig\|1952825.3.peg.2772 | Rhodobiaceae bacterium UBA4205 | | |
| fig\|1189622.3.peg.1716 | Pseudomonas amygdali pv. tabaci str. 6605 | | |
| fig\|294.173.peg.2741 | Pseudomonas fluorescens | | |
| fig\|294.122.peg.3307 | Pseudomonas fluorescens | | |
| fig\|1198456.3.peg.4053 | Pseudomonas guguanensis | | |
| fig\|1855380.3.peg.1951 | Pseudomonas sp. Z003-0.4C(8344-21) | | |
| fig\|1144330.3.peg.3879 | Pseudomonas sp. GM48 | | |
| fig\|86265.3.peg.2799 | Pseudomonas thivervalensis | | |
| fig\|1881035.3.peg.3817 | Mitsuaria sp. PDC51 | | |
| fig\|511.8.peg.774 | Alcaligenes faecalis | | |
| fig\|1095552.3.peg.2955 | Methylobacter luteus IMV-B-3098 | | |
| fig\|1690268.3.peg.1172 | Acidovorax sp. SD340 | | |
| fig\|871652.3.peg.1451 | Poseidonocella sedimentorum | | |
| fig\|1946868.3.peg.175 | Methylophaga sp. UBA1490 | | |
| fig\|1924940.3.peg.1147 | Mameliella sp. | | |
| fig\|1912891.7.peg.5370 | Sphingobium sp. | | |
| fig\|1236503.3.peg.1539 | Acetobacter persici JCM 25330 | | |
| fig\|1745182.3.peg.1942 | Paracoccus sp. MKU1 | | |
| fig\|1112.5.peg.2875 | Porphyrobacter neustonensis | | |
| WP_051585410.1 | Sphingomonas paucimobilis | | |
| fig\|1082931.4.peg.3584 | Pelagibacterium halotolerans B2 | | |
| fig\|1907665.3.peg.5475 | Agrobacterium sp. DSM 25558 | | |
| fig\|1841652.4.peg.3782 | Agrobacterium sp. 13-626 | | |
| fig\|1736312.3.peg.3441 | Rhizobium sp. Leaf262 | | |
| fig\|1768770.3.peg.4687 | Caulobacter sp. CCH5-E12 | | |
| fig\|355591.9.peg.1867 | Marinobacter vinifirmus | | |
| fig\|1869214.3.peg.1848 | Rheinheimera sp. | | |
| fig\|1946470.3.peg.3546 | Erythrobacter sp. UBA2510 | | |
| fig\|1860090.3.peg.231 | Roseobacter sp. MedPE-SWde | | |
| fig\|2020902.8.peg.1814 | Ponticaulis sp. | | |

| NCBI Accession[a] | Species/strain | Retron name (if applicable) | SEQ ID NO: 19413-to-21341 |
|---|---|---|---|
| fig\|940286.3.peg.3612 | Komagataeibacter oboediens 174Bp2 | | |
| fig\|1736380.3.peg.1842 | Rhizobium sp. Leaf453 | | |
| fig\|665126.3.peg.2283 | Prosthecomicrobium hirschii | | |
| fig\|2029410.3.peg.1956 | Mesorhizobium sp. WSM4311 | | |
| WP_003169203.1 | Brevundimonas diminuta | | |
| fig\|1884373.3.peg.3317 | Mesorhizobium sp. YR577 | | |
| fig\|989436.3.peg.3203 | Pseudovibrio sp. Ad5 | | |
| fig\|1736359.3.peg.3976 | Rhizobium sp. Leaf386 | | |
| fig\|104102.12.peg.3797 | Acetobacter tropicalis | | |
| fig\|1500305.3.peg.4736 | Rhizobium sp. OK665 | | |
| fig\|1842535.30.peg.6 | Blastomonas sp. RAC04 | | |
| fig\|70775.16.peg.91 | Pseudomonas plecoglossicida | | |
| fig\|287.4262.peg.2063 | Pseudomonas aeruginosa | | |
| WP_017702484.1 | Pseudomonas syringae | | |
| fig\|1357292.3.peg.4700 | Pseudomonas syringae pv. pisi str. PP1 | | |
| fig\|287.2436.peg.3554 | Pseudomonas aeruginosa | | |
| fig\|76758.3.peg.4722 | Pseudomonas orientalis | | |
| fig\|1904755.3.peg.3469 | Pseudomonas sp. 43NM1 | | |
| fig\|47879.37.peg.693 | Pseudomonas corrugata | | |
| fig\|1771311.3.peg.1935 | Pseudomonas sp. ATCC PTA-122608 | | |
| fig\|2008975.3.peg.1976 | Pseudomonas sp. Irchel 3E13 | | |
| fig\|1259798.3.peg.1121 | Pseudomonas sp. LAMO17WK12:I2 | | |
| fig\|1736487.3.peg.2103 | Noviherbaspirillum sp. Root189 | | |
| fig\|1706231.5.peg.1557 | Janthinobacterium sp. CG23_2 | | |
| fig\|1804984.3.peg.4700 | Burkholderia sp. OLGA172 | | |
| fig\|54067.3.peg.2925 | Xylophilus ampelinus | | |
| fig\|40324.357.peg.1426 | Stenotrophomonas maltophilia | | |
| fig\|1967657.4.peg.913 | Salmonella enterica subsp. enterica serovar Telelkebir | | |
| fig\|573.14330.peg.816 | Klebsiella pneumoniae | | |
| fig\|615.357.peg.16 | Serratia marcescens | | |
| fig\|1122616.3.peg.231 | Oceanospirillum beijerinckii DSM 7166 | | |
| fig\|314276.4.peg.1389 | Idiomarina baltica OS145 | | |
| fig\|1038921.4.peg.2790 | Pseudomonas chlororaphis subsp. aureofaciens 30-84 | | |
| fig\|292.72.peg.3280 | Burkholderia cepacia | | |
| fig\|1899355.18.peg.947 | Oceanospirillaceae bacterium | | |
| fig\|2015356.3.peg.5401 | Burkholderia sp. AU33647 | | |
| fig\|206665.3.peg.1731 | Desulfonauticus submarinus | | |
| fig\|1987165.3.peg.2564 | Sphingobium sp. GW456-12-10-14-TSB1 | | |
| fig\|1283312.3.peg.2182 | Sphingomonas wittichii DC-6 | | |
| fig\|1223566.3.peg.1810 | Bradyrhizobium sp. CCGE-LA001 | | |
| fig\|76761.16.peg.744 | Pseudomonas veronii | | |
| PIY00499.1 | Hydrogenophilales bacterium CG_4_10_14_3_um_filter_58_23 | | |
| fig\|305.94.peg.4778 | Ralstonia solanacearum | | |
| fig\|1758178.5.peg.2546 | Celeribacter ethanolicus | | |
| fig\|1354263.4.peg.2524 | Hafnia paralvei ATCC 29927 | | |
| fig\|1125979.3.peg.1941 | Rhizobium sp. PDO1-076 | | |
| fig\|1338032.3.peg.3393 | Vibrio parahaemolyticus O1:K33 str. CDC_K4557 | | |
| fig\|1898112.54.peg.3344 | Rhodospirillaceae bacterium | | |
| fig\|1432558.3.peg.4265 | Klebsiella pneumoniae ISC21 | | |
| fig\|333962.3.peg.2767 | Providencia heimbachae | | |
| fig\|60552.10.peg.2414 | Burkholderia vietnamiensis | | |
| WP_011808964.1 | Verminephrobacter eiseniae | | |
| fig\|1844107.4.peg.2966 | Pseudomonas sp. 58 R 12 | | |
| fig\|1952916.3.peg.906 | Synergistaceae bacterium UBA5549 | | |
| fig\|458817.8.peg.542 | Shewanella halifaxensis HAW-EB4 | | |
| fig\|1674859.3.peg.1291 | Spirochaetales bacterium Spiro_03 | | |
| fig\|1121434.3.peg.22 | Halodesulfovibrio aestuarii DSM 10141 | | |
| fig\|1262899.3.peg.286 | Fusobacterium sp. CAG:439 | | |
| fig\|57320.3.peg.1084 | Pseudodesulfovibrio profundus | | |
| fig\|1736444.3.peg.3753 | Acinetobacter sp. Root1280 | | |
| fig\|1310670.3.peg.2122 | Acinetobacter sp. 907131 | | |
| fig\|505345.6.peg.150 | Gallibacterium genomo sp. 3 | | |
| fig\|670.887.peg.4391 | Vibrio parahaemolyticus | | |
| fig\|196024.16.peg.2750 | Aeromonas dhakensis | | |
| fig\|663.48.peg.1321 | Vibrio alginolyticus | | |
| fig\|28141.133.peg.4717 | Cronobacter sakazakii | | |
| fig\|1117315.3.peg.3 | Pseudoalteromonas haloplanktis ATCC 14393 | | |
| fig\|1917164.4.peg.2739 | Shewanella sp. UCD-KL21 | | |
| fig\|2006083.3.peg.3222 | Photobacterium sp. CECT 9192 | | |

-continued

| NCBI Accession[a] | Species/strain | Retron name (if applicable) | SEQ ID NO: 19413-to-21341 |
|---|---|---|---|
| fig\|584.227.peg.2146 | *Proteus mirabilis* | | |
| fig\|1792834.4.peg.1793 | *Marinicella sediminis* | | |
| fig\|1333513.3.peg.3775 | *Pseudoalteromonas haloplanktis* TAE56 | | |
| fig\|1305826.3.peg.1246 | *Streptomyces* sp. Amel2xC10 | | |
| WP_048809063.1 | *Microbacterium ginsengisoli* | | |
| fig\|1987376.3.peg.4246 | *Pseudonocardia* sp. N23 | | |
| fig\|164115.3.peg.6832 | *Streptomyces niveiscabiei* | | |
| fig\|285676.33.peg.4994 | *Micromonospora saelicesensis* | | |
| SFF52649.1 | *Streptomyces alni* | | |
| fig\|1100822.3.peg.6408 | *Streptomyces* sp. AmelKG-E11A | | |
| WP_098467790.1 | | | |
| fig\|1190417.3.peg.2916 | *Geodermatophilus telluris* | | |
| SDS16714.1 | *Agrococcus carbonis* | | |
| fig\|692370.5.peg.1108 | *Altererythrobacter dongtanensis* | | |
| fig\|1736370.3.peg.1383 | *Sphingomonas* sp. Leaf412 | | |
| fig\|1759074.3.peg.2615 | *Sphingopyxis* sp. HIX | | |
| fig\|1120928.3.peg.922 | *Acinetobacter tjernbergiae* DSM 14971 = CIP 107465 | | |
| fig\|470.4268.peg.2032 | *Acinetobacter baumannii* | | |
| fig\|1217627.3.peg.995 | *Acinetobacter baumannii* NIPH 67 | | |
| fig\|28450.149.peg.5786 | *Burkholderia pseudomallei* | | |
| fig\|2032650.3.peg.3543 | Magnetococcales bacterium HCHbin5 | | |
| fig\|101571.169.peg.3909 | *Burkholderia ubonensis* | | |
| fig\|396597.7.peg.2128 | *Burkholderia ambifaria* MEX-5 | | |
| fig\|869212.3.peg.3514 | *Turneriella parva* DSM 21527 | | |
| fig\|1196083.80.peg.1885 | *Snodgrassella alvi* | | |
| fig\|1304886.3.peg.1257 | *Desulfotignum balticum* DSM 7044 | | |
| fig\|555.16.peg.1362 | *Pectobacterium carotovorum* subsp. *carotovorum* | | |
| fig\|1421338.3.peg.151 | *Enterobacter asburiae* L1 | | |
| fig\|443144.3.peg.785 | *Geobacter* sp. M21 | | |
| fig\|1265503.3.peg.1271 | *Colwellia piezophila* ATCC BAA-637 | | |
| fig\|55601.100.peg.1601 | *Vibrio anguillarum* | | |
| fig\|299766.9.peg.4890 | *Enterobacter hormaechei* subsp. *steigerwaltii* | | |
| fig\|243231.5.peg.1360 | *Geobacter sulfurreducens* PGA | | |
| fig\|1263083.3.peg.558 | *Klebsiella variicola* CAG:634 | | |
| fig\|57706.9.peg.1106 | *Citrobacter braakii* | | |
| fig\|1619244.3.peg.1323 | *Enterobacter bugandensis* | | |
| SHO56340.1 | *Vibrio quintilis* | | |
| fig\|688.15.peg.906 | *Aliivibrio logei* | | |
| fig\|663.75.peg.4800 | *Vibrio alginolyticus* | | |
| fig\|1967612.3.peg.4508 | *Salmonella enterica* subsp. *houtenae* serovar 50:z4, z23:- | | |
| fig\|82985.3.peg.3508 | *Pragia fontium* | | |
| fig\|55207.5.peg.1840 | *Pectobacterium betavasculorum* | | |
| fig\|582.25.peg.388 | *Morganella morganii* | | |
| fig\|1006598.5.peg.80 | *Serratia plymuthica* RVH1 | | |
| fig\|82977.3.peg.3268 | *Buttiauxella agrestis* | | |
| CRY53703.1 | *Yersinia intermedia* | | |
| fig\|595494.3.peg.706 | *Tolumonas auensis* DSM 9187 | | |
| fig\|1217694.3.peg.3300 | *Acinetobacter* sp. CIP 64.2 | | |
| fig\|470.2679.peg.715 | *Acinetobacter baumannii* | | |
| fig\|1879050.4.peg.2797 | *Acinetobacter wuhouensis* | | |
| fig\|2004650.3.peg.1818 | *Acinetobacter chinensis* | | |
| fig\|648.80.peg.1405 | *Aeromonas caviae* | | |
| fig\|1217722.3.peg.1866 | *Pseudomonas* sp. S13.1.2 | | |
| fig\|294.88.peg.4234 | *Pseudomonas fluorescens* | | |
| fig\|629262.5.peg.1917 | *Pseudomonas syringae* pv. *japonica* str. M301072 | | |
| WP_053932309.1 | *Pseudomonas coronafaciens* | | |
| fig\|1844101.3.peg.4702 | *Pseudomonas* sp. 31 R 17 | | |
| fig\|380021.13.peg.6149 | *Pseudomonas protegens* | | |
| fig\|287.3716.peg.2163 | *Pseudomonas aeruginosa* | | |
| fig\|287.3208.peg.1464 | *Pseudomonas aeruginosa* | | |
| fig\|1952221.3.peg.555 | Methylococcaceae bacterium UBA2780 | | |
| fig\|1869214.3.peg.3542 | *Rheinheimera* sp. | | |
| fig\|375286.7.peg.830 | *Janthinobacterium* sp. Marseille | | |
| fig\|536.26.peg.4616 | *Chromobacterium violaceum* | | |
| fig\|983548.3.peg.2977 | *Dokdonia* sp. 4H-3-7-5 | | |
| fig\|307480.5.peg.1780 | *Chryseobacterium vrystaatense* | | |
| fig\|1262921.3.peg.2213 | *Prevotella* sp. CAG:1185 | | |
| fig\|1965649.3.peg.4193 | *Butyricimonas* sp. An62 | | |
| fig\|1951558.3.peg.3731 | Chitinophagaceae bacterium UBA4411 | | |

-continued

| NCBI Accession[a] | Species/strain | Retron name (if applicable) | SEQ ID NO: 19413-to-21341 |
|---|---|---|---|
| fig\|1950669.3.peg.2035 | Bacteroidales bacterium UBA6192 | | |
| fig\|1869230.3.peg.3025 | Chryseobacterium sp. CBo1 | | |
| fig\|1500294.3.peg.2814 | Chryseobacterium sp. YR485 | | |
| fig\|1756149.11.peg.2545 | Elizabethkingia bruuniana | | |
| fig\|1137281.3.peg.1436 | Xanthomarina gelatinilytica | | |
| fig\|1964365.5.peg.2525 | Sneathiella sp. | | |
| fig\|28450.428.peg.5049 | Burkholderia pseudomallei | | |
| fig\|1628751.3.peg.813 | Nostoc linckia z16 | | |
| fig\|60137.10.peg.1138 | Sulfitobacter pontiacus | | |
| fig\|1580596.3.peg.2701 | Phaeobacter piscinae | | |
| fig\|1041141.4.peg.4741 | Rhizobium leguminosarum bv. viciae 128C53 | | |
| WP_063290764.1 | unclassified Pseudovibrio | | |
| fig\|1816219.4.peg.1873 | Colwellia sp. PAMC 21821 | | |
| fig\|651.3.peg.13 | Aeromonas media | | |
| fig\|134375.17.peg.3222 | Achromobacter sp. | | |
| WP_011296194.1 | Cupriavidus pinatubonensis | | |
| fig\|1513890.4.peg.2322 | Pseudomonas chlororaphis subsp. piscium | | |
| fig\|294.193.peg.980 | Pseudomonas fluorescens | | |
| fig\|287.2516.peg.114 | Pseudomonas aeruginosa | | |
| fig\|2006083.3.peg.3219 | Photobacterium sp. CECT 9192 | | |
| fig\|1458817.8.peg.538 | Shewanella halifaxensis HAW-EB4 | | |
| fig\|1073383.3.peg.1289 | Aeromonas veronii AMC34 | | |
| fig\|190893.14.peg.2110 | Vibrio coralliilyticus | | |
| fig\|663.144.peg.2659 | Vibrio alginolyticus | | |
| fig\|55601.106.peg.926 | Vibrio anguillarum | | |
| fig\|669.51.peg.5531 | Vibrio harveyi | | |
| fig\|1250059.5.peg.3511 | Tenacibaculum sp. MAR 2009 124 | | |
| fig\|906888.6.peg.2449 | Nonlabens ulvanivorans | | |
| WP_042276051.1 | Nonlabens sediminis | | |
| fig\|1953167.3.peg.1254 | Bacteroidetes bacterium UBA6221 | | |
| fig\|991.14.peg.629 | Flavobacterium hydatis | | |
| fig\|1121890.3.peg.5 | Flavobacterium frigidarium DSM 17623 | | |
| fig\|387094.4.peg.1115 | Flavobacterium hercynium | | |
| fig\|1946558.3.peg.2413 | Flavobacterium sp. UBA7665 | | |
| fig\|253.27.peg.2882 | Chryseobacterium indologenes | | |
| fig\|1685010.5.peg.4376 | Chryseobacterium glaciei | | |
| fig\|1500289.3.peg.4103 | Chryseobacterium sp. OV705 | | |
| fig\|1500298.3.peg.2823 | Chryseobacterium sp. YR561 | | |
| fig\|1797331.3.peg.2180 | Bacteroidetes bacterium GWE2_29_8 | | |
| fig\|1947498.3.peg.1366 | Sphingobacterium sp. UBA4616 | | |
| WP_074239321.1 | Chitinophaga niabensis | | |
| fig\|192149.7.peg.174 | Muricauda sp. | | |
| fig\|718222.3.peg.4924 | Bacillus cereus TIAC219 | | |
| fig\|1053210.3.peg.211 | Bacillus cereus HuB4-10 | | |
| fig\|2026089.3.peg.6077 | Paenibacillus sp. XY044 | | |
| fig\|1938610.3.peg.3678 | Flavobacterium sp. LM5 | | |
| fig\|1947482.3.peg.632 | Sphingobacterium sp. UBA1575 | | |
| fig\|1948844.3.peg.823 | Patescibacteria group bacterium UBA6130 | | |
| fig\|986.7.peg.83 | Flavobacterium johnsoniae | | |
| fig\|1950382.3.peg.461 | Bacteroidales bacterium UBA1181 | | |
| fig\|1947145.3.peg.376 | Prevotella sp. UBA3765 | | |
| fig\|1122989.3.peg.367 | Prevotella oris DSM 18711 = JCM 12252 | | |
| fig\|1896974.3.peg.2001 | Bacteroides sp. 43_108 | | |
| fig\|2014804.3.peg.4306 | Lewinellaceae bacterium SD302 | | |
| fig\|1428.517.peg.2380 | Bacillus thuringiensis | | |
| fig\|1428.574.peg.3351 | Bacillus thuringiensis | | |
| fig\|1428.590.peg.5685 | Bacillus thuringiensis | | |
| fig\|720554.3.peg.188 | Hungateiclostridium clariflavum DSM 19732 | | |
| fig\|1122203.4.peg.2283 | Marinococcus halotolerans DSM 16375 | | |
| fig\|1462525.3.peg.3489 | Thalassobacillus sp. TM-1 | | |
| fig\|1395513.3.peg.363 | Sporolactobacillus laevolacticus DSM 442 | | |
| fig\|1262834.3.peg.1229 | Clostridium sp. CAG:715 | | |
| SCI87282.1 | uncultured Roseburia sp. | | |
| fig\|1952116.3.peg.2349 | Lachnospiraceae bacterium UBA6480 | | |
| WP_069150959.1 | Lachnospiraceae | | |
| fig\|1265.10.peg.3100 | Ruminococcus flavefaciens | | |
| fig\|1120998.3.peg.2858 | Anaerovorax odorimutans DSM 5092 | | |
| WP_072702499.1 | Butyrivibrio hungatei | | |
| fig\|1232453.3.peg.2795 | Clostridiales bacterium VE202-21 | | |

-continued

| NCBI Accession[a] | Species/strain | Retron name (if applicable) | SEQ ID NO: 19413-to-21341 |
|---|---|---|---|
| fig\|39485.11.peg.251 | *Lachnospira eligens* | | |
| WP_072832325.1 | | | |
| fig\|1509.24.peg.2487 | *Clostridium sporogenes* | | |
| SCI88558.1 | uncultured *Clostridium* sp. | | |
| fig\|1490.6.peg.2635 | *Paraclostridium bifermentans* | | |
| fig\|1947399.3.peg.1322 | Hungateiclostridiaceae bacterium UBA3548 | | |
| fig\|1953138.3.peg.796 | Bacteroidetes bacterium UBA1312 | | |
| fig\|1950875.3.peg.364 | Clostridiales bacterium UBA4139 | | |
| fig\|1396.1518.peg.4860 | *Bacillus cereus* | | |
| fig\|1305675.3.peg.2174 | *Bacillus solimangrovi* | | |
| fig\|1423.436.peg.4365 | *Bacillus subtilis* | | |
| fig\|361277.6.peg.1539 | *Terribacillus saccharophilus* | | |
| fig\|1392.356.peg.4724 | *Bacillus anthracis* | | |
| fig\|1053189.3.peg.4219 | *Bacillus cereus* BAG5X1-1 | | |
| WP_079442297.1 | *Clostridium chromiireducens* | | |
| fig\|1953262.3.peg.783 | Candidatus Omnitrophica bacterium UBA1562 | | |
| fig\|1797955.3.peg.2304 | Elusimicrobia bacterium RIFOXYA12_FULL_51_18 | | |
| fig\|1953111.3.peg.2436 | Acidobacteria bacterium UBA7540 | | |
| WP_099010551.1 | *Escherichia coli* | Retron-Eco1 (Ec86) | |
| fig\|1005565.3.peg.1153 | *Escherichia coli* 3006 | | |
| fig\|158822.8.peg.1905 | *Cedecea neteri* | | |
| fig\|1444060.3.peg.4830 | *Escherichia coli* 4-203-08_S1_C1 | | |
| fig\|29484.22.peg.4571 | *Yersinia frederiksenii* | | |
| fig\|529823.3.peg.332 | *Cellvibrio* sp. OA-2007 | | |
| fig\|48296.218.peg.3142 | *Acinetobacter pittii* | | |
| fig\|550.518.peg.3445 | *Enterobacter cloacae* | | |
| fig\|204773.6.peg.4 | *Herminiimonas arsenicoxydans* | | |
| fig\|670.190.peg.4348 | *Vibrio parahaemolyticus* | | |
| fig\|44577.7.peg.209 | *Nitrosomonas ureae* | | |
| fig\|1125747.3.peg.1 | *Paraglaciecola agarilytica* NO2 | | |
| fig\|1338034.3.peg.2437 | *Vibrio parahaemolyticus* O1:Kuk str. FDA_R31 | | |
| fig\|1952844.3.peg.2619 | Rhodocyclaceae bacterium UBA5533 | | |
| fig\|1288788.3.peg.2384 | *Vibrio parahaemolyticus* 3631 | | |
| fig\|644.31.peg.975 | *Aeromonas hydrophila* | | |
| fig\|498292.3.peg.28 | *Flavobacterium swingsii* | | |
| fig\|1948088.3.peg.4515 | Firmicutes bacterium UBA6132 | | |
| fig\|1408433.3.peg.3094 | *Crocinitomix catalasitica* ATCC 23190 | | |
| WP_074236572.1 | *Chryseobacterium zeae* | | |
| fig\|1127353.3.peg.1738 | *Salmonella enterica* subsp. *enterica* serovar *Newport* str. #11-4 | | |
| fig\|1881110.4.peg.120 | *Pantoea sesami* | | |
| fig\|34038.6.peg.27 | *Rahnella aquatilis* | | |
| fig\|630.95.peg.4256 | *Yersinia enterocolitica* | | |
| fig\|149387.11.peg.1139 | *Salmonella enterica* subsp. *enterica* serovar Brandenburg | | |
| fig\|1343738.3.peg.2232 | *Vibrio cholerae* 2012EL-1759 | Retron-Vch3 (Vc137) | |
| fig\|1423.175.peg.4339 | *Bacillus subtilis* | | |
| fig\|2021695.3.peg.3399 | *Bacillus* sp. 7894-2 | | |
| fig\|189426.10.peg.597 | *Paenibacillus odorifer* | | |
| fig\|2020949.3.peg.856 | *Romboutsia weinsteinii* | | |
| fig\|1243664.3.peg.1004 | *Bacillus massiliogorillae* | | |
| fig\|1855345.3.peg.2971 | *Bacillus* sp. RRD69 | | |
| fig\|1946358.3.peg.2514 | *Clostridium* sp. UBA4108 | | |
| fig\|1520.90.peg.2502 | *Clostridium beijerinckii* | | |
| fig\|79672.3.peg.288 | *Bacillus thuringiensis* serovar medellin | | |
| fig\|189426.19.peg.3973 | *Paenibacillus odorifer* | | |
| fig\|1497.3.peg.4049 | *Clostridium formicaceticum* | | |
| fig\|169760.4.peg.4269 | *Paenibacillus stellifer* | | |
| WP_073588670.1 | *Anaerocolumna xylanovorans* | | |
| fig\|1950815.3.peg.1585 | Clostridiales bacterium UBA1341 | | |
| fig\|1897004.3.peg.2166 | *Eubacterium* sp. 45_250 | | |
| fig\|1946293.3.peg.290 | *Catabacter* sp. UBA7571 | | |
| fig\|1796620.3.peg.3489 | *Acutalibacter muris* | | |
| fig\|76857.53.peg.2245 | *Fusobacterium nucleatum* subsp. *polymorphum* | | |

-continued

| NCBI Accession<sup>a</sup> | Species/strain | Retron name (if applicable) | SEQ ID NO: 19413-to-21341 |
|---|---|---|---|
| fig\|2013784.3.peg.1260 | Firmicutes bacterium HGW-Firmicutes-3 | | |
| fig\|79884.3.peg.1106 | Bacillus pseudalcaliphilus | | |
| fig\|135461.47.peg.1552 | Bacillus subtilis subsp. subtilis | | |
| WP_016122013.1 | Bacillus cereus group | | |
| fig\|1499688.3.peg.3214 | Bacillus sp. LF1 | | |
| fig\|1318.8.peg.1495 | Streptococcus parasanguinis | | |
| fig\|1381091.3.peg.1173 | Streptococcus equi subsp. zooepidemicus SzAM60 | | |
| fig\|1409369.3.peg.815 | Staphylococcus aureus AMMC6050 | | |
| fig\|1497681.5.peg.3014 | Listeria newyorkensis | | |
| fig\|1095727.3.peg.409 | Streptococcus sp. SK643 | | |
| fig\|1318.12.peg.313 | Streptococcus parasanguinis | | |
| fig\|1681184.3.peg.4899 | Lysinibacillus sp. ZYM-1 | | |
| fig\|561879.29.peg.3569 | Bacillus safensis | | |
| fig\|1884359.3.peg.2978 | Psychrobacillus sp. OK028 | | |
| fig\|29367.3.peg.1112 | Clostridium puniceum | | |
| fig\|1225345.3.peg.1103 | Clostridium chromiireducens | | |
| fig\|1345695.10.peg.2438 | Clostridium saccharobutylicum DSM 13864 | | |
| fig\|119641.3.peg.784 | Clostridium uliginosum | | |
| fig\|1761781.3.peg.88 | Clostridium sp. DSM 8431 | | |
| fig\|1946346.3.peg.2999 | Clostridium sp. UBA1056 | | |
| fig\|1492.48.peg.3952 | Clostridium butyricum | | |
| fig\|1121302.3.peg.4511 | Clostridium cavendishii DSM 21758 | | |
| fig\|398512.4.peg.5301 | Pseudobacteroides cellulosolvens ATCC 35603 = DSM 2933 | | |
| fig\|1946357.3.peg.500 | Clostridium sp. UBA3947 | | |
| fig\|642492.3.peg.3338 | Cellulosilyticum lentocellum DSM 5427 | | |
| fig\|1946690.3.peg.1553 | Lachnoclostridium sp. UBA3320 | | |
| fig\|397290.3.peg.150 | Lachnospiraceae bacterium A2 | | |
| fig\|97138.3.peg.1713 | Clostridium sp. ASF356 | | |
| fig\|1965545.3.peg.499 | Tyzzerella sp. An114 | | |
| fig\|1047063.3.peg.240 | WS1 bacterium JGI 0000059-K21 | | |
| fig\|1192034.3.peg.1508 | Chondromyces apiculatus DSM 436 | | |
| AAA88323.1 | Myxococcus xanthus | Retron-Mxa2 (Mx65) | |
| fig\|33.8.peg.8196 | Myxococcus fulvus | | |
| fig\|215803.3.peg.1485 | Enhygromyxa salina | | |
| fig\|1406225.3.peg.2150 | Archangium violaceum Cb vi76 | | |
| fig\|1952931.3.peg.5137 | Verrucomicrobia subdivision 3 bacterium UBA6082 | | |
| fig\|1972460.3.peg.279 | Anaerolineaceae bacterium 4572_78 | | |
| fig\|1950201.3.peg.3297 | Anaerolineales bacterium UBA2796 | | |
| WP_015247705.1 | | | |
| fig\|1799658.3.peg.2777 | Planctomycetaceae bacterium SCGC AG-212-F19 | | |
| fig\|214688.26.peg.6659 | Gemmata obscuriglobus UQM 2246 | | |
| fig\|12023130.3.peg.4250 | Rhodopirellula sp. MGV | | |
| fig\|52.7.peg.9046 | Chondromyces crocatus | | |
| fig\|448385.16.peg.2914 | Sorangium cellulosum So ce56 | | |
| fig\|888845.4.peg.14202 | Minicystis rosea | | |
| fig\|1752210.3.peg.1275 | Deltaproteobacteria bacterium Ga0077539 | | |
| fig\|1391654.3.peg.3562 | Labilithrix luteola | | |
| fig\|1752218.3.peg.3670 | Planctomycetaceae bacterium Ga0077529 | | |
| WP_006981058.1 | Chthoniobacter flavus | | |
| fig\|1952939.3.peg.2584 | Verrucomicrobiaceae bacterium UBA1938 | | |
| fig\|2024858.3.peg.3711 | Sandaracinus sp. | | |
| WP_009096166.1 | Rhodopirellula sp. SWK7 | | |
| fig\|595453.3.peg.1506 | Rhodopirellula sp. SM50 | | |
| fig\|1263868.3.peg.4100 | Rhodopirellula europaea SH398 | | |
| fig\|167547.3.peg.303 | Prochlorococcus marinus str. MIT 9311 | | |
| fig\|1499501.3.peg.459 | Prochlorococcus sp. SS52 | | |
| fig\|1905359.3.peg.4335 | marine bacterium AO1-C | | |
| WP_002700020.1 | Microscilla marina | | |
| fig\|1913989.145.peg.263 | Gammaproteobacteria bacterium | | |
| WP_073154989.1 | Seinonella peptonophila | | |
| fig\|46223.3.peg.3648 | Thermoflavimicrobium dichotomicum | | |
| fig\|1329796.3.peg.1947 | Risungbinella massiliensis | | |
| fig\|1123252.3.peg.3225 | Shimazuella kribbensis DSM 45090 | | |

| NCBI Accession[a] | Species/strain | Retron name (if applicable) | SEQ ID NO: 19413-to-21341 |
|---|---|---|---|
| fig\|714067.3.peg.3719 | *Kroppenstedtia eburnea* | | |
| fig\|1341151.3.peg.628 | *Laceyella sacchari* 1-1 | | |
| fig\|2026763.3.peg.3089 | Myxococcales bacterium | | |
| fig\|1797895.3.peg.2518 | Deltaproteobacteria bacterium RIFOXYA12_FULL_58_15 | | |
| fig\|373672.4.peg.4082 | *Chryseobacterium gambrini* | | |
| fig\|1416778.5.peg.4374 | *Chryseobacterium arachidis* | | |
| fig\|1603293.4.peg.829 | *Flavobacterium* sp. 316 | | |
| CCB70859.1 | *Flavobacterium branchiophilum* FL-15 | | |
| fig\|1986952.3.peg.951 | Sphingobacteriaceae bacterium GW460-11-11-14-LB5 | | |
| fig\|1476464.3.peg.4304 | *Pedobacter xixiisoli* | | |
| fig\|1761785.3.peg.3112 | *Flavobacterium* sp. ov086 | | |
| fig\|1664068.3.peg.3690 | bacterium 336/3 | | |
| fig\|880071.3.peg.3500 | *Bernardetia litoralis* DSM 6794 | | |
| fig\|1121902.3.peg.2906 | *Eisenibacter elegans* DSM 3317 | | |
| fig\|1509483.4.peg.1923 | *Flectobacillus* sp. BAB-3569 | | |
| fig\|1166018.3.peg.5312 | *Fibrella aestuarina* BUZ 2 | | |
| fig\|634771.3.peg.967 | *Chitinophaga eiseniae* | | |
| fig\|29529.3.peg.396 | *Chitinophaga arvensicola* | | |
| fig\|1891659.3.peg.6032 | *Chitinophaga* sp. CB10 | | |
| fig\|2033437.3.peg.3442 | *Chitinophaga* sp. MD30 | | |
| fig\|1004.4.peg.1677 | *Chitinophaga sancti* | | |
| fig\|1881041.3.peg.3698 | *Chitinophaga* sp. YR627 | | |
| fig\|1123078.3.peg.2010 | *Runella zeae* DSM 19591 | | |
| fig\|1354355.3.peg.1846 | *Niastella yeongjuensis* | | |
| fig\|1951546.3.peg.1574 | Chitinophagaceae bacterium UBA1946 | | |
| fig\|1812911.3.peg.633 | *Flavihumibacter* sp. CACIAM 22H1 | | |
| fig\|477680.4.peg.4668 | *Filimonas lacunae* | | |
| fig\|221126.7.peg.3781 | *Algibacter lectus* | | |
| fig\|342954.4.peg.734 | *Lacinutrix algicola* | | |
| fig\|1871037.5.peg.2180 | Flavobacteriaceae bacterium | | |
| fig\|669041.3.peg.843 | *Tenacibaculum dicentrarchi* | | |
| WP_074538568.1 | *Cellulophaga baltica* | | |
| fig\|1248440.3.peg.1511 | *Polaribacter franzmannii* ATCC 700399 | | |
| fig\|1121007.3.peg.1574 | *Aquimarina muelleri* DSM 19832 | | |
| fig\|688867.3.peg.2332 | *Ohtaekwangia koreensis* | | |
| fig\|926565.3.peg.717 | *Sporocytophaga myxococcoides* DSM 11118 | | |
| fig\|1257021.3.peg.5265 | Flammeovirgaceae bacterium 311 | | |
| fig\|2044937.5.peg.2350 | candidate division KSB3 bacterium | | |
| fig\|1499966.3.peg.180 | Candidatus *Moduliflexus flocculans* | | |
| fig\|1948269.3.peg.1254 | Verrucomicrobia bacterium UBA6053 | | |
| fig\|694433.3.peg.3103 | *Saprospira grandis* DSM 2844 | | |
| fig\|2008677.3.peg.3337 | *Mitsuaria noduli* | | |
| fig\|946333.3.peg.3570 | *Rhizobacter gummiphilus* | | |
| fig\|1736433.3.peg.5559 | *Rhizobacter* sp. Root1221 | | |
| fig\|1500265.3.peg.5760 | *Methylibium* sp. YR605 | | |
| fig\|1121349.4.peg.2836 | *Comamonas composti* DSM 21721 | | |
| fig\|1082851.3.peg.91 | *Comamonas serinivorans* | | |
| fig\|1121480.5.peg.5468 | *Pseudoduganella violaceinigra* DSM 15887 | | |
| fig\|2045208.3.peg.1247 | *Massilia violaceinigra* | | |
| fig\|1736455.3.peg.3692 | *Massilia* sp. Root133 | | |
| fig\|34073.25.peg.8569 | *Variovorax paradoxus* | | |
| fig\|1884311.3.peg.7121 | *Variovorax* sp. OK202 | | |
| fig\|1123487.3.peg.1763 | *Uliginosibacterium gangwonense* DSM 18521 | | |
| fig\|2029111.3.peg.3032 | Comamonadaceae bacterium NML120219 | | |
| fig\|1977087.20.peg.1226 | Proteobacteria bacterium | | |
| fig\|754436.4.peg.4454 | *Photobacterium aphoticum* | | |
| fig\|265726.7.peg.1038 | *Photobacterium halotolerans* | | |
| fig\|1121867.3.peg.59 | *Enterovibrio calviensis* DSM 14347 | | |
| fig\|1238431.3.peg.2655 | *Vibrio nigripulchritudo* BLFn1 | | |
| fig\|1384589.3.peg.2721 | [*Erwinia*] *teleogryllii* | | |
| fig\|1261127.3.peg.2947 | *Citrobacter amalonaticus* Y19 | | |
| fig\|349521.8.peg.3588 | *Hahella chejuensis* KCTC 2396 | | |
| fig\|525918.3.peg.1501 | *Thiothrix caldifontis* | | |
| fig\|1737490.4.peg.4974 | *Agarilytica rhodophyticola* | | |
| fig\|251229.3.peg.427 | *Chroococcidiopsis thermalis* PCC 7203 | | |
| fig\|1245923.3.peg.9587 | *Scytonema millei* VB511283 | | |
| fig\|1503470.5.peg.10896 | cyanobacterium TDX16 | | |

-continued

| NCBI Accession[a] | Species/strain | Retron name (if applicable) | SEQ ID NO: 19413-to-21341 |
|---|---|---|---|
| fig\|2005460.3.peg.1118 | *Chondrocystis* sp. NIES-4102 | | |
| fig\|179408.3.peg.4679 | *Oscillatoria nigro-viridis* PCC 7112 | | |
| fig\|1612423.3.peg.5384 | *Nostoc linckia* z1 | | |
| fig\|63737.11.peg.472 | *Nostoc punctiforme* PCC 73102 | | |
| fig\|224013.5.peg.7163 | *Nostoc piscinale* CENA21 | | |
| fig\|1932621.3.peg.7363 | *Nostoc* sp. T09 | | |
| fig\|373994.3.peg.3383 | *Rivularia* sp. PCC 7116 | | |
| fig\|2005463.3.peg.257 | *Calothrix* sp. NIES-4105 | | |
| fig\|2005459.3.peg.7019 | *Tolypothrix* sp. NIES-4075 | | |
| fig\|184925.3.peg.2602 | *Chlorogloeopsis fritschii* PCC 9212 | | |
| fig\|454136.5.peg.3127 | *Phormidium ambiguum* IAM M-71 | | |
| fig\|203124.6.peg.2732 | *Trichodesmium erythraeum* IMS101 | | |
| fig\|2040638.3.peg.3067 | *Tychonema bourrellyi* FEM_GT703 | | |
| fig\|1880991.4.peg.2927 | Oscillatoriales cyanobacterium USR001 | | |
| fig\|1173028.3.peg.7115 | *Oscillatoria* sp. PCC 10802 | | |
| fig\|568701.4.peg.2073 | *Moorea bouillonii* PNG | | |
| fig\|927677.3.peg.4187 | *Synechocystis* sp. PCC 7509 | | |
| fig\|179408.3.peg.6267 | *Oscillatoria nigro-viridis* PCC 7112 | | |
| fig\|1710894.3.peg.2079 | *Aphanizomenon flos-aquae* LD13 | | |
| fig\|1947888.3.peg.4484 | Cyanobacteria bacterium UBA6047 | | |
| fig\|1705388.3.peg.1178 | *Planktothricoides* sp. SR001 | | |
| fig\|454136.5.peg.4162 | *Phormidium ambiguum* IAM M-71 | | |
| fig\|2005458.3.peg.378 | *Nostoc* sp. NIES-4103 | | |
| fig\|1947874.3.peg.4590 | Cyanobacteria bacterium UBA1583 | | |
| fig\|1781255.3.peg.802 | *Desertifilum* sp. IPPAS B-1220 | | |
| fig\|1128427.4.peg.2346 | filamentous cyanobacterium ESFC-1 | | |
| fig\|1946321.3.peg.3928 | *Chloracidobacterium* sp. UBA7656 | | |
| fig\|118173.3.peg.1030 | *Pseudanabaena* sp. PCC 6802 | | |
| fig\|1922337.4.peg.4802 | *Leptolyngbya* sp. 'hensonii' | | |
| fig\|927668.3.peg.2766 | *Pseudanabaena biceps* PCC 7429 | | |
| fig\|1173020.3.peg.6191 | *Chamaesiphon minutus* PCC 6605 | | |
| fig\|329726.14.peg.4440 | *Acaryochloris marina* MBIC11017 | | |
| fig\|215803.3.peg.1649 | *Enhygromyxa salina* | | |
| fig\|1920190.3.peg.9548 | *Archangium* sp. Cb G35 | | |
| fig\|1961464.3.peg.5181 | Myxococcales bacterium UBA2376 | | |
| fig\|765913.3.peg.336 | *Thiorhodococcus drewsii* AZ1 | | |
| fig\|1396141.3.peg.2891 | *Haloferula* sp. BvORR071 | | |
| fig\|1961463.3.peg.5253 | Myxococcales bacterium UBA1671 | | |
| AAL40743.1 | *Nannocystis exedens* | Retron-Nex2 (Ne144) | |
| fig\|54.3.peg.4123 | *Nannocystis exedens* | | |
| fig\|53367.3.peg.3417 | *Asanoa ferruginea* | | |
| fig\|460265.11.peg.3882 | *Methylobacterium nodulans* ORS 2060 | | |
| fig\|298794.3.peg.462 | *Methylobacterium variabile* | | |
| fig\|190148.4.peg.3492 | *Bradyrhizobium paxllaeri* | | |
| fig\|1075417.3.peg.445 | *Catalinimonas alkaloidigena* | | |
| fig\|1429438.4.peg.7505 | *Candidatus Entotheonella* factor | | |
| fig\|1977087.12.peg.1756 | Proteobacteria bacterium | | |
| fig\|92487.3.peg.3972 | *Thiothrix eikelboomii* | | |
| fig\|1977087.20.peg.1473 | Proteobacteria bacterium | | |
| fig\|1123400.3.peg.3276 | *Thiofilum flexile* DSM 14609 | | |
| fig\|34062.8.peg.73 | *Moraxella osloensis* | | |
| fig\|1699623.3.peg.1502 | *Psychrobacter* sp. P11G3 | | |
| fig\|1123509.3.peg.848 | *Zooshikella ganghwensis* DSM 15267 | | |
| fig\|2026735.3.peg.2222 | Deltaproteobacteria bacterium | | |
| fig\|1977087.12.peg.2982 | Proteobacteria bacterium | | |
| fig\|2026763.4.peg.1195 | Myxococcales bacterium | | |
| fig\|1977087.12.peg.510 | Proteobacteria bacterium | | |
| fig\|1123508.3.peg.7252 | *Zavarzinella formosa* DSM 19928 | | |
| fig\|214688.26.peg.3091 | *Gemmata obscuriglobus* UQM 2246 | | |
| fig\|1908690.5.peg.1204 | *Fimbriiglobus ruber* | | |
| fig\|1805126.3.peg.4431 | Deltaproteobacteria bacterium CG2_30_63_29 | | |
| fig\|1882752.4.peg.1962 | *Singulisphaera* sp. GP187 | | |
| fig\|1636152.3.peg.5364 | *Planctomyces* sp. SH-PL62 | | |
| APR75442.1 | *Minicystis rosea* | | |
| fig\|54.3.peg.8798 | *Nannocystis exedens* | | |
| fig\|980254.4.peg.4083 | *Roseimaritima ulvae* | | |
| fig\|1856297.3.peg.3627 | Gammaproteobacteria bacterium 45_16_T64 | | |
| fig\|1219077.3.peg.1945 | *Vibrio azureus* NBRC 104587 | | |
| fig\|1334629.3.peg.167 | *Myxococcus fulvus* 124B02 | | |

-continued

| NCBI Accession[a] | Species/strain | Retron name (if applicable) | SEQ ID NO: 19413-to-21341 |
|---|---|---|---|
| AAA25405.1 | *Myxococcus xanthus* | Retron-Mxa1 (Mx162) | |
| fig\|378806.16.peg.4444 | *Stigmatella aurantiaca* DW4/3-1 | | |
| WP_002615305.1 | *Stigmatella aurantiaca* | Retron-Sau1 (Sa163) | |
| fig\|48.3.peg.757 | *Archangium gephyra* | | |
| fig\|448385.16.peg.2083 | *Sorangium cellulosum* So ce56 | | |
| fig\|52.7.peg.5100 | *Chondromyces crocatus* | | |
| fig\|1752210.3.peg.5621 | Deltaproteobacteria bacterium Ga0077539 | | |
| fig\|2024858.3.peg.6345 | *Sandaracinus* sp. | | |
| WP_012826728.1 | *Haliangium ochraceum* | | |
| fig\|927083.3.peg.3408 | *Sandaracinus amylolyticus* | | |
| WP_006977315.1 | *Plesiocystis pacifica* | | |
| fig\|1400863.5.peg.627 | Candidatus *Competibacter denitrificans* Run_A_D11 | | |
| fig\|1961463.3.peg.4303 | Myxococcales bacterium UBA1671 | | |
| fig\|1898731.3.peg.3099 | *Curtobacterium* sp. MCBA15_001 | | |
| fig\|1279028.3.peg.3374 | *Curtobacterium* sp. 314Chir4.1 | | |
| fig\|1898733.3.peg.2056 | *Curtobacterium* sp. MCBA15_004 | | |
| fig\|1795630.3.peg.3476 | *Frondihabitans* sp. PAMC 28766 | | |
| fig\|2033654.3.peg.3461 | *Curtobacterium* sp. 'Ferrero' | | |
| fig\|1736329.5.peg.1436 | *Frondihabitans* sp. Leaf304 | | |
| fig\|1736292.3.peg.1083 | *Rathayibacter* sp. Leaf185 | | |
| fig\|1736327.3.peg.206 | *Rathayibacter* sp. Leaf296 | | |
| fig\|1736311.3.peg.3668 | *Curtobacterium* sp. Leaf261 | | |
| fig\|1736308.3.peg.2333 | *Frigoribacterium* sp. Leaf254 | | |
| fig\|656366.8.peg.2905 | *Arthrobacter alpinus* | | |
| fig\|494023.3.peg.138 | *Paeniglutamicibacter antarcticus* | | |
| ASN40093.1 | *Arthrobacter* sp. 7749 | | |
| fig\|1494608.3.peg.465 | *Arthrobacter* sp. PAMC 25486 | | |
| fig\|656366.4.peg.2620 | *Arthrobacter alpinus* | | |
| fig\|656366.3.peg.1944 | *Arthrobacter alpinus* | | |
| fig\|1132441.3.peg.1888 | *Arthrobacter* sp. 35W | | |
| fig\|1704044.3.peg.520 | *Arthrobacter* sp. ERGS1:01 | | |
| fig\|1496689.3.peg.681 | *Arthrobacter* sp. L77 | | |
| fig\|1681197.3.peg.149 | *Arthrobacter* sp. RIT-PI-e | | |
| fig\|37921.12.peg.1481 | *Arthrobacter agilis* | | |
| fig\|1736303.3.peg.982 | *Arthrobacter* sp. Leaf234 | | |
| fig\|1312978.3.peg.1472 | *Arthrobacter* sp. H41 | | |
| fig\|1348338.3.peg.1472 | *Leifsonia rubra* CMS 76R | | |
| fig\|1452536.3.peg.1955 | *Microbacterium* sp. Cr-K20 | | |
| fig\|1736525.3.peg.446 | *Leifsonia* sp. Root4 | | |
| fig\|1529318.3.peg.434 | *Cryobacterium* sp. MLB-32 | | |
| fig\|1267973.3.peg.3479 | *Arthrobacter* sp. H5 | | |
| fig\|150121.3.peg.1900 | *Agreia pratensis* | | |
| fig\|123316.3.peg.955 | *Agreia* sp. VKM Ac-2052 | | |
| fig\|1052260.3.peg.3617 | *Klenkia soli* | | |
| fig\|1566299.3.peg.3962 | *Klenkia marina* | | |
| fig\|1736356.3.peg.3150 | *Modestobacter* sp. Leaf380 | | |
| fig\|1736354.3.peg.1787 | *Geodermatophilus* sp. Leaf369 | | |
| fig\|479431.6.peg.3115 | *Nakamurella multipartita* DSM 44233 | | |
| fig\|1090615.3.peg.2397 | *Nakamurella panacisegetis* | | |
| fig\|1306174.4.peg.4778 | *Kineosporia aurantiaca* JCM 3230 | | |
| fig\|546871.3.peg.1120 | *Friedmanniella luteola* | | |
| fig\|630515.4.peg.525 | *Microlunatus soli* | | |
| fig\|546874.3.peg.1181 | *Friedmanniella sagamiharensis* | | |
| BAK35674.1 | *Microlunatus phosphovorus* NM-1 | | |
| fig\|1380390.4.peg.72 | Solirubrobacterales bacterium URHD0059 | | |
| fig\|1283299.3.peg.2784 | *Conexibacter woesei* Iso977N | | |
| fig\|929712.3.peg.3165 | *Patulibacter minatonensis* DSM 18081 | | |
| fig\|1123262.3.peg.3125 | *Solirubrobacter soli* DSM 22325 | | |
| fig\|1861.4.peg.5240 | *Geodermatophilus obscuras* | | |
| fig\|1137993.4.peg.1318 | *Geodermatophilus africanus* | | |
| fig\|1070870.3.peg.778 | *Geodermatophilus nigrescens* | | |
| fig\|1190417.3.peg.1785 | *Geodermatophilus telluris* | | |
| fig\|477641.3.peg.1023 | *Modestobacter marinus* | | |
| fig\|1798228.3.peg.3756 | *Blastococcus* sp. DSM 46838 | | |
| WP_091929708.1 | *Blastococcus* sp. DSM 46786 | | |
| SHH20361.1 | *Jatrophihabitans endophyticus* | | |
| fig\|1844.3.peg.1151 | *Nocardioides luteus* | | |

-continued

| NCBI Accession<sup>a</sup> | Species/strain | Retron name (if applicable) | SEQ ID NO: 19413-to-21341 |
|---|---|---|---|
| fig\|748909.6.peg.1418 | *Nocardioides alpinus* | | |
| fig\|402596.3.peg.987 | *Nocardioides exalbidus* | | |
| fig\|1736322.3.peg.1963 | *Nocardioides* sp. Leaf285 | | |
| fig\|1445613.3.peg.3490 | *Sciscionella* sp. SE31 | | |
| fig\|543632.4.peg.9742 | *Actinoplanes subtropicus* | | |
| fig\|1036182.3.peg.2958 | *Actinoplanes atraurantiacus* | | |
| fig\|1246995.3.peg.737 | *Actinoplanes friuliensis* DSM 7358 | | |
| fig\|56427.3.peg.3052 | *Couchioplanes caeruleus* subsp. *caeruleus* | | |
| fig\|1710355.3.peg.2225 | *Actinoplanes* sp. TFC3 | | |
| fig\|649831.3.peg.2352 | *Actinoplanes* sp. N902-109 | | |
| fig\|35754.4.peg.6321 | *Dactylosporangium aurantiacum* | | |
| fig\|1881.4.peg.2703 | *Micromonospora viridifaciens* | | |
| fig\|47863.3.peg.3975 | *Micromonospora globosa* | | |
| fig\|285665.4.peg.2050 | *Micromonospora coriariae* | | |
| fig\|1192034.3.peg.4668 | *Chondromyces apiculatus* DSM 436 | | |
| fig\|1198133.3.peg.2442 | *Myxococcus xanthus* DZ2 | | |
| fig\|33.8.peg.521 | *Myxococcus fulvus* | | |
| fig\|394193.3.peg.7794 | *Amycolatopsis saalfeldensis* | | |
| fig\|369932.4.peg.5621 | *Amycolatopsis niigatensis* | | |
| fig\|1238180.3.peg.5340 | *Amycolatopsis azurea* DSM 43854 | | |
| fig\|589385.3.peg.7940 | *Amycolatopsis xylanica* | | |
| fig\|1068980.3.peg.1527 | *Amycolatopsis nigrescens* CSC17Ta-90 | | |
| fig\|1854586.3.peg.2100 | *Amycolatopsis antarctica* | | |
| fig\|587909.3.peg.3086 | *Yuhushiella deserti* | | |
| fig\|2030.3.peg.3051 | *Kibdelosporangium aridum* | | |
| fig\|1382595.4.peg.3164 | *Saccharopolyspora erythraea* D | | |
| WP_013675061.1 | *Pseudonocardia dioxanivorans* | | |
| fig\|1660131.3.peg.2805 | *Pseudonocardia* sp. SCN 72-86 | | |
| fig\|366584.3.peg.4349 | *Pseudonocardia oroxyli* | | |
| fig\|1885031.4.peg.5241 | *Pseudonocardia* sp. Ae331_Ps2 | | |
| fig\|1690815.5.peg.5350 | *Pseudonocardia* sp. HH130630-07 | | |
| fig\|1123023.3.peg.3229 | *Pseudonocardia acaciae* DSM 45401 | | |
| fig\|1449976.3.peg.8114 | *Kutzneria albida* DSM 43870 | | |
| WP_007238159.1 | | | |
| fig\|1220583.3.peg.1582 | *Gordonia aichiensis* NBRC 108223 | | |
| GAB07179.1 | *Gordonia amarae* NBRC 15530 | | |
| fig\|1223545.3.peg.704 | *Gordonia soli* NBRC 108243 | | |
| fig\|1223540.3.peg.3237 | *Gordonia desulfuricans* NBRC 100010 | | |
| fig\|1112204.3.peg.4913 | *Gordonia polyisoprenivorans* VH2 | | |
| AFR49048.1 | *Gordonia* sp. KTR9 | | |
| fig\|402289.3.peg.1558 | *Rhodococcus* sp. HA99 | | |
| fig\|1077144.3.peg.224 | *Dietzia alimentaria* 72 | | |
| fig\|1344003.3.peg.1864 | *Williamsia sterculiae* | | |
| fig\|1463823.3.peg.3407 | *Microbispora* sp. NRRL B-24597 | | |
| fig\|1903117.3.peg.1566 | *Williamsia* sp. 1138 | | |
| fig\|1603258.4.peg.1828 | *Williamsia herbipolensis* | | |
| fig\|644548.3.peg.652 | *Gordonia neofelifaecis* NRRL B-59395 | | |
| fig\|1136941.3.peg.1310 | *Gordonia phthalatica* | | |
| fig\|1223542.3.peg.3439 | *Gordonia malaquae* NBRC 108250 | | |
| fig\|47312.10.peg.4232 | *Tsukamurella pulmonis* | | |
| fig\|57704.14.peg.421 | *Tsukamurella tyrosinosolvens* | | |
| fig\|521096.6.peg.2443 | *Tsukamurella paurometabola* DSM 20162 | | |
| fig\|1123241.3.peg.3642 | *Nakamurella lactea* DSM 19367 | | |
| fig\|1210073.4.peg.1031 | *Nocardia salmonicida* NBRC 100378 | | |
| fig\|1206740.4.peg.4617 | *Nocardia thailandica* NBRC 100428 | | |
| fig\|1210064.4.peg.2434 | *Nocardia altamirensis* NBRC 108246 | | |
| fig\|1123258.3.peg.1651 | *Smaragdicoccus niigatensis* DSM 44881 = NBRC 103563 | | |
| fig\|1443888.3.peg.2891 | *Rhodococcus fascians* 02-815 | | |
| fig\|1517936.4.peg.882 | *Rhodococcus* sp. CUA-806 | | |
| fig\|398843.6.peg.4214 | *Rhodococcus kyotonensis* | | |
| fig\|1813677.3.peg.4031 | *Rhodococcus* sp. EPR-157 | | |
| WP_008711873.1 | | | |
| fig\|1381122.3.peg.6103 | *Rhodococcus erythropolis* DN1 | | |
| fig\|1736210.3.peg.2766 | *Rhodococcus* sp. Leaf7 | | |
| fig\|1736300.3.peg.1279 | *Rhodococcus* sp. Leaf225 | | |
| fig\|1219012.3.peg.1705 | *Rhodococcus corynebacterioides* NBRC 14404 | | |
| fig\|1219023.3.peg.2791 | *Rhodococcus rhodnii* NBRC 100604 | | 21339 |

-continued

| NCBI Accession[a] | Species/strain | Retron name (if applicable) | SEQ ID NO: 19413-to-21341 |
|---|---|---|---|
| fig\|616997.3.peg.2548 | *Hoyosella altamirensis* | | 21340 |
| fig\|1303689.4.peg.2934 | *Rhodococcus koreensis* JCM 10743 = NBRC 100607 | | 21341 |

[a]Accession in Patric database (https://www.patricbrc.org/) or NCBI (https://www.ncbi.nlm.nih.gov/protein/)

Thus, in various aspects, the present disclosure describes making recombinant retrons and retron-based genome editing sy tables summarize the amino acid and nucleotide sequences disclosed herein, each being ascribed an individual sequence identifier (i.e., SEQ ID NO). In some instances, the sequences are disclosed in the body of the Specification. In other instances, the sequences are disclosed in the Sequence Listing, which forms a part of the instant Specification.

The following is a sequence key to summarize and identify the enclosed sequences. The sequence key accompanies the visual summary provided in FIGS. 28 and 29.

Table A and Sub-Tables A1-A45: Novel Retron Reverse Transcriptase Sequences

Table A provides non-limiting examples of retron reverse transcriptases that may be modified in accordance with the herein methods to obtain a recombinant retron reverse transcriptase or use in the compositions, systems, and methods described herein.

In particular, Table A provides sequence identifiers corresponding to the novel retron RTs identified as a result of the computational discovery work described in the Examples. The table provides sequence identifiers corresponding to the contents of the Sequence Listing included as part of this Specification. The table includes both RT amino acid sequences and RT nucleic acid sequences. The table is organized into forty-five sub-tables each of which represents those sequences forming a single phylogenetic clade of related retron RTs as determined by the computational work described in the Examples.

| | Seq ID Nos | | |
|---|---|---|---|
| Table | RT Amino Acid Sequence | RT Nucleic Acid Sequence | Functional Types |
| A1 | 3980-4178 | 11231-11429 | I-A |
| A2 | 4671-4825 | 11922-12075 | I-B1 |
| A3 | 4980-5143 | 12229-12392 | I-B2 |
| A4 | 367-368, 427-441, 494-521, 526-527, 536, 626, 649, 660-668, 675, 679, 687-692, 695, 697, 703, 716, 721-722, 751-763, 767, 770-1411, 1456-1462 | 7624-7625, 7684-7698, 7751-7778, 7783-7784, 7793, 7883, 7906, 7917-7925, 7932, 7936, 7944-7949, 7952, 7954, 7960, 7973, 7978-7979, 8008-8020, 8024, 8027-8667, 8712-8718 | I-C |
| A5 | 1529-1569 | 8784-8823 | I-D |
| A6 | 6697-6701 | 13943-13947 | II |
| A7 | 4179-4670 | 11430-11921 | II-A1 |
| A8 | 4884-4909 | 12134-12159 | II-A1 other |
| A9 | 6919-6972 | 14163-14215 | II-A2 |
| A10 | 2786-2866, 2887-2938 | 10039-10119, 10140-10191 | II-A3 |
| A11 | 4826-4863 | 12076-12113 | II-A4 |
| A12 | 4864-4875 | 12114-12125 | II-A4 fused |
| A13 | 6974-7002 | 14217-14244 | II-A5 |

| | Seq ID Nos | | |
|---|---|---|---|
| Table | RT Amino Acid Sequence | RT Nucleic Acid Sequence | Functional Types |
| A14 | 2598-2600, 2759-2785 | 9851-9853, 10012-10038 | III |
| A15 | 2445-2582 | 9699-9836 | III-A1 |
| A16 | 1983-2158 | 9237-9412 | III-A2 |
| A17 | 1612-1982 | 8866-9236 | III-A3 |
| A18 | 2601-2678 | 9854-9931 | III-A4 |
| A19 | 2679-2758 | 9932-10011 | III-A5 |
| A20 | 3442-3603 | 10694-10855 | IV |
| A21 | 3604-3708 | 10856-10959 | V |
| A22 | 2939-3441, 3709-3979, 5177-5192 | 10192-10693, 10960-11230, 12426-12441 | VI |
| A23 | 7003-7033 | 14245-14275 | VII-A1 |
| A24 | 7054-7133 | 14296-14374 | VII-A2 |
| A25 | 7034-7049 | 14276-14291 | VIII |
| A26 | 6835-6918 | 14079-14162 | IX |
| A27 | 6823-6834 | 14068-14078 | X |
| A28 | 298-366, 369-373, 442-493, 522-525, 528-535, 537, 551-554, 557, 560-625, 672-674, 680-681, 684-686, 696, 698, 702, 723-742, 764-766, 1412-1450, 1452-1453, 1463-1466, 1571-1577 | 7555-7623, 2626-7630, 7699-7750, 7785-7792, 7794, 7808-7811, 7814, 7817-7882, 7929-7931, 7937-7938, 7941-7943, 7953, 7955, 7959, 7980-7999, 8021-8023, 8668-8706, 8708-8709, 8719-8722, 8825-8831 | XI |
| A29 | 374-426, 539-550, 555-556, 558-559, 671, 682-683, 743, 745-750 | 7631-7683, 7796-7807, 7812-7813, 7815-7816, 7928, 7939-7940, 800, 8002-8007 | XII |
| A30 | 5942-6665 | 13189-13911 | XIII |
| A31 | 1-297, 715, 1580-1603 | 7258-7554, 7972, 8834-8857 | XIV |
| A32 | 705-714 | 7962-7971 | XV |
| A33 | 6681-6694 | 13927-13940 | XVI |
| A34 | 6788-6803 | 14033-14048 | XVII |
| A35 | 1469-1526, 5147-5151 | 8725-8781, 12396-12400 | CRISPR-associated |
| A36 | 2159-2428 | 9413-9682 | Ec107-like |
| A37 | 646-648 | 7903-7905 | RT-atpase |
| A38 | 2592-2595 | 9846-9849 | RT-DUF4116 |
| A39 | 676-678, 717-720 | 7933-7935, 7974-7977 | RT-HTH |
| A40 | 538, 669, 704, 1454 | 7795, 7926, 7961, 8710 | RT-pddex |
| A41 | 670, 699-701 | 7927, 7956-7958 | RT-unk |
| A42 | 4917-4979 | 12167-12228 | Phage |
| A43 | 4910-4916 | 12160-12166 | Jumbophage |
| A44 | 5195-5941 | 12444-13188 | Outgroup |
| A45 | 627-645, 650-659, 693-694, 744, 768-769, 1451, 1455, 1467-1468, 1527-1528, 1570, 1578, 1579, 1604-1611, 2429-2444, 2583- | 7884-7902, 7907-7916, 7950-7951, 8001, 8025-8026, 8707, 8711, 8723-8724, 8782-8783, 8824, 8832-8833, 8858-8865, 9683- | unclassified |

| Table | Seq ID Nos | | Functional Types |
|---|---|---|---|
| | RT Amino Acid Sequence | RT Nucleic Acid Sequence | |
| | 2591, 2596-2597, 2867-2886, 4876-4883, 5144-5146, 5152-5176, 5193-5194, 6666-6680, 6695-6696, 6702-6787, 6804-6822, 6973, 7050-7053, 7134-7257 | 9698, 9837-9845, 9850, 10120-10139, 12126-12133, 12393-12395, 12401-12425, 12442-12443, 13912-13926, 13941-13942, 13948-14032, 14049-14067, 14216, 14292-14295, 14375-14498 | |

Table B and Sub-Tables B1-B45: Exemplary ncRNA Sequences

Table B provides non-limiting examples of retron ncRNA sequences that may be modified in accordance with the herein methods to obtain a recombinant retron ncRNA sequences for use in the compositions, systems, and methods described herein.

In particular, Table B provides sequence identifiers corresponding to the novel retron RTs identified as a result of the computational discovery work described in the Examples. The table provides sequence identifiers corresponding to the contents of the Sequence Listing included as part of this Specification. The table is organized into forty-five sub-tables each of which represents those sequences forming a single phylogenetic clade of related retron ncRNAs as determined by the computational work described in the Examples.

In various embodiments and in the claims, the disclosure provides recombinant retron-based genome editing systems which comprise combining in a cell through various delivery strategies a retron RT together with an ncDNA. In various aspects, the retron RTs and the ncDNA constituting the recombinant retron-based genome editing system can be based on pairing together such components that are naturally found associated to one another in nature, i.e., sourced from the same bacterial species. These are referred to as the "cognate" pairings of retron RT and retron ncRNA. In various other aspects, the retron RT component and the ncRNA component can be from different bacterial species, i.e., are not found together in nature as cognate pairs. In still other embodiments, the retron RT component and the ncRNA component can both be from the same phylogenetic functional type (e.g., Type I-A, Type I-B1, Type I-B2, Type IC, etc.). For example, a recombinant retron-based genome editing system may be comprised of a retron RT from Type I-A (i.e., SEQ TD Nos: 3980-4178 for AA and SEQ TD Nos: 11231-11429 for NT—see Table A) and a retron ncRNA also from Type I-A (i.e., SEQ TD Nos: 16886-17078—see Table B).

| Table | Seq ID Nos | Functional Types |
|---|---|---|
| B1 | 16886-17078 | I-A |
| B2 | 17478-17622 | I-B1 |
| B3 | 17677-17756 | I-B2 |
| B4 | 14831-14833, 14838, 14847, 14850-15460 | IC |
| B5 | N/A | ID |
| B6 | N/A | II |
| B7 | 17079-17477 | II-A1 |
| B8 | 17660-17676 | II-A1 other |
| B9 | 19031-19080 | II-A2 |
| B10 | 16414-16516 | II-A3 |
| B11 | 17623-17659 | II-A4 |
| B12 | N/A | II-A4 fused |
| B13 | 19081-19108 | II-A5 |
| B14 | 16397-16413 | III |
| B15 | 16195-16320 | III-A1 |
| B16 | 15779-15925 | III-A2 |
| B17 | 15476-15778 | III-A3 |
| B18 | 16321-16366 | III-A4 |
| B19 | 16367-16396 | III-A5 |
| B20 | 16705-16814 | IV |
| B21 | 16815-16885 | V |
| B22 | 16517-16704 | VI |
| B23 | N/A | VII-A1 |
| B24 | N/A | VII-A2 |
| B25 | N/A | VIII |
| B26 | 18949-19030 | IX |
| B27 | N/A | X |
| B28 | 14657-14716, 14778-14824, 14834, 14835-14836, 14839, 15461-15475 | XI |
| B29 | 14717-14777, 14841-14846 | XII |
| B30 | 18413-18936 | XIII |
| B31 | 14499-14656 | XIV |
| B32 | N/A | XV |
| B33 | 18939 | XVI |
| B34 | N/A | XVII |
| B35 | N/A | CRISPR-associated |
| B36 | 15926-16178 | Ec107-like |
| B37 | N/A | RT-atpase |
| B38 | N/A | RT-DUF4116 |
| B39 | N/A | RT-pddex |
| B40 | N/A | RT-HTH |
| B41 | 14837 | RT-unk |
| B42 | N/A | Phage |
| B43 | N/A | Jumbophage |
| B44 | 17757-18412 | Outgroup |
| B45 | 14825-14830, 14840, 14848-14849, 16179-16194, 18937-18938, 18940-18948 | unclassified |

Table C: Consensus RT Amino Acid Sequence

Table C provides a consensus amino acid sequence for each type of RT identified in Table A.

| RT Type | Consensus Amino Acid Sequence | SEQ ID NO: |
|---|---|---|
| TypeIA | YKVYXIPKRXXGXRXIAXPXXXLKXXQXXXXXXXXXXXXXHXXXXAYXXXXXIKXNAXXHXXXXYXLK XDXXXFFNSIXXXXXXXXXXXXXXXXXXXXXXXXXFWXXXXXXXXXLXLSXGAPSSPXXSNXXMXXFDXXXXX XCXXXXXXXYXRYADDXTFSTXXXXXLXXXPXXXXXLXXXXXXXXXXXNXXKTXFSSKAHNRHXTGXTXXNXXXXSX GRXXKRXIXXLXXXXXXX | 19109 |
| TypeIIA1 | YKXXXIXKXXGXXRXIXXPXXXXKXXQXXXXXXXXXXXXXHXXAXAYXXXXXIXXNAXXHXXXXXXX XDFXXFFXSIXXXXXXXXXXXXXXXXXXXXXXXXXXXXXLXIGXPXSPXXSNXXXXXXDXXXXX XXXXXXXXYXRYADDXXXSXXXXXXXXXXXXXXXXXXXXNXXKTXXXXXXXXXXXTGXXXXXXXXXXXG RXXKRXXXXXXXXXXX | 19110 |

-continued

| RT Type | Consensus Amino Acid Sequence | SEQ ID NO: |
|---|---|---|
| TypeIB1 | XXXXXXXXXXXXXXXXXXXXXLKXXXXFXXXXXXXXXXXXXXXXXXXVXSYRKGXXXXXAVXXHXXXXXFXXXDXX XFFXSIXXXXXXXXXXXXXXXXXXPXDXXXXXXXXXXXXXXXLPXGXXTSPXXSNXXLXXFDXXXXXXCXXXXXX YTRYXDDXIXSXXXXXXXXXXXXXXXXXXXXLXXXXXXXXXXXNXXKXKXXXXGXXXXKXLGXXILPXGXXXXXXXXXXKXXX EXXXXXXXXX | 19111 |
| TypeIB2 | XXXXXXXXXXXXXXXXXXXXXXXXXXXXXXXXXXXXXXXXXXXSYXXXXXXHXXXXXXXR XDIXXFFXSIXXXXXXXXXXXXXXXXXXXXXXXXXXXXXXXXXXXXXXXPXGXXXSPXXSNXXFRXXDX XIXXXCXXXXXXXYXRYADDXLFSXXXXXXXXXXXXXFXXXIXXXXXXXXXXNXXKXXXXXXXXSLNGXXXXXXXX XXXSXXKXXXXXXXXXXXXX | 19112 |
| TypeIC | YXXFXIXKXXGXXRXIXAPXXXLKXXQXXLXXXLXXXXXXXXXXXXXXXXXXXXXHXFXXXXXXIXXXNAXXH XXXXXVXNXDLXXFFXXXXFGRVXGXFXXXXXXFXXXXXXAXXXAQXXCXXXXLPQGXPXSPXIXNXIXXXLDXXXX XXAXXXXXXXXYRYADDXTFSTXXXXXXXXXXXXXXXXXXXXXXXXXGFXXNXXKTRXXXXXXRQXVTGLXV NXXXNXXXXYXXXXRXXXXXXXXX | 19113 |
| TypeID | YXXXXXXXKKXGGXRXIXXPXXXLXXXQXXLXXXLXXYXXXXXXXXXGFXXXXXXXXXXXXXIXXNAXX HXXKXXXLNXDXXXFFXSIXXXXXXXXXXXXXFXXXXXXAXXXXLLXTXXXXLPXGAPXSPXXSNXXCXXXDXXLX XXXXXXXXXXYRYADDLTFSXXXXXXXXXXXXXXXIXXXXFXXNKKKXRXXXXXXXQXVTGXXVNXKXNXXRXXX XXXRAXXHXXXXX | 19114 |
| TypeID | YXXXXXXXKKXGGXRXIXXPXXXLXXXQXXLXXXLXXYXXXXXXXXXGFXXXXXXXXXXXXXIXXNAXX HXXKXXXLNXDXXXFFXSIXXXXXXXXXXXXXFXXXXXXAXXXXLLXTXXXXLPXGAPXSPXXSNXXCXXXDXXLX XXXXXXXXXXYRYADDLTFSXXXXXXXXXXXXXXXIXXXXFXXNKKKXRXXXXXXXQXVTGXXVNXKXNXXRXXX XXXRAXXHXXXXX | 19115 |
| TypeIIA1 | YXXXXXXXXXXXXRXXXXPXXXLKXXQXWXXXXXXXXXXXXXXXAYXXXXXSXXXXAXXHXXXXXXXXX XDIXXFFXSXXXXXXXXXXXXXXXXXXXXXXXXXXXLXXGXXXSPXIXNXXMXXXDXXXXXXXXXXX XXYXRYXDDIXXSSXXXIXXXXXXXXXXLXXXXXXXNXXKTXXXXXXXXXXXXTGXXXXXXXXXXXGXXXXXXXXXX XYXXXXX | 19116 |
| TypeIIA2 | YRXFXXXXKXXGXXRXIXXPRXFXKXXQXXXXDXXLXXLXXHXXXXXXXXXSXXXNAXXHXXXXXXXXX XDIXXXFXXIXXXXXXXXXXXXXXXXXXXXXXXTXXXXLPQGAPTSPXXSNXXLXXFDXXXXXXXXXXXXXXYX RYXDDXTXSXXXXXXXXXXXXXXXXLXXXXXXXNXXKXRXXXXXXXQXVTGXXXNXXXXPXRXXRXXXRAXXXXA XX | 19117 |
| TypeIIA3 | YXXXXXXKXXXXXRXIXXPXXXLKXXQXWILXXILXXXXXSXXXXXFXXXXXXXXNAXXHXXXXXXLX XDXXXFFXXXXXXVXXXFXXXGYXXXXXXXXLXXXCXXXXXLPQGXXXSPXXXNLXXXXLDXRXXXXXXXXXXXXXYT RYADDXXXSXXXXXXXXXXXXXIXXXEXXXXXNXXKXXXXXXXXXXXXXXXXXTGXXXXXXXXXXXXXXXRXXXXXX XX | 19118 |
| TypeIIA4 | XXXXXXIXXXXXXXRKIXTXXXXXXXXXXXXHXXXXXXXXXXXXXXXFXKAYXXXXSIXXNAXXHMYNDXF XXXDIXXFFXXIXHXXLXXXLXXXXXXXXXXXXXXXXXXXXXXXXXGLXXGXXXSPXLXNXYXKXFDXIXYG XLKXXXXXXXXIYTRYADDXXISFKXXXXXXXXXXXIXXXXXXXLXXXXLXXNXXKXXXXXXXXXSNHVXITGXXIXX XXXXXXRXXXVGXXXXXXLXXXAXXXXX | 19119 |
| TypeIIA4 | XXXXXXXXXXXXKXRXXXXXXXXXXGXXXXXXHXXXXXXXXXXXXXXXSYAYXXXXSIXXCXXXHXXXX XFXKXDIXXFFNSIXXXXXLXXXXXXXXXXXXXXXXXXXXXXXXXPXGLXXSPXXSDXYXXXXXXXXXXXX XXXXXXXYTRYADDIXISXXXXXXXXXXIXXXXXLXXXXLXXNXXKXXXXXXXXXXXXXXXXGXNIXXXXXXX XXXVGXXXXXXXXXXXXXXXX | 19120 |
| TypeIIA5 | YRXFXXXKXXGXXRXIXXPXTYLKVXQWWIXDXIXXXXXXXXXXXGFXXGXXXXXXNAXXHXXXXXXLN XDXXXFFXSXXXXXXXXXXFXXXGXXXXXXXLXXLXXXXXXXPXGAPTSPXXXNXXXXXXDXXLXXXXXXXXXXYX RYADDXTFSXXXXXXXXXXXXXXXXXXXXXGFXXXXXXXKTXXXGXXXRXXVTGXXXNXXXXXXXXXRXXXXRXXXXHXXX XX | 19121 |
| TypeIIIA1 | YRXXXIXKXXGXXRXIXEPLPXLKXIQXWILXXILXXXXXSXXAKAXXXXXXXXXXXNXXXHXXXXXXXXX XDXXXFFXXIXXXXXXXXFXXXGYXXXXXXXLXXLCXXXXXLPQGAPTSPXLSNXXXXXXXDXXXXXXXXXXXYT RYADDXXFSGXXXXXXXXXXXXXXXXXXXXXXXNXXKXXXXXXXXXXXQXVTGXVVNXKXQXXXXXRXXXXXXIXK | 19122 |
| TypeIIIA2 | YRXFXIXKXXGGXRXIXXPXXXLXXXQXXIXXXILXXXXXXXXXXXXXXXSXXXNAXXHXXXXXXXLK XDXXXFFXSIXXXXXXXFXXXGYXXXXXXXLXXXCXXXXXLPQGAXTSPXLSNXXXXXXDXXLXXXXXXXXXXYX RYADDXXXSGXXXXXXXXXXXXGXXXNXXKXXXXXXXXXXXIXTGXXXXXXXXXXPXXXXRXXXXXXXXXXX XX | 19123 |
| TypeIIIA3 | YXXXXXXXXXXXXRXIXXPXXXLXXXQXXIXXXXLXXXXXHXXXAXXXXXXXXXXXAXXHXXXXXWXXK XDXXXFFXXXXEXXXXXFXXXGYXXLXXXXEXARXCTXXXXXXXXXXXXXXXXXXXXXXXGXLPQGAPTSXX LXNLXXXXXDXXXXXXAXXXXXXYTRYXDDXXXSXXXXXXXXXXXXXXXXXXXXXXGXXXXXXKXXXXXPGXXX XVLGLXVXXXXXXLXXXXXXXXXHXXXXXXX | 19124 |
| TypeIIIA4 | YXXXXXXKXXGGXRXIXXPXXXLXXXQXWIXXNILXXXXXXXXXXGFXXXXSIXXNAXXHXXXXXXLX XDLXXFXXXIXXXXXXXXFXXXGYXXXXXAAXXXTXXXXXXXXXXXXXXXXXXXXXLPQGAPXSPXXXNXXXXXX DXRXXXXXXXXXXXXYRYADDXTFSXXXXXXXXXXXIXXXEXXXXXNXXKXXXXXXXXXXXXVTGLXXXXXXXXX XXXXXXXXXXXXXXXCXK | 19125 |

-continued

| RT Type | Consensus Amino Acid Sequence | SEQ ID NO: |
|---|---|---|
| TypeIIIA5 | YXXXXIXKXXGXXRXXXXPXXXLKXXQXWILXXILXXXXXXXXXXGFXXXXSIXXNAXXHXXXXXXXX XDXXXFFPXIXXXXXXXXFXXXGYXXXXXXXXXXCTXXXXLPQGPXSPXXXNXXXXXXDXRXXXXXXXXXXXYX RYADDXTXSGXXXXXXXXXXXXXXXIXXXXXXXXNXXKXXXXXXXXXXQXVTGXXVNXXXXXXXXXXXXXXXIYXXXK X | 19126 |
| TypeIIIunk | YXXXXXXXXXRXXXXPXXXLKXXQXWIXXNILXXXXXXXXXXXXXXXSIXXNAXXHXXXXXXX XDIXXFFXSIXXXXXXXXFXXXXXXXXXXXXXXXXXXLXQGXPXSPXXXNXXXXXXDXXXXXXXXXXXXXY XRYADDXXXSXXXXXXXXXXXXXXXXXXXXNXXKTXXXXXXXXXXTGXXXXXXXXXXXXXXXXXXXXEXXYC XX | 19127 |
| TypeIV | YXXXXXXKXXGXXRXXXXPXXXXRXXQXRINXRIFXXXXXWPXXXXGSXPXXXXXXXXXXXXXDYXXCAX XHCXXKXXLKXDIXXFFXNXXXXXVXXXFXXXXXXXXXXXXLXXXCXXXXXXXQGXXTSSYXAXLXLXXXEXXXX XXXXXXKXLXYTRXVDDITXSSXXXXXXFXXXXXXXXXXMLXXXXLPXNXXKXXXXXXXXXXLXVHGLRXXXXXPRXP XXEXXXIRXXVXXXXXX | 19128 |
| TypeV | YXXXXXXXXXXXKRXXXXPXXLKXXXQKRINXXIFXXXXXPXYLXGGXXXXXXXRDYXXNXXXHXXX XXXIXLDXXXFYXXIXXXXVXXXXXXXXFXXVXXXLXLXTXXXXXPQGXCTSSYXANLXXXXXEYXXXXXXXX XXXXXYXRLLDDXTXSXXXXXXXXXXXXXIXXXXXXXXXLXXXXXKXXXXXXXXXXXXXVTGLWXXXXXPXXXX XXRXXIRXXVXXCXXX | 19129 |
| TypeVI | XXXXXXXXXXXXXXRXXXXXXXXXLXXXXXXXXXXXXXXPXXXXXXXXXXXXXXXNAXXHXXXXXXXXXX DXXXFXXXXXXXXXXXXXXXXXXXXXXXXXXXXXXXXXGXXXSXXXXXXXXXXXXXXXXXXXXXXXXXXX XXXDDXXXSXXXXXXXXXXXXXXXXXXXXXXXXXKXXXXXXXXXXXTGXXXXXXXXXXXXXXXXXXXXXX XXX | 19130 |
| TypeVIIA1 | XXXXXXXXXXXXXXXXXXXRXVWEXXXXXXXXXXXKXXXRXXXXFXXXXXXXXXPHXXXXGYXXGRXXRXNAXXH XGXXXXXXXDXXXFFPSIXXXXXXXXXXGXXXXXXXXLXXFXTIXXXLPLGLXXSPXXXNXXXXXXDXXLXXXLA XXXXXXXYXRYDDXXXSXXXXXPXXXXXXXXXXXXXXXXFXXXXXXKXXXSKXGQXHXVTGLSXXXXXXXPHXPRXXKXXL RQELXXXXXX | 19131 |
| TypeVIIA2 | XXXXXXXXXXXXXXXXXXXXXXXXXXXXXXXXXXXXXXXXXXXXGFXXXXXXXXXNAXXHXXXXXXXXX DXXXFFXXIXXXXXXXXXXXXXXXXXXXXXXXXTXXXXLXXGXXTSPXXXNXXXXXXDXXXXXXXXXXXXXRY XDDXXFSXXXXXXXXXXXXXXXXXXXXXXXXXNXXKXXXXXXXGXXQXVTGLXXXXXXXXPRXXXXXXKXXXRXXXXXXX X | 19132 |
| TypeVIII | YXXXXXXXKRXXXXXGEXRXVXXAXXXXXXXXXHRXXXXXXXXXXXXFGXHVQGFXXXRSXXXNAXXHXXX XXXXHADIXXFFXXITXXQVXXXXXXXXXXXXXAXXXAXXCTIDGXLXQGTRCSPXXXNXVCXXXDXXXLXLAXXX XXXXXRYADXXTFSGXXXXXXXXXXXXXXXXXXGFXLRXXXXCYXQXXGXXQXVTGLXVXDXXXPRLPKXXXKXXLRLXX XXXXKX | 19133 |
| TypeIX | YRXFXIXXXXXXXRXIXAPXVXLKXXQXWXXXXXXXXXXXXXXXVXGFXXGXXXXXAAXXHXXAXWXXS XDXXXFFXXXXXXXXXXXXLXXXGYXXXXXXXXXXXXXXXXXLXQGXPXSPXXSNXXXXXXDXXXXXXXXXX RYADDXXFSGXXXXXXXXXXXXXXXXXXXXXWXXXXXKXXXXXXPXRLKVHGLLVXXXXXXXLTKGYRNXXRAXXHXX XXX | 19134 |
| TypeX | YXXXXPXXXXXXXXXRWIEAPXXXLKXXQRXXLXXXXYXXXXXXXAHGFXXGRSIXXNAXXHXGXXXVVX XDXXXFFPXXXXXXXXXXXXXXXXXXXXXXXXLXXXXXLPQGAPTSPXLXNLVXXXXXDXXLXXXAXXXXXXYT RYADDLXFSXXXXXXXXXXXXXXXXXXXXIXXXXGXXXXXXKXXXXXXXQRQXVTGXVVNXXXXLPXXXRRXLRAXXX XXXXX | 19135 |
| TypeXI | YXXFXIXKXXGXXRXIXXPXXXLKXXQXXXXXLXXXXXXXXXXXGFXXXXSXXXNAXXHXXXXXXXXN XDLXXFFXXIXXXXXXXXXXXXXXXXXXXXAXXXAXXXXXXXXLPQGAPXSPXXSNXXXXXXDXXLXXXAXXXXXX YTRYADDXTXSXXXXXXXXXXXXXXXXXXXXXXXXXXXXXXFXNXXKXXXXXXXXXXXXXVTGXXXNXXXNXXR XXXXXXXXXXXXXXX | 19136 |
| TypeXII | YXXFXXXKXXGGXRXIXAPXXXLXXXQXXXXXXXXXXXXXXXXAHGFXXXXSXXXNAXXHXXXXXXXXX XDXXXFFPXXXXXXRVXGXFXXXGYXXXXAXXXAXXXTXXXXXXXXXXXXXXXXXXXXRXLPQGAXXSPXXXNXXXX XLDXRLXXXAXXXXXXYTRYADDXTFSXXXXXXXXXXXXXXXXXXXXXXXEGFXXXXXKXXXXXXXXXXQXVTGXXVN XXXXXXRXXXXXXRAXXXXXXXX | 19137 |
| TypeXIII | YXXFXXPKXXGGXRXIXAPXXXLXXXQXXLXXXXXXXXXXXXAHGFXXXXSXXXNAXXHXXXXXXXXX XDXXXFFPXXXXXXRVXGXFXXXGYXXXXAXXXXLXXTXXXXXXXXXXXXXXXXXXXXXRXLPQGAXXSPXXXNXXXX XLDXRLXXXAXXXGXXYTRYADDLTFSXXXXXXXXXXXXXXXXXXXXXXXEGFXXXXXKXXXXXRXXXXQXVTGXVVN XXXXXXRXXXXXXRAXXXXXXXX | 19138 |
| TypeXIV | YXXFXIXKKXGXXRXIXXPXXXLXXXXXXXXXXXXXXXXXXXXGFXXXXSXXXNAXXHXXXXXVXN XDLXDFFXSXXXXXXXXXXXXXPXXXXXXXXXAXXXXXXLCXXXXXXXXXXXXXLPQGXPXSPXXXNXXCXXLDXXLX XXXAXXXXXXXXXYRYADDXTFSXXXXXXXXXXXFXXXXXXIXXXXXXXXNXXKTRXXXXXXXRQEVTGXXVXXXXXNXXX XYXXXXXRXXLXXWXXX | 19139 |
| TypeXV | YXXFXXXKKXSGGXRXIXXXPXKSLXIXQXKLSQXLYXXXYPXXXVHGXXXXXSIXTNAXXHXXXXKXFXLN XDIXDFFXSINXGRVRGXFIAXPYXLXXXXVATXXAXICCXXNKLPQGAPXSPIXSNLICXXXDXELQXFAXXXXXXX YTRYADDITXSXXXXXXLPXXLXXXXXXXXXXXLGXELXXIIXXNGFXINXXKKXRLXYXXQXQXVTGLXVNXXVNV XRKYIRNXXXXLHAWEKX | 19140 |

-continued

| RT Type | Consensus Amino Acid Sequence | SEQ ID NO: |
|---|---|---|
| TypeXVI | YXXFXXXKXXGXXRXIXAPXXXLKXXQXXILXXXLXXVXLXXXAXGFRXXRSIXTNAXXHXXXXXXXK XDXKXFFPSXXXXRVXGXXXXLGYPXXXXXXLTXLXTXXXXLPXGAPTSPXXXNXXXXRXDXRXXXLXXKXXFXYS RYADDXXXSSXXXXXXXXIPFFXXIXXXEGFXXNEXKXXIXRXGXRQXXTGXVVNXKXNXXXXEXXXLRAVXXNCX XX | 19141 |
| TypeXVII | YRXFXXXKXDGXXRXXXXPXXXLKXXQXXXXXXXLXXXXXHPXAXXFXXXXSXXXXAXXHAXXXXXXT XDXXDFFXXTXXXRVXXXXXXXXXXXXXXXXXLXXLXXXXXXLPQGAPTSPXLSNXVNXXXDXXXXXXXXXXXXXYT RYXDDXXFSWXXXXXPXXFXXXXXXXLXXXGYXXXPXKXXXXXXXXXXPXXTGXXLXXXGXXXXPXXXXXXXXXX X | 19142 |

EXAMPLES

Example 1: Retron Engineering

This example demonstrates that an engineered (or recombinant) retron as described herein can be engineered based on existing sequence information in a sequence database.

Specifically, retron-like reverse transcriptases (RTs) are first identified from various genomic or metagenomic sequence databases. The identified ncRNA regions of the retrons are then predicted in silico, and/or are determined empirically by, for example, reconstituting the putative retron system in a living cell, to assay for msDNA production.

Once a particular wild-type retron is identified and confirmed, one or more sequence elements of the retron are modified based on the methods described herein, and/or the associated RT is modified or engineered to enhance the overall activity and/or processivity of the retron. For example, the wild-type retron can be engineered by one or more of the following methods: (a) addition of a heterologous nucleic acid sequence of interest (e.g., a nucleotide sequence encoding an HDR donor template) to the various portions and structures of the msd locus; (b) performing any/all of the structural modifications described herein; (c) optionally linking the engineered retron ncRNA to one or more CRISPR gRNA, e.g., a gRNA linked to the 3' end of a retron ncRNA, or a gRNA linked to the 5' end of a retron ncRNA, or a pair of gRNAs linked one to the 3' end and one to the 5' end of a retron ncRNA.

The engineered retron or its encoded ncRNA are optionally linked to a sequence-specific nuclease such as CRISPR/Cas enzyme and/or gRNA, ZFN, TALEN, TnpBs, or IscBs, and the like For example, the RT is fused to the CRISPR/Cas enzyme (such as Cas9 or Cpf1) as a N- or C-terminal fusion, optionally further fused to a nuclear localization signal (NLS) at the N- and/or C-terminal of the fusion. The ncRNA or the resulting msDNA after reverse transcription is also linked to a guide RNA (gRNA) at the 5' or 3' end, and can be used with the cognate CRISPR/Cas enzyme in the method of the invention.

In another example, the RT is linked to a DNA-repair modulating biomolecule, such as a HDR promoter and/or an NHEJ peptide inhibitor, as described herein above.

Example 2: Genome Engineering

This example demonstrates that the engineered retron can be used to introduce a heterologous nucleic acid sequence (e.g., a targeting DNA donor or template) into a host cell genome (e.g., a human cell).

First, a targeting DNA is introduced into the msd portion of the engineered retron, as shown in FIG. 3 as a "marker." The heterologous nucleic acid sequence is designed such that it is flanked by 10-100 or more base pairs of homologous sequence substantially identical/homologous to the genomic sequence at the target site. Thus, the desired edit on the "marker" is in between the homologous sequence arms, and includes an insertion, a deletion, and/or other mutations.

A sequence-specific nuclease, such as a Cas9 nuclease, forms a complex with a guide RNA that specifically targets a location at or near the desired editing site on the genomic sequence. The nuclease is designed such that it does not cut the target once the edit is properly installed. In this experiment, the Cas9 nuclease is linked to the retron reverse transcriptase (RT) as a fusion protein. The Cas9 gRNA is also linked to the ncRNA or msDNA produced by the engineered retron.

The engineered retron encoding the sequence-specific nuclease (and the fused RT) as well as the ncRNA (and the linked gRNA) are then introduced into a host cell, such as a human cell.

The engineered retron is introduced as part of a plasmid for transfection into the cell, or as part of a viral vector (such as an AAV vector) for infecting the cell.

Alternatively, the transcribed ncRNA (and the linked gRNA) can be formulated in vitro in, for example, the lipid nanoparticle or delivery system of the invention, for direct delivery into the host cell. The sequence-specific nuclease (and the fused RT) can either be separately delivered into the host cell (using transfection of plasmid or infection by AAV, etc.), or delivered with the ncRNA in lipid nanoparticles. For example, the coding sequence (e.g., mRNA) of the Cas9-RT fusion is formulated with the ncRNA in the same lipid nanoparticle, or separately formulated as lipid nanoparticles to be delivered together, either simultaneously or one after another.

Once present inside the cell, the Cas9-RT fusion is translated by the host cell translation machinery, while the ncRNA is transcribed from the engineered retron (if the ncRNA is not directly delivered into the cell). The RT portion of the fusion proceeds to reverse transcribe the ncRNA and convert it to msDNA, which includes the heterologous nucleic acid sequence as the cargo/donor/template. Meanwhile, double-stranded breaks (DSBs) are generated at the target site by the CRISPR/Cas9 nuclease. The cargo/donor/template sequence is then integrated into the host genome at the target site, via host cell DNA repair (e.g., HDR) after the Cas9 nuclease forms the DSB.

The cells of interest are then assayed for correct installation of the edit on the heterologous nucleic acid sequence, either through phenotypic changes that occur due to the edit, or by direct DNA sequencing of the target site, or both.

Example 3: Computational Discovery of Novel Retrons and Phylogenetic Analysis to Increase Retron Diversity for Genome Editing Applications Reverse transcriptases (RTs), also called RNA-directed DNA polymerases, are enzymes capable of synthesizing DNA using RNA as a template. Although they are present in the three domains of life and viruses; prokaryotic RTs have been traditionally less explored in comparison with their eukaryotic counterparts. Prokaryotic RTs can be divided into 6 main groups: (1) Group II introns, (2) CRISPR-associated RTs, (3) Diversity Generating Retroelements, (4) Retrons, (5) Abi (Abortive infection) RTs and (6) Unknown Groups of RTs (UG). In the last five years, a burst of research has increased the knowledge about prokaryotic RTs that led to the discovery of novel putative systems with potential antiphage properties, including retrons. In this Example, a systematic search of public databases was performed with the aim of increasing the number and diversity of known retrons for possible use in genome editing applications. As a result, new types of retrons have been identified, and the increase in data has allowed the identification of new associated ncRNAs.

As a first step in this work, a set of known retron RTs was manually curated, trimmed, and aligned to create suitable input, which was then used to train an HMM model for identifying new retron RTs. Next, this model was applied to existing databases of protein sequences (e.g., nr database from NCBI) to identify potential candidate retron RTs. As a next step, the identified candidates were then grouped by sequence identity and individual representative sequences from each group were chosen. These RT domains of these representative candidates were then aligned, and a phylogenetic tree was built (data not shown). Using information about other known classes of RTs, the full phylogeny was separated into bonafide retron RT candidates and RTs that could belong to other classes (such as group II introns, DGRs, CRISPR-Cas RTs, etc). A new alignment and phylogenetic tree were then constructed from these verified candidates, as shown in FIG. 28. For all sequences in the new alignment, a matrix of the protein neighborhood was built, indicating which proteins were present in the vicinity of the candidate retron RTs. From there, types and subtypes of retrons were defined based on the RT phylogeny and identity of associated effector proteins.

To predict ncRNAs proximal to the candidate retron RTs, genomic regions proximal to the candidate retron RTs were extracted, aligned, and analyzed for structural covariance using an iterative convergence model.

ncRNA Classification Methodology:

To identify what type of ncRNA a sequence may belong to, sequences can be checked against the covariance model of existing ncRNA types. The Infernal suite (http://eddy-lab.org/infernal/) provides tools to do this. Briefly, covariance models can be built from structural alignment of known ncRNAs for each type, then collated into a CM database. From there, new sequences can be searched against the databases to verify whether the sequence fits with any of the represented families.

Example 4: Retron-Mediated Precise Genome Editing: Unique Ability to Produce Donor DNA Template Known as msDNA (Multicopy Single-Stranded DNA) Inside Cells Beyond Current Limit of Insertion Size Using an all-RNA System and in the Presence of Guide RNA Provided in Trans Current genome editing methods can efficiently disrupt target genes by inserting and deleting genetic information using programmable nucleases. However, gene disruption that does not discriminate mutant from wild type allele impairs not only mutant allele in pathogenesis but also wild type allele in normal physiology of the organism. In Transthyretin (TTR) induced amyloidosis, for example, mutated TTR alleles cause the disease but non-pathogenic wild type allele plays a role in neuro protection and injury response (1). As a single nucleotide exchange is a dominant variant in TTR (2), the vast majority of pathogenic alleles in human differ from their nonpathogenic counterparts by small modifications that require much more precise editing technologies to correct. Homology-directed repair (HDR) stimulated by nuclease-mediated DNA breaks has been widely used to install precise editing. However, HDR relies on the delivery of exogenous donor DNA, that can trigger strong immune response and has been shown inefficient to deliver universally high abundance in recipients (3). Current therapeutical ex-vivo and in vivo delivery of donor DNA relies on AAV (adeno-associated virus) transduction. However, AAV manufacturing is complicated and expensive. Additionally, AAV has raised safety concerns in 30% of 255 complete or ongoing clinical trials surveyed by meta-analysis (4). RNA delivery in contrast, successfully demonstrated its safety, easier manufacturing and efficacy in two SARS-Covid2 vaccines. Based on this amenability of RNA as a cargo, we searched the system, where donor DNA for precise editing could be generated from delivered RNA within cells.

Retrons are defined by their unique ability to produce an unusual satellite DNA known as msDNA (multicopy single-stranded DNA) from RNA inside the cell (5). These bacterial elements are involved in phage defense (6) and consist of a non-coding RNA and a reverse transcriptase (RT) that can reverse transcribe non-coding RNA (ncRNA) into msDNA. Their tightly defined sites of reverse transcription enable to insert donor DNA sequences in non-coding RNA substrate. Moreover, their compact size is amenable to deliver along with programmable nuclease in all RNA format. These features place retron an attractive tool for precise genome editing in therapeutic application.

Independent approach to generate new DNA sequences by reverse transcription in the cell is prime editing and its virus originating RT can achieve up to 44 bp insertion (7). Retron in natural sequence can produce up to 163 nucleotide single strand DNA (8), suggesting that longer insertion in retron mediated editing is feasible. In line with this, newly characterized retron Aco1 could insert 56 bp with 6 bp deletion in EMX1 locus of HEK293T cells in *S. pyogenes* Cas9 nuclease system.

Evidence of Retron from Different Clades in Precise Editing

As a first step, over 7,000 retron/retron-like RTs in bacterial genomes were identified and analyzed. Phylogenetic analysis of the over 7,000 retrons produced the phylogenetic tree of FIG. 28 Non-coding RNA gene was searched in the genomic neighborhood of the retron/retron-like RT sequences for conserved RNA secondary structures resembling characterized msr-msd transcripts: self-hybridizing inverted repeat at the ends, hairpin structures in msr and msd, such as those represented by FIGS. 2-27. Using covariance models and consensus structure detection, ncRNAs were identified with a high degree of confidence in certain RTs. To evaluate gene editing applicability of retron across diverse phylogeny, Eco1, Eco3, Eco5, Aco1, RTX3-2042, 6083 v1 and 6943 were selected for further analysis (FIG. 30). Eco1, Eco3 and Eco5 were previously experimentally validated retrons to show msDNA production (9). Aco1 was recently annotated in the literature but has not been experimentally validated as producing msDNA (10). RTX3-2042, 6083 vi and 6943 are novel retrons.

A gene editing assay was first performed in plasmid DNA format. Retron elements are assembled in a plasmid, where RT is transcribed under CAG promoter and ncRNA fused with single guide RNA (sgRNA) of Cas9 nuclease under U6 or H1 RNA polymerase III promoter (see FIGS. 31A and 31B). As described in FIGS. 32 and 33, the plasmid was transfected to Cas9 expressing human embryonic kidney 293T (HEK293T) cells via lipofection. Three days after transfection, EMX1 target genomic locus was amplified by PCR and sequences were analyzed by next generation sequencing (NGS). The precise edit assayed is characterized as a 10 bp insertion and a 6 bp substitution and its percentage is calculated by CRISPResso 2 analysis among other editing outcomes. A representative editing outcome is shown in FIG. 35 (SEQ ID NO: 19217-19224). Eco1 (FIG. 36), Aco1 (FIG. 37), RTX3-2042 (FIG. 38), RTX3-6083 vi and 6943 (FIG. 39A) showed precise editing efficiency of 0.3%, 0.1%, 0.25%, 0.06% and 0.05% (left graph in FIGS. 36, 37, 38, and 39, respectively). Undesired editing outcome defined as indels that incorporated random nucleotides or deleted sequences near Cas9 cutting site amounted to 50%, 3%, 5%, 2% and 4% (right graph in FIGS. 36, 37, 38, and 39A, respectively). Follow up experiments using the same assay indicated that RTX3_6083v1 and RTX3_6943 generated 3-4 fold more precise edits than Eco1 while indels generated from these two retrons were 2-3 fold lower (FIGS. 39B and 39C). RTX3_2042 showed precise editing at similar frequencies to Eco1 but had more variability than other samples (FIGS. 39B and 39C). These data demonstrated that recently reported (Aco1) and three novel retrons (RTX3-2042, RTX6083 v1, RTX3-6943) enable precise gene editing in human cells, in addition to previously characterized Eco1 (11).

Evidence of Retron-Mediated Gene Editing in all-RNA System

To establish RNA-based editing system, gene editing assay with two RNA components (RT mRNA and ncRNA fused to sgRNA of Cas9 nuclease) was performed first, in HEK293T cells constitutively expressing Cas9 nuclease. With RT and ncRNA being separated in RNA format, the condition for higher precise editing and lower indels could be easier identified than when they are together in the same plasmid by optimizing the ratio between RT enzyme and its substrate. RT mRNA and ncRNA fused to sgRNA of Cas9 nuclease were produced by in vitro transcription. Following experimental scheme in FIG. 40. Eco1, Eco3 and Eco5 mediated gene editing activities were compared at two different ratios of RT mRNA and ncRNA-sgRNA fusion in Cas9 expressing HEK293T cells. More amount of ncRNA than RT mRNA was transfected to maximize msDNA production for precise gene editing. Results showed precise edits up to 0.4% for Eco3 and as low as 10% indels for Eco3 (FIG. 41). Precise editing frequency in RNA based assay is comparable to that in plasmid-based assay.

Given that Eco3 produced highest editing, RNA load and RT mRNA:ncRNA-sgRNA fusion ratio was further optimized in Eco3 retron system. To 0.2 or 0.5 µg of RT mRNA, ncRNA-sgRNA fusion was added at ratios of RT mRNA to ncRNA, 1:2, 1:3, 1:4, 1:5, 1:8, 1:10, respectively. 0.5 µg of RT mRNA gave rise to more precise editing than 0.2 ug at any ratio and increasing ncRNA correlated with higher precise editing (FIG. 42, left). Indels was as low as 6% (FIG. 42, right). With two RNA components, precise editing was achieved up to 1% of cell population.

Next, Cas9 mRNA was added to RT mRNA and ncRNA-sgRNA fusion, making all RNA editing system in HEK293T cells (FIG. 43). At the optimized RNA load and ratio of RT mRNA and ncRNA-sgRNA fusion, the amount of Cas9 mRNA was titrated with Eco3 retron (FIG. 44). Precise editing was observed up to 0.1% of cell population with 0.2 µg of Cas9 mRNA and adding more it did not increase editing efficiency. While the precise editing frequency is an order of magnitude lower than two RNA system, the editing occurred by specific action of Cas9 nuclease and retron, since the absence of either abrogated the precise editing.

The delivery of all RNA system to cells was also made via lipofection using MessengerMAX reagent (FIG. 45). This approach is more resembling in vivo delivery of therapeutic RNAs loaded in lipid nanoparticle (LNP), in terms of formation of RNA/lipid complexes and cell uptake mechanism. When applied to Aco1 retron system that consists of Aco1 RT mRNA, Aco1 ncRNA-sgRNA fusion, and Cas9 mRNA, precise editing of 56 bp insertion with 6 bp deletion was observed in 0.1% of cell population and the frequency of indels was about 1.5% (FIG. 46). Aco1 retron was recently annotated but has not been experimentally validated yet (10). The precise gene editing mediated by Aco1 strongly suggest that Aco1 retron could produce msDNA inside cells. Moreover, the length of insertion in precise editing exceeds those made by other reverse transcriptase mediated editing (7).

Elevated Retron-Mediated Gene Editing in all-RNA System with sgRNA Spike-In

In all experiments above, retron ncRNA fused with sgRNA of Cas9 nuclease was used. This fusion RNA serves as a template of RT and at same time sgRNA portion could complex with Cas9 nuclease. Two enzymes acting on a single RNA piece could create steric effects that affect the activity of either enzyme. In line with this hypothesis, frequency of indels that tells overall Cas9 nuclease activity is only about 1.5% with 400 ng of ncRNA-sgRNA fusion (FIG. 46, right).

To test systematically the hypothesis, Cas9 nuclease activity by frequency of indels was compared between equimolar amounts of ncRNA-sgRNA fusion and separated sgRNA. When electroporated with 200 ng of Cas9 mRNA, 1 µg (7.5 pmol) of ncRNA-sgRNA fusion shows 20-fold lower activity than 0.266 µg (7.5 pmol) of separated sgRNA alone (FIG. 47). The result suggests that ncRNA-sgRNA fusion might inhibit either formation of complex with Cas9 protein or the activity of Cas9-sgRNA complex or both. In addition, chemically modified sgRNA shows 6-fold higher activity than unmodified sgRNA. These results indicate that affected Cas9 cleavage activity by ncRNA-sgRNA fusion could limit precise editing and addition of separated sgRNA could compensate for it. Modification of separated sgRNA is expected to further enhance precise editing.

FIG. 48 summarizes the assay of sgRNA spike-in in all RNA system and Fig. R. shows the results using Eco3 retron. At 0.2 µg of Cas9 mRNA and 0.5 µg of RT mRNA, the amount of sgRNA spike-in is titrated at 50, 100, and 200 ng (Fig. R, left). The titration was performed at two different ratios of RT mRNA:ncRNA-sgRNA fusion=1:6 or 1:8. With addition of 50 ng of sgRNA spike-in to 1:6 ratio, the precise editing was achieved 40-fold and gradually increased with more sgRNA, reaching up to 50-fold increase at 200 ng. 1:8 ratio of RT mRNA:ncRNA-sgRNA fusion responded similarly to sgRNA spike-in and obtained slightly higher activity than 1:6, up to 13% of precise editing. Higher precise editing with sgRNA spike-in came along with higher indels on the right graph.

The effect of sgRNA spike-in in precise editing was confirmed using orthogonal delivery method, lipofection (FIG. 50). Although overall amount of RNA to transfect was five times lower than in electroporation, 3.4% of precise editing was obtained without sgRNA spike-in, which is 7.5-fold higher than that achieved by electroporation (FIG. 49 and FIG. 51, left graph). With addition of sgRNA as low as 2 ng, precise editing further increased up to 3.5-fold, reaching 12% efficiency (FIG. 51, left). Increasing the amount of sgRNA up to 10 ng did not further change the efficiency. The precise editing observed is dependent on retron since the absence of retron components (RT mRNA and ncRNA-sgRNA fusion) completely abrogated the editing.

These data support that physical fusion of ncRNA and sgRNA of Cas9 nuclease could be a limiting factor for Cas9 activity and consequently precise editing and either spike-in of sgRNA demonstrated here or separation of ncRNA and sgRNA would be an improved strategy for efficient precise editing.

Separation of ncRNA and sgRNA

The impact of separating sgRNA from ncRNA on editing was tested in Eco3 retron system comparing the editing efficiency between ncRNA-sgRNA fusion and separated ncRNA and sgRNA side by side (FIG. 52). Increasing amount of sgRNA was added to 300 ng of ncRNA that is equimolar amount of 400 ng of ncRNA-sgRNA fusion. With no sgRNA added, no precise editing was observed as expected. With 10 ng of sgRNA, precise editing peaked at 2.23% compared to 1.78% obtained with ncRNA-sgRNA fusion (FIG. 52, left). The increasing amount of sgRNA beyond 10 ng did not further improve precise editing. Frequency of indels (FIG. 52, right) showed a similar trend as precise editing.

These data demonstrates that separation of ncRNA and sgRNA could achieve comparable or even higher precise editing than ncRNA-sgRNA fusion.

Materials and Methods:

Mammalian cell culture HEK293T (ATCC CRF-3216) or 293T-Cas9 (Genecopoeia SL502) cells were cultured in Dulbecco's modified Eagle's medium (DMEM) plus GlutaMAX (Thermo Fisher Scientific), supplemented with 10% (v/v) fetal bovine serum (Gibco). Cells were maintained at 37° C. with 5% CO2.

Genomic DNA extraction After incubation, the media was removed from the cells and genomic DNA was extracted by the addition of prepGEM reagent (Thomas Scientific: PUN0050) directly into each well of the tissue culture plate. Lysed cells were transferred to a 96 well PCR plate and incubated at 72° C. for 10 minutes, followed by 95° C. enzyme inactivation step for 2 minutes.

High-throughput DNA sequencing of genomic DNA samples Human EMX1 gene locus was amplified from genomic DNA samples and sequenced on an Illumina NextSeq. Briefly, amplification primers containing Illumina forward and reverse adapters were used for a first round of PCR (PCR1) amplifying EMX1 targeting site. 25 µl PCR1 reactions were performed with 0.3 µM of each forward and reverse primer, 1 µl of genomic DNA extract and 12.5 µl of KAPA HIFI HOTSTART PCR master mix. PCR reactions were carried out as follows: 95° C. for 1 minute, then 25 cycles of [98° C. for 20 seconds, 65° C. for 15 seconds, and 72° C. for 15 seconds], followed by a final 72° C. extension for 2 minutes. PCR reactions were purified using Ampure XP beads (Beckman Coulter) and eluted in 20 µl H20. Unique Illumina barcoding primer pairs were added to each sample in a secondary PCR reaction (PCR2). Specifically, 25 µl PCR2 reactions were performed with 5 µl of IDT for Illumina UDI primers (Illumina), 1 µl of purified PCR1 reaction, and 12.5 µl of KAPA HIFI HOTSTART PCR master mix. PCR reactions were carried out as follows: 95° C. for 3 minutes, then 10 cycles of [95° C. for 30 seconds, 55° C. for 30 seconds, and 72° C. for 30 seconds], followed by a final 72° C. extension for 5 minutes. PCR2 reactions were purified by SequalPrep Normalization plate kit (Thermo Fisher Scientific) and pooled. Size and purity were evaluated by Tape station D1000 assay (Agilent). DNA concentration was measured by fluorometric quantification (Qubit, ThermoFisher Scientific) and libraries were sequenced with 30% PhiX sequencing control on an Illumina NextSeq 2000 instrument using P1 or P2 300 cycle kit. Sequencing reads were demultiplexed and alignment of amplicon sequences to a reference sequence was performed using CRISPresso2. CRISPresso2 was run in HDR mode using the desired allele as the expected allele and precise editing yield was calculated as the number of HDR aligned reads divided by total aligned reads.

Plasmid based gene editing Plasmids encoding retrons were synthesized by Twist Bioscience. For transfections, 25,000 293T-Cas9 cells (Genecopoeia: SL502) were transfected using Lipofectamine 3000 (Thermofisher: L3000001) according to the manufacturer's protocol. Transfected cells were incubated at 37° C. for 72 hrs before lysis in prepGEM reagent (Thomas Scientific: PUN0050) according to the manufacturer's protocol. A 1 uL aliquot of crude lysate was used as template for amplification of the EMX1 CRISPR target site by PCR. Illumina adaptors and UDIs were added in a second round of PCR before loading onto an Illumina NextSeq. The resulting FASTQ files were used as input for CRISPResso2 which quantified precise editing and indels at the EMX1 locus.

In vitro transcription Plasmid templates were synthesized by Twist Bioscience. T7 promoter was inserted upstream of RT or ncRNA sequences. Plasmid was linearized by Sbf1-HF enzyme (NEB, R3642S) for 16 hour at 37° C. and the linearization was checked by agarose gel electrophoresis. RT mRNA was synthesized for 16 hour at 37° C. using HiScribe T7 mRNA kit with CleanCap Reagent AG (NEB, E2080S) and ncRNA using HiScribe T7 High Yield RNA synthesis kit (NEB, 2040S). After DNAseI treatment, RNA was purified using Qiagen RNeasy midi kit (Qiagen, 75144). RNA concentration was measured by Nanodrop (Thermo Fisher) and purity and size were evaluated by RNA Screen-Tape analysis on Tape station (Agilent). RT mRNA was further poly (A) tailed by E. Coli Poly(A) polymerase (NEB, M0276) and purified by Qiagen RNeasy midi kit.

RNA Transfection by Neon Electroporation system HEK293T (ATCC CRF-3216) or 293T-Cas9 (Genecopoeia SL502) cells were harvested and resuspended in R buffer. 50,000 cells with 1 µl of RNA mixture were electroporated by 10 µl Neon tip at 1150 voltage, 20 pulses. Electroporated cells were gently transferred to 96 well plate (VWR) containing culture media and cultured for 72 hours before genomic DNA extraction.

RNA Transfection by Lipofectamine MessengerMAX 20,000 HEK293T (ATCC CRF-3216) cells were seeded in 96 well plates. 16-24 hours post-seeding, cells were transfected with 0.3 µl of Lipofectamine MessengerMax (Thermo Fisher Scientific) with appropriate amount of RNA mixture. Cells were cultured for 72 hours before genomic DNA extraction.

Sequences Utilized in Example 4
EMX1 s.p Cas9 gRNA
(SEQ ID NO: 19159)
GAGTCCGAGCAGAAGAAGAA Eco1 ncRNA + HDR_Template
(SEQ ID NO: 19160)
TGATAAGATTCCGTATGCGCACCCTTAGCGAGAGG

TTTATCATTAAGGTCAACCTCTGGATGTTGTTTCG

GCATCCTGCATTGAATCTGAGTTACTGTCTGTTTT

CCTACAAACGGCAGAAGCTGGAGGAGGAAGGGCCT

GAGTCCGAGCAGAAGAAAAGTTCTCCCATCACAT

CAACCGGTGGCGCATTGCCACGAAGCAGGCCAATG

GGGAGGACATCGATGTCAAGGAAACCCGTTCTTC

TGACGTAAGGGTGCGCATACGGAATCTTATCA

Aco1 ncRNA + HDR Template
(SEQ ID NO: 19161)
CCGTAGTGGGAGCCTCAGGCGAGGGTGTGTATCAT

GCCCGTTCTGCCAAGACCCACCAAAGAAGGGCACC

GTGGAGGACAAACGGCAGAAGCTGGAGGAGGAAGG

GCCTGAGTCCGAGCAGAAGAAACAGAAGTGCAAAG

TTCTCCCATCACATCAACCGGTGGCGCATTGCCAC

GAAGCAGGCCAATGGGGAGGACATCGATGTCACCT

CCACGGTGCAATGCGAAAGCAACTTGAGGCTT

TGCTTAGTATGAGGCTCCCACTACGG

RTX3_2042 RT
(SEQ ID NO: 19162)
MKDDQYSQWKKYYESRGILPEIQDKLLNYAKIHID

NNTPVIFNFEHLTLLLGREKNYLSSVVNSPDSHYR

KFKIKKRSGGEREITAPYLSLLEMQYWIYRNILIN

VKIHYAAHGFAQDKSIITNSRNHLGQKHLLKMDLK

DFFPSIKLNRIIYIFKSLGYPNIIAFYLASICSYK

GHLPQGSPTSPILSNIVSITLDNRLVKFARKMKLR

YSRYADDLTFSGDKIPTNYIKYITDIINDEGFEVN

DTKTKLYLKAGKRIVTGISVIGNDPKLPREYKRKL

KQELHYIFTYGIGSHMAKKKIKKINYLYRIIGKVN

FWLNIEPDNEYARNAKAKLLLLIDN*

RTX3_2042 ncRNA + HDR_Template
(SEQ ID NO: 19163)
GTTAAGGTGGTTATATTCTAGTATTTATGAAGTGT

AGTCGCTTCGATCGTTAAGGCTGATTTTAACCTCT

GCATAATAATATCGGTAGATATTATTATGCACGCT

CCCTTTAGCAGAGCTAAGAATCGCTCACTCAGGCA

CAAGCTTTGAGGACAAACGGCAGAAGCTGGAGGAG

GAAGGGCCTGAGTCCGAGCAGAAGAATCCTAAGAG

AAAAGTTCTCCCATCACATCAACCGGTGGCGCATT

GCCACGAAGCAGGCCAATGGGGAGGACATCGATGT

CACCTCAAAGCTTGTGCCTGAGTGAGAGCTAAAGAAA

AGAAAAGTAGAATAAGCCACCTTAAC

RTX3_6083v1 RT
(SEQ ID NO: 19164)
MSNPQPTRAEIFERIKQSSKQEVILEEMQRLGFWP

RSEGQPEVAADLIQREGELQRELAELNKKLAVKRN

PERALREMRKQRMKDARDKREVTKRAQAQQRYDKA

LLWHEKRASHVAYLGPGVSASLHENSSATQEQGDK

GKPKRARDRAVPDLQRLTLNGLPALISAAQLAESM

GVSVAELRFLSFHREVARTNHYHSFTLPKKTGGER

LISAPMPRLKRAQYWVLDNVLAKMPAHDAAHGFLA

GRSIISNAKPHAGQDVVINLDVKDFFPSIAFGRIK

GVFRQLGYGESIATVFALLCSENRAQAWQVDGERL

FVGGKARERVLPQGAPTSPMLTNLLCRRMDRRLLG

LAKQLGFVYTRYADDLTFSASGEPARDNVGKLLSR

VRWILRDEGFTPHPDKERVMRKGRRQEVTGLVVNS

DTPSVSRETRRRLRAALHRASQPDAASKPAHWQGH

TAQPSQLLGLATFVHQIDPKQGKTLLADAQQLMRS

PIDRANDAAKSASRADAAQQSFRVLAAAGKPPVLA

DGKNWWQPAPPATPVLEKTDQQRREERQATRRQQA

AAAAPPPSSTRRNERPQQAAHEQQGDAQPQNEAPP

RFDPDQYAPPPRNVMTYWAQIAISFFLGSILHNRL

ITIFAMVAVIALYYMRRQRWDVFMGILVVATLLGY

LVRGMG*

RTX3_6083v1 ncRNA + HDR Template
(SEQ ID NO: 19165)
GCTCCGGAGCAATGAGCAGGCTCTTGCAATCCGGG

CGGTGTTTCGCCGCCCTTGTGAACTGCCGTTTCAT

GCACCACGGGCGCCGTTTTCACTGTGCCACCCCAG

CCACGGTAGTGCTACAAACGGCAGAAGCTGGAGGA

GGAAGGGCCTGAGTCCGAGCAGAAGAACTACAAGG

TTAAAGTTCTCCCATCACATCAACCGGTGGCGCAT

TGCCACGAAGCAGGCCAATGGGGAGGACATCGATG

TCAAGCACTACCGTGGCGGGGTGGCGTCGAGCGAA

CAGCTCCCGTCCCGTGAGCCCTACAGGCTCTTCGA

CGAGATGCACATTGCTCCGGAGC

RTX3_6943 RT
(SEQ ID NO: 19166)
MEESTNYKLLVWGLSVIQPATPNEVLNYLTSTLND

NGLLPDVEKMIHYFELLDQLGYIHQVSKRNNLYSL

TPRGNERLTPALKRLRDKIRLFMLDNCHSISKLGV

LASTDTENMGGDSPSLQLRHNLKEVPHPSLSWAAG

TLPSSPRQAWVRIYEQLNIGSMSSDEASTPTTARN

APLSFVGRLGFSLNYYSFNKIDEPLFNNDGVTAIA

```
SCIGISPGLITAMVKSPKRYYRTFNLRKKSGGFRS
ILAPRKFIKTIQYWLKDHVLNRLKIHSSCYSYRSG
VSIKDNAINHVKKKFVASIDISDYFGSINKKMVKD
CFYKNNIPDHIVNTISGIVTYNDVLPQGAPTSPII
SNAILFEFDEEMTAHALTLDCIYTRYSDDISISSD
YKENIAILINIAEANLLSAGFTLNRQKQRIASDNS
RQVVTGILVNESIRPTRCYRKKIRSAFDHALKEQD
GSQLTINKLRGYLNYLKSFETYGFKFNEKKYKETL
DFLIALKQS*
```

RTX3_6943 ncRNA + HDR Template
(SEQ ID NO: 19167)
```
GCGGAGTGCTGGCCTCAACTGATACAGAGAATATG
GGCGGTGATTCGCCGTCTTTACAGTTAAGGCACAA
TTTAAAAGAGGTTCCGCACCCAAGCCTGTCTTGGG
CTGCACAAACGGCAGAAGCTGGAGGAGGAAGGGCC
TGAGTCCGAGCAGAAGAACGTATGGCCTAAAGTTC
TCCCATCACATCAACCGGTGGCGCATTGCCACGAAG
CAGGCCAATGGGAGGACATCGATGTCAGCAGCCCA
AGACAGGCTTGGGTGCGGATCTACGAGCAATTAAAT
ATTGGTTCGATGTCCAGTGATGAGGCCAGCACCCGC
```

Eco1 RT
Coding sequence only. RNA was produced
from a CRO and proprietary 5' cap,
5' UTR, 3' UTR and encoded polyA of
around 120 bases were added. Full
substitution with 1N-methyl-
pseudouridine)
(SEQ ID NO: 19168)
```
AUGAAAUCUGCAGAGUAUCUGAAUACGUUCCGCCU
UAGGAAUUUGGGCCUCCCCGUGAUGAACAAUCCC
ACGAUAUGAGCAAGGCGACUCGAAUAUCCGUGGAA
ACGCUGAGACUGCUCAUCUAUACAGCAGACUUUCG
GUACAGGAUCUACACGGUCGAAAAGAAGGGGCCUG
AGAAACGCAUGCAACAAUUUAUCAACCUAGCCGA
GAGCUCAAGGCGUUGCAGGGCUGGGUUCUUCGAAA
CAUCCUUGACAAACUCUCAUCAUCACCCUUUAGUA
UUGGGUUUGAAAAGCACCAAAGCAUCCUUAACAAC
GCGACGCCACACAUAGGUGCCAAUUUCAUAUUGAA
CAUCGACUUGGAGGAUUUUUUUCCGAGCCUCACAG
CCAAUAAAGUGUUCGGUGUUUUUCACAGUCUUGGG
UACAAUCGCCUUAUUAGUUCCGUUCUUACCAAGAU
UUGUUGUUACAAGAAUCUCUUGCCCCAGGGAGCAC
CCAGCAGUCCGAAAUUGGCGAAUUUGAUUUGUUCC
AAGCUCGAUUAUCGAAUACAAGGGUACGCGGGCAG
CCGGGGACUCAUCUAUACCCGCUACGCAGACGAUC
UUACGCUGUCUGCCCAAUCAAUGAAGAAGGUCGUA
AAGGCGCGGGAUUUCUUGUUUUCUAUCAUCCCGUC
CGAGGGCUUGGUAAUUAAUUCCAAAAAGACUUGUA
UCUCAGGACCACGAUCUCAGCGAAAAGUGACAGGA
CUCGUCAUUUCUCAAGAAAAAGUCGGUAUAGGGAG
AGAGAAGUAUAAGGAAAUCCGCGCGAAGAUCCACC
ACAUAUUCUGUGGCAAGAGCAGCGAGAUAGAACAC
GUCCGAGGCUGGUUGUCCUUCAUACUGAGCGUGGA
CUCAAAAAGCCACCGCCGGUUGAUCACCUAUAUUU
CAAAACUGGAAAAGAAAUAUGGAAAGAACCCACUC
AACAAAGCUAAAACACCACCAAAGAAGAAAAGAAA
GGUCUGA
```

Eco1 ncRNA
ncRNA-sgRNA fusion (6 bp
substitution in EMX1 gene)
(SEQ ID NO: 19169)
```
GAAAUGAUAAGAUUCCGUAUGCGCACCCUUAGCGA
GAGGUUUAUCAUUAAGGUCAACCUCUGGAUGUUGU
UUCGGCAUCCUGCAUUGAAUCUGAGUUACUGUCUG
UUUUCCUACAAACGGCAGAAGCUGGAGGAGGAAGG
GCCUGAGUCCGAGCAGAAGAAAAAGUUCUCCCAUC
ACAUCAACCGGUGGCGCAUUGCCACGAAGCAGGCC
AAUGGGGAGGACAUCGAUGUCAAGGAAACCCGUUU
CUUCUGACGUAAGGGUGCGCAUACGGAAUCUUAUC
AGAGUCCGAGCAGAAGAAGAAGUUUCAGAGCUAUG
CUGGAAACAGCAUAGCAAGUUGAAAUAAGGCUAGU
CCGUUAUCAACUUGAAAAAGUGGCACCGAGUCGGU
GCUUUUUUUUUUUU
```

Eco3 RT
Coding sequence only. RNA was
produced from a CRO and
proprietary 5' cap, 5' UTR,
3' UTR and encoded polyA of
around 120 bases were added.
Full substitution with 1N-methyl-
pseudouridine
(SEQ ID NO: 19170)
```
AUGCGCAUUUACUCUCUGAUCGACAGCCAAACCUU
AAUGACCAAAGGGUUCGCAUCCGAGGUCAUGAGGA
GCCCAGAACCCCUAAGAAGUGGGACAUUGCGAAG
AAGAAGGGCGGAAUGCGUACGAUAUACCAUCCCUC
UUCUAAGGUGAAGCUGAUACAGUACUGGCUGAUGA
ACAACGUGUUCUCCAAAUUGCCGAUGCACAACGCC
GCGUACGCUUUCGUGAAGAAUAGAUCUAUCAAGUC
UAACGCACUGCUGCACGCAGAGAGUAAGAACAAAU
ACUACGUUAAGAUUGACCUGAAGGACUUCUUUCCA
AGCAUCAAGUUCACAGACUUCGAAUAUGCCUUUAC
```

```
CCGGUACCGUGACAGAAUAGAGUUCACGACCGAGU

ACGACAAAGAACUGCUUCAGCUGAUUAAGACCAUU

UGUUUCAUUUCUGACUCUACACUGCCAAUAGGCUU

CCCCACUUCCCCUCUUAUAGCCAAUUUCGUCGCCA

GGGAGCUGGACGAGAAGCUCACUCAGAAGCUGAAC

GCUAUAGACAAGCUCAACGCUACGUACACUCGCUA

CGCAGACGACAUAAUCGUGAGCACGAACAUGAAGG

GCGCCUCUAAGCUGAUCUUAGACUGCUUCAAGCGG

ACCAUGAAGGAAAUCGGACCCGAUUUCAAGAUCAA

UAUCAAGAAGUUCAAAAUAUGCUCUGCCAGUGGCG

GCUCAAUUGUCGUGACGGGCCUUAAGGUCUGUCAU

GACUUCCACAUAACUCUGCACCGGUCUAUGAAGGA

CAAGAUCCGCCUGCACCUCUCUCUCCUGUCCAAAG

GUAUUCUGAAGGACGAGGACCACAACAAGCUGUCC

GGGUACAUCGCCUACGCUAAGGACAUCGAUCCACA

CUUCUACACCAAGCUCAAUAGGAAGUACUUCCAGG

AGAUCAAGUGGAUACAAAACCUGCAUAAUAAGGUG

GAGCCACCAAAGAAGAAAAGAAAGGUCUGA

Eco3 ncRNA
ncRNA-sgRNA fusion (10 bp
insertion in EMX1 gene)
                                (SEQ ID NO: 19171)
GAAAUGAUAAGAUUCCGUAAGAGCCAAACCUAGCA

UUUUAUGGGUUAAUAGCCCAUCGGGCCAUGAGUCA

UGGUUUCGCCUAGUAUUUUAGCUAUGCCCGUCGUU

CAGUUCGCUGAACAAACGGCAGAAGCUGGAGGAGG

AAGGGCCUGAGUCCGAGCAGAAGAAUUACGUCUGC

AAAGUUCUCCCAUCACAUCAACCGGUGGCGCAUUG

CCACGAAGCAGGCCAAUGGGGAGGACAUCGAUGUC

AUCAGCGAACUGAUCGACGUGCUCAAGUAGGUUUG

GCUCUUACGGAAUCUUAUCAGAGUCCGAGCAGAAG

AAGAAGUUUCAGAGCUAUGCUGGAAACAGCAUAGC

AAGUUGAAAUAAGGCUAGUCCGUUAUCAACUUGAA

AAAGUGGCACCGAGUCGGUGCUUUUUUUUUUUU

Eco5 RT
Coding sequence only. RNA was
produced from a CRO and
proprietary 5' cap, 5' UTR,
3' UTR and encoded polyA of
around 120 bases were added.
Full substitution with 1N-methyl-
pseudouridine
                                (SEQ ID NO: 19172)
AUGGACGCUACCAGAACGACUCUCCUUGCAUUGGA

UCUCUUCGGAUCUCCAGGUUGGUCCGCCGAUAAAG

AAAUUCAGAGGCUUCAUGCGCUCAGUAAUCAUGCU

GGAAGGCAUUACAGAAGGAUUAUAUUAAGUAAAAG

GCACGGCGGACAGCGUCUUUGUGCUUGCACCUGAUU

ACUUGUUAAAGACCGUUCAGCGCAACAUUUUGAAG

AACGUUUUGAGUCAAUUUCCACUGUCACCAUUUGC

UACAGCCUACAGACCGGGAUGCCCAAUCGUGUCUA

ACGCGCAGCCACACUGCCAACAGCCACAGAUCUUG

AAACUCGAUAUAGAAAACUUCUUCGAUUCUAUUAG

UUGGUUGCAGGUGUGGCGGGUGUUUCGCCAGGCCC

AGUUGCCCCGAAAUGUCGUAACGAUGCUCACUUGG

AUAUGUUGUUAUAACGACGCACUUCCGCAGGGUGC

CCCUACAUCCCCUGCAAUUUCCAAUCUCGUCAUGA

GAAGGUUUGAUGAACGGAUUGGAGAAUGGUGUCAG

GCUCGAGGGAUUACCUACACUCGCUACUGCGAUGA

CAUGACGUUUAGUGGACACUUCAAUGCAAGGCAGG

UCAAGAAUAAAGUCUGCGGUCUCUUAGCUGAGCUG

GGCCUUUCCCUGAAUAAACGGAAAGGCUGCCUCAU

AGCGGCUUGUAAGCGCCAGCAAGUCACCGGCAUUG

UUGUGAAUCACAAGCCACAGCUUGCCCGAGAAGCC

AGGCUGUGCCCUGCGUCAGGAAGUGCACCUGUGCCA

GAAAUAUGGAGUUAUCUCUCAUCUCUCACAUAGAG

GUGAACUGGAUCCUAGCGGAGAUCUGCACGCUCAG

GCGACAGCGUAUCUCUAUGCACUCCAGGGGAGAAU

UAACUGGCUUCUUCAAAUUAACCCUGAGGAUGAGG

CGUUUCAACAGGCCCGGGAGUCCGUUAAGAGGAUG

UUAGUUGCCUGGCCACCAAAGAAGAAAAGAAAGGU

CUGA

Eco5 ncRNA
ncRNA-sgRNA fusion (10 bp
insertion in EMX1 gene)
                                (SEQ ID NO: 19173)
GAAAUGAUAAGAUUCCGUACGCCAGCAGUGGCAAU

AGCGUUUCCGGCCUUUUGUGCCGGGAGGGUCGGCG

AGUCGCUGACUUAACGCCAGUAGUAUGUCCAUAUA

CCCAAAGUCGCUUCAUUGUAACAAACGGCAGAAGC

UGGAGGAGGAAGGGCCUGAGUCCGAGCAGAAGAAU

CCUUCGAGCAAAGUUCUCCCAUCACAUCAACCGGU

GGCGCAUUGCCACGAAGCAGGCCAAUGGGGAGGAC

AUCGAUGUCAUACAGUUACGCGCCUUCGGGAUGGU

UUAAUGGUAUUGCCGCUGUUGGCGUACGGAAUCUU

AUCAGAGUCCGAGCAGAAGAAGAAGUUUCAGAGCU

AUGCUGGAAACAGCAUAGCAAGUUGAAAUAAGGCU

AGUCCGUUAUCAACUUGAAAAAGUGGCACCGAGUC

GGUGCUUUUUUUUUUUU
```

```
EMX1 sgRNA modified
Contains chemical modifications
from Synthego: 2'-F, 2'-O-methyl,
phosphorothioates
                         (SEQ ID NO: 19174)
GAGUCCGAGCAGAAGAAGAAGUUUCAGAGCUAUGC

UGGAAACAGCAUAGCAAGUUGAAAUAAGGCUAGUC

CGUUAUCAACUUGAAAAAGUGGCACCGAGUCGGUG

CUUUUU

EMX1 sgRNA unmodified
No modifications
                         (SEQ ID NO: 19175)
GAGUCCGAGCAGAAGAAGAAGUUUCAGAGCUAUGC

UGGAAACAGCAUAGCAAGUUGAAAUAAGGCUAGUC

CGUUAUCAACUUGAAAAAGUGGCACCGAGUCGGUG

CUUUUU
```

References

[1] Are we creating a new phenotype? M F, Dohrn. 2021, Neurological Research and Practice.
[2] Val50Met hereditary transthyretin amyloidosis:not just a medical problem but a psychosocial burden. J, Gonzalez-Moreno. s.l.: Orphanet Journal of Rare Diseases, 2021, Vol. 16.
[3] synthetic DNA delivery systems. D, Luo. 2000, Nature Biotechnology, pp. 33-37.
[4] rAAV immunogenicity, toxicity, and durability in 255 clinical trials:A meta-analysis. W, Shen. 2022, Frontiers in Immunology.
[5] Reverse transcriptase associated with the biosynthesis of the branched RNA-linked msDNA in *Myxococcus xanthus*. S, inouye. s.l.: Cell, 1989, Vol. 56. 709-717.
[6] Bacterial retrons function in anti-phage defense. A, Millman. s.l.: Cell, 2020, Vol. 183. 1551-1561.
[7] Search-and-replace genome editing without double-strand breaks or donor DNA. AV, anzalone. 2019, Nature, pp. 149-157.
[8] Branched RNA covalently linked to the 5' end of a single-stranded DNA in *Stigmatella aurantiaca*. T, Furuichi. 1, s.l.: Cell, 1987, Vol. 48. 47-53.
[9] Retrons and their applications in genome engineering. A J, Simon. 21, s.l.: Nucleic Acids Research, 2019, Vol. 47.
[10] Systematic prediction of genes functionally associated with bacterial retrons and classification of the encoded tripartite system. MR, Mestre. 22, s.l.: Nucleic Acids Research, 2020, Vol. 48.
[11] Precise genome editing across kingdoms of life using retron-derived DNA. SC, lopez. 2, s.l.: Nature Chemical Biology, 2021, Vol. 18.

Example 5: Improved ncRNAs Generated by Transcription from Template Linearized Plasmid Having Blunt Ends Show Higher Precise Editing Efficiency Previously made in vitro transcription experiments to produce ncRNA used a double-stranded DNA template containing a 3' overhang (on same strand as T7 promoter sequence). A new template with a blunt end was designed and tested. See FIG. 52. As shown in FIG. 53, four RNAs (cas9 mRNA, Eco3 RT mRNA, gRNA targeting EMX1 locus and ncRNA) were transfected into 293T cells using MessengerMAX lipofection reagent. Cells were harvested after 3 days, genomic DNA isolated, the EMX1 locus amplified, the Illumina libraries produced and sequenced on NextSeq. The percent of precise edits improves more than 5-fold for ncRNA produced using blunt end template as compared to the precise editing by ncRNA produced using overhang template.

Example 6: Improved ncRNAs with MS2 Hairpin

Additional elements can be added to the ncRNA by encoding them on the plasmid template. FIG. 53 shows a modified Eco3 ncRNA that comprises an MS2 stem loop hairpin structure added to its 3' end. As shown in FIG. 54, the precise editing of ncRNA comprising the 3' MS2 structure resulted in nearly 15-fold increase in precise editing compared to an ncRNA generated from a overhang template, and nearly 3-fold increase in precise editing compared to an ncRNA generated from a blunt end template.

Example 7: Modified ncRNAs with Caps and/or Tails ncRNA performance can be modified by adding a cap structure to the 5' end and/or adding a poly(A) tail at the 3' end, as depicted in FIG. 55. As shown in FIG. 56, using ncRNA with either or both protection by cap and tail lowered indels as compared uncapped/untailed ncRNAs. In this experiment, a 4 component all-RNA system (RT mRNA+Cas9 mRNA+ncRNA-sgRNA+sgRNA) was delivered to HEK293T cells by Lipofectamine MessengerMAX. All RNA was transfected at a fixed amount RT mRNA 100 ng, ncRNA-sgRNA 400 ng, Cas9 mRNA 100 ng, and sgRNA 5 ng. ncRNA-gRNA fusion was either capped (+cap −tail) or poly-A tailed (−cap +tail) or both capped and poly-A tailed (+cap +tail). Using RNA without end protection (−cap −tail) produced ~4.5% precise edits and the editing was dependent on retron since the absence of RT abrogated precise editing. Using RNA with either or both protection by cap and tail produced lower precise editing (left graph) but lowered indels (right graph) than without cap and tail.

SEQUENCE LISTING (19224 sequences)

SEQ ID NO: 1 - protein, 486 aa, unidentified
  source 1..486: note = Related to NC_015164.1; note = Phocaeicola salanitronis
MDKTEIVQIASQMSTREDLLALLNRIKQDEIRESGFDADKFYPFTMKQLLYYCNPNHAFHRYRQFKIKKKSGGFRLITTPRNRSFMMLLRSVNEILKAIYTPSDYAMGFTEKRSVVTNAAVHRNQNYVFNIDLKDFFPSVEQGRVMKRLTLEPFNFSPQIALLISGLCSMRVKREQPLETKRYDLDKQFMYVLPQGAPTSPVITNTICDTLDRRLAGLAKRFGLRYTRYADDITFSSMHYVYSKNSEFIKELIRIINTQGFMINEAKTRLQKLGSRQEVTGIIVSDKLNVTKKYVREIRSLLYIWDKYGYSAAMSRFFPKYKAEKGHIKKGNPELTNVLDGKLLYLKMVKGDTDSVYIKLYTKFQELVNRDSGPDKTNSYGISYIESFPILEFEKDKNTNITIFHKDGNKRYATFRMGETHQVASINKDVTPDDEQQKEKLAISCCKNFRGEQFWLIHLLDKVTVFKPKPVDIDELNNDLDLLLGI

SEQ ID NO: 2 - protein, 486 aa, unidentified
  source 1..486: note = Related to JAFSKF010000035.1; note = Bacteroidales bacterium
MDKTQIAQIASQMSTREDLLALLNRIKQDEIRDLGFDTDKFYPFTMKQLLYYCNPNHAFHRYRQFKIKKKSGGYRQITAPRNQSFMILLQSVNEILKSIYTPSEYAMGFTENRSVVTNAAVHRAQNYVFNIDLKDFFPSVEQGRVMKRLTLAPFNFSPQIALAVSGLCSMRVKREQPLETKQHDLDKQFMYVLPQGAPTSPIITNMICDTLDRRLAGLAKRFGLCYTRYADDITFSSMHYVYSEKGEFRNELARIISTQGFVINEAKTRLQKLGSRQEVTGVIVSEKLNVTKKYVREIRSLLYIWDKYGYSAAMSKFYPKYKAEKGHVKKGNPDLTNVLDGKLMYLKMVKGDDDSVYVRLYTKFQELVNRDTGSDKTNSYGITYVETMPLMKFEKDKNTNIIISQKDVNKRYATFELGKVHQIASINKAVTPEDEQHKEKLAISYCRNPKGELFWLIHLLDKATTFKGKPVDVDELNNDLDALLST

SEQ ID NO: 3 - protein, 486 aa, unidentified
  source 1..486: note = Related to JAFZXH010000011.1; note = Bacteroidaceae bacterium
MDKTQIAQIASQMSTREDLLALLNRIKQDEIRELGLDADKFYPFTMKQLLYYCNPNHAFHRYRQFKIKKKTGGYRQIDAPRNKSYMMLLKTVNEVLKSIYIPSTYAMGFTEKRSVVTNATVHKGQNYVFNIDLKDFFPSVEQGRVMKRLTLSPFLFSPEIALLISGLCSMRVKREILVEDKKHDLDKQFLYVLPQGAPTSPIITNMICDTLDRRLAGLAKRFGLHYTRYADDITFSSMHHVYSKEGEFRKELERIIESQGFTMNDKKTRLQKLGSRQEVTGIIVSDKLNVTRKYVREIRSLLYIWEKYGYTTAMSRFYPKYIAEKGHVKKVNPDMTNVLDGKLMYLKMVKGDSDSVYINLYTKFQELVARDSGSEKTNSYGLTYIESVPLLKFEKDKKTNVTISKKDGNKRYATFKLGEVHQIATINKAVTPDDELHKEKLVISYCRNPKGETFWLIHLLDKVTTFKPYPVNIDELNNDLDSLLST

SEQ ID NO: 4 - protein, 486 aa, unidentified
  source 1..486: note = Related to NZ_KQ957209.1; note = Prevotella corporis
MDKTQITQIASQMSTREDLLALLNRIKQDEIRELGYDTDKFYPFTMKHLLYYCNPNHVFHRYHQFKIKKKSGGFRQITAPRNQSFMMLLQTVNEILKAMYSPSDYAMGFTEERSVVTNASVHKGQNYVFNIDLKDFFPSVEQRRVLKRFGAKPFNFNPEIALLLSGLCSMRVKREQADETQTHDLDKEFVYVLPQGAPTSPIITNMICDTLDRRLAGLARRFGLRYSRYADDITFSSMHYVYAEKGEFRKELARIIGSQGFTINDTKTRLQKRGSRQEVTGIIVSDKLNVTKKYVREIRSLLYIWEKYGYSATMAKFLPKYKAEKGHVKKGNPDLTNVLDGKLMYLKMVKGESDIVYARLFEKFQQLVARDSGGDKKNPYGITYMETVPLLKFEQDKNTEVAIFHKEEGKRYATFEFNGVKQVVSINKDVSQNDEMQKEKLAISNCRNPKGEQFWLIHLVNKVTVYNLKPVDIDELNNDLDSLLST

SEQ ID NO: 5 - protein, 481 aa, unidentified
  source 1..481: note = Bacteroidales bacterium; note = Related to JAFWZP010000094.1
MDKAQIVQIASQMSTREDLLALLNSIKQDEISKSCSDGDKFYPFTMKHLLYYCNPNHVFHRYRKFRIKKKSGGFRQITSPRNRSFMMLLQSVNEILKAMYTPSDYAMGFTEKRSVVTNARIHQGQNYVFNIDLKDFFPSVEQPRIWKRLQLAPFNFPISIANVLAGLCSMREVRKDIDGKDVFVYVLPQGAPTSPIITNMICDTLDRRLVGLAKRFGLHYSRYADDITFSSMHYVYAKNGEFRKELIRIIKSQGFTINEEKTRLQKQGSRQEVTGIVVSESKLNVPKKYVREIRSLLYIWEKYGYSVAMSRFLPKYKLEKGHVKKGNPDLINVLEGKLMYLKMVKGDMDPVYVRLYSKFQELVAKDFSLNKTNSYGITYIETIPLLKFEEDNNTNVIIHLKDCNKRYAVFKLGGINQFASINKNVPSDYEQQKEKLGISNCRNSKGKQFWLIHLVDKVIVQNSNMVDIDELNNDLNLLLDI

SEQ ID NO: 6 - protein, 482 aa, unidentified
  source 1..482: note = Bacteroidales bacterium; note = Related to JAFSTV010000046.1
MDKNQIAQVANQIQEREDLLSLLNKIRKDIVGDNGSESKFFPFTMKHLLYYCNPNHTFHRYTQFKIKKKSGGFRLITSPRNSSYMFLLQSLNELLKSMYTPAQSAMGFTEGRSVVTNANVHKGQNYVFNLDLKDFFPSIEQPRIWKRLQLAPFNFPSSIANVIAGLCSMKETRTDTTGNDVVTYVLPQGAPTSPIITNMICDTLDRRLLGLSKRFGLRYTRYADDITFSSMHYVYAKDGVFRKELTRIIESQGFTINEAKTRLQKLGSRQEVTGIIVSDKLNVSKKYIRNIRNLLYIWERYGYSVAMSRFLPKYRADKGHVKKGTPNLINVLDGKLMYLKMVKGEFDSVYVRLHDKFQELVKRDFGAEKTNSLGITYIDTKPLLEFEKEMQTTISFQHKKNEKRAASFLIEGITHCASVNKNVTPDSEQQKEKLSISNCQNEKGEQFWLIHLVDKKTVFKSKPVDIDELNKDLDSLLNTYNG

SEQ ID NO: 7 - protein, 487 aa, unidentified
  source 1..487: note = Related to VVZB01000003.1; note = Phocaeicola dorei
MDKKQIVKQASQLKSKEDLLNLLNRIKRDEIEEMGFDAFKFHPFTMRHLNYYCNPNNVFHRYRQFHIKKKSGGSRVITAPRNRSFMMMLQAVNEILKAIYSPSDYAMGFTEGRSVVTNATIHKGQNYIFNIDLKDFFPSVEQSRVWKRLQLKPFNFSKQMANIIAGLCSMRQVKDVIDETKEHNNDKKFKYVLPQGSPVSPIITNMICDTLDRRLAGLARRFGLHYSRYADDITFSSMHYVYASNGKFRTELCRLITEQGFTINEDKTRLQKLGARQEVTGIIVSQKLNVTKEYVRDIRSILYIWDRYGYTAAIAQFLPKYTAAKGHVKKGNPDLQNVIDGKLMYLKMVKGDEDSVYTRLYSKFQSLIQRDTSSEKTNSYGISYVETTTVSKFEQINKTTINFVQDGDGKRHAEFTLGGKKQYATFMTIVKTDEIKDNLAISNCRNPKGEMFWLIHKVDKVTVPAKPIINIDELNNDLDTLLNLPHG

SEQ ID NO: 8 - protein, 486 aa, unidentified
  source 1..486: note = Related to NZ_JADNRM010000003.1; note = Phocaeicola sp.
MDKKQIVKQVSQIKSKEDLLNLLNCIKRDELEEMGFDASKFHPFTIRHLNYYCNPNNVFHRYRQFHIKKKSGGTRVITAPRNRSFMMMLQAVNEILKALYSPSDYAMGFTEGRSVVTNATIHKGQNYVFNIDLKDFFPSVEQFRVWKRIQLKPFNFPKQIANIVAGLCFMRQVRNVIDETKEHDNDKKFKYVLPQGSPVSPIITNMVCDTLDRRLAGLARRFGLHYSRYADDITFSSMHYVYAPNGKFHTELYRLITEQGFIINKDKTRLQKLGSRQEVTGIIISQKLNVTKKYVRDIRNILYIWDRYGYTTAISKFLPKYKAAKGHVKKGNPDLQNVIDGKLMYLKMVKGDEDSVYVKLYTKFQELVNRDSSSDKTNSYGITYIESLPFLKFEKDKNTIITIHHKDCNKRYATFKIGETTQIVSINKSVTPDDEQQKEKLAISYCRDSKGERFWLIHLVDKMTEFKPKPVDIDELNNDLDLLLSI

SEQ ID NO: 9 - protein, 484 aa, unidentified
  source 1..484: note = Myoviridae sp.; note = Related to BK014950.1
MDKKQIVKQASQLNSKEDLLNLLNRIKRDEIEEMGFDASKFHPFTMRHINYYCNPNNVFHRYRQFHIKKKSGGTRIITAPRNRSFMMILQAVNEILKAIYTPSDYAMGFTEGRSVVSNATIHKGQNYVFNIDLKDFFPSVEQFRVWKRLQLKPFNFPKQIANIIAGLCSMRQTREIIDETKEHKNDKRYKYVLPQGSPVSPIITNMICDTLDRRLAGLAHRFGLCYSRYADDITFSSMHYVYAPNGKFRTELCRIISDQGFTLNEDKTRLQKVGARQEVTGIIVSKKLNVTKKYVRDIRNILYIWDRYGYTAAIAKFLPKYKAAKGHVKKGNPDLQNVIDGKLMYLKMIKGEEDSVYIKLYTKFQSLVNRDTSLDKTNTYGISYVETTPILKFEHTNGTIVVFVHDEGGKRHAEFILGEKKQYATIMSVVKTEEVKENLAISNCRNSNGEMFWLIHSLDKVTTFKPEPVDIDELNNDLDLLLST

SEQ ID NO: 10 - protein, 479 aa, unidentified
  source 1..479: note = Related to JAFWQO010000014.1; note = Prevotella sp.
MDRTEITKMAMQMKTKEDLLSLLNLIKRAELEEIGLQDQFHPFTMKHINYYCNPNNAFHRYRQFKVKKKSGGFRLITTPRNRSFMMVLSAINELLKSLYTPSDYAMGFSEGRSVVSNASIHKGQNYVFNIDLKDFFPSIEQPRVWKRLQLAPFNFPEKIASLIAGMCSMKEIRSFEDGHQETFYVLPQGAPTSPIITNMICDTLDRRLAGLAKRFGLHYSRYADDITFSSMHYVYQEDGDFRKELRRIIADQHFTINDDKTRLQKKGARQEVTGIIVSDKLNVTQKYVRDVRNILYIWNRYGYPSALAKFIPKYKEEKGHVKKGNPNLENVIDGKLMYLKMVKGEEDSVYQRLHNKFVTLVEKMKEKSITTEQKVTYIETWALLEFEKKYSTEVVITTSENSHRYAHFIFGSKKAKASVNKNIIPDEEKDKKQLAISLCIDGKGDTFWFVHRIDKVIVPKKTEVDIDELNNDLNLLLNI

SEQ ID NO: 11 - protein, 534 aa, unidentified
  source 1..534: note = Related to FNHC01000010.1; note = Prevotella bryantii
MLFLLCYDVFMLYIICYIYIKKIVSGWDLSRPLINIFERRRQMDKEQIRQTALQMKTREDLLTLLNRIKRDEMEKLDFADKFHPFTAKHMNYYCNPKNAFHRYRQFKIKKKSGGFRQIMAPRNRSFMFMLDCLNEVLKAVYTPSQYAMGFTEGRSVVLNASKHKGANYVFNIDLKDFFPSIEQPRVWKRLQLQPFNFPVPVASAIAGLCCMKETREMSDGTKKDFYVLPQGAPTSPIITNMICDKLDHRLGGLARRFGLNYTRYADDITFSSMHNVYQENSEFRKELARIIGNQGFTMNEQKTRLLKRGSRQEVTGITISDRLNVSQKYVRDIRNILYIWEKYGYAVAYSKFLPKYKEEKGHVKKGNPDLMNVIDGKLMYLKMVKGKEDSVYKRMYAKFQILVEKSYDIKKTNEKNITYIETTPLLEFEKKIGSPVEIVISNQESQSEAEKKKNDKGRYAYYKLANGSKIKASISKYLSDAEIKTKDKLAISTCRDAKSKEFMFIHRAGIVTVPPPKPIDIDELNNELDSLLSS

SEQ ID NO: 12 - protein, 492 aa, unidentified
  source 1..492: note = Related to NZ_JNLA01000055.1; note = Bacteroides sp.
MDKEQIKHIALQMESREDLLSLLNRIKRDEMEELGYADKFHPFTIRHMNYYCNPKNAFHRYRQFKIKKKAGGFRQITAPRNRSFMFLLDCLNEVLKAVYTPSQYAMGFTEGRSVVTNACKHKGANYVFNIDLKDFFPSIEQPRVWKRLQLQPFNFPVSVANAIAGLCCMRETRITSDGIKKDYYILPQGAPTSPIITNMICDKLDHRLGGLAHRFGLNYTRYADDITFSSMHNVFQENSDFRKELLRIIGDQGFVMNEKKTRLQKRGSRQEVTGIIISDKLNVSQKYVRNIRNILYMWEKYGYTVAYAKFFPRYMEEKGHVKKGNPDLVNVIDGKLMYLKMVKGKDDSVYQRLYAKFQSLVAQMRDPKKTNDKHIAYVETMPLLDFEKKIGSSVEIVIPPKEEKNSEGEMSQSGKGRFAYYLLVGTKQLISISKYLSETEIKAKDKLAISQCRDGKGKEFMLIHRINIVTVPPPKPVDIDELNNELDSLLSS

SEQ ID NO: 13 - protein, 517 aa, unidentified
  source 1..517: note = Related to JAGBTN010000007.1; note = Bacteroidaceae bacterium
MDKEQIAKLAHQMETKDDLVTLLNRIKKEEMAEMGFADKYYPFSQKLMNYYCNPKNSFHRYKQFKIKKKSGGFRQITAPRNRSFMLMLSYVNVILKALYTPSKYTMGFTEGRSVVDNAQKHLGMNYVLNLDLKDFFPSIVQPRVWKRLQLKPFNFPVPVASAIAGLCCMKEIREDTDGKKTEHFVLPQGAPTSPIITNMICDKLDHRLAGLAKRFGLNYTRYADDITFSSMHNVYQKHGEFFAELYRIIEGQGFTVNEKKTRLQKNGSRQEVTGITVSEKLNVTQKYVNDLRNIIYIWDRYGYSVAYSKFFPKYKQEKGHVKKGNPDLVNVIDGKLMYLKMVKGDEDSVYKRLHGKFIKLLSNLNDPAKKTEQNITYVDTLPLLEFEKRNNTEVLVCFSEEKYELTFDNGIVVQMSEEHYEILKDKTPKEEIKSTRFVPSRRYAYFKLHNKKVYVSINKSVKPEEEHNKELLAISVCRDSKNKEFWLLHKLDKVTVSTQVELDLDELNNDLDSLLNS

SEQ ID NO: 14 - protein, 350 aa, unidentified
  source 1..350: note = Related to FR901644.1; note = Prevotella sp.
MEREQIAKMAAAMADKEDLLDLLNKIKQDEMIATGFGDKFYPFSIKHINYYCNPNNSFHRYRQFKIKKKSGGERIITAPRNRSFKLILSYINEILKSMYTPSTYAMGFAEGRSIADNAKKHRGMNYVFNLDLKDFFPSIEQARVWKRLQLAPFNFPLPVANIIAGMCCMKEVVQAEGGSQTARYVLPQGAPTSPIITNMICDNLDRRLAGVAKRFGLNYTRYADDITFSSMHNVYQENGEFRKEVRRIIEEQKFTINDKKTRLQKKGSRQEVTGIIVSDKINVTRDYVRDIRNILYMWEKYGYGVAFAKFFPKYKADKGHVKKGNPDLINVLDGKLQYLKMVKGEEDSVW

SEQ ID NO: 15 - protein, 486 aa, unidentified
  source 1..486: note = Related to JAGAGC010000402.1; note = Aeriscardovia sp.
MKREQIAQLARNMENRSDLLALLNRIKHDDVVEEGVQFFPFTMKQIRFYCNPNHAFHRYRQFKIKKKSGGFRLITTPRNRTYKMLLQYVNIILKALYSPSDYAMGFTEGRSVVTNAEKHLGQNYVLNLDLKDFFPSIDQARVWKRLQLAPFNFPVEIASIIAGLCCMKFKDDEVEKTRYVLPQGAPTSPIITNMICDKLDRRLVGLAKRFGLHYTRYADDITFSSMHNVYQPNGDFWTELRRIIADQNFTINEDKTRLQKRGSRQEVTGVMVTEKLNVSQKYVRDIRNILYIWERHGFNVAYSRFFPKYKSEKGHVKKGMPDLVNVLDGKLMYLKMVKGENDPVYLRLYRKFKALADQARDILTANNGGINYIETTPILEFEQKNNTEVVILWTEDKTDGDKMIPARRYAYFMLDGKRIKASVNKVITKEEESQKELLAISSCRDGNDKPFWLVHKKDKVTVFPPEPVNIEQLNNELDALLNKQDG

SEQ ID NO: 16 - protein, 496 aa, unidentified
  source 1..496: note = Related to NZ_JACJJF010000108.1; note = Bacteroides gallinaceum
MDKTEIAALAHRMESKDDILALLNHLKQDEMEEMGQIDKFYPFTMKHITFYCNPNHTFHRYKQFKIKKKSDGYRQITAPRNQSFMLLLRYVNEIFKAVYSPSDYAMGFTEQRSVVTNANVHKGQNYIFNIDLKDFFPSIEQPRVWKRLQLEPFNFPIPVANVLAGICSMKETRTLENGTKKDFYVLPQGAPTSPIITNMICDTLDRRLAGLAKRFGLRYTRYADDITFSSMHNVYQKDGDFRKELVRIIQSQGFTINEKKTRLQKIGGRQEVTGIIVSDKLNVTQKYVRDIRNILYIWDRYGYGVTYSKFFPKYKEEKGHVKKGNPDLVNVLDGKLMYMKMVKGENDSVYKRLHDKFEKLVRETRDPLKTTAHSITYVETTPLLDFEKQNTTEVIITESETSVEQTMTDSGEQARPHRYAYFMLDGKKIFASVNNGIKPEMEKRKEQLSISICRDKNDKQFWLIHLSKKVTVPPFEPIDVDELNKELDALLDIGHG

SEQ ID NO: 17 - protein, 396 aa, unidentified
  source 1..396: note = Related to JAFTVS010000063.1; note = Bacteroidaceae bacterium
YAMGFAEGRSVVTNANVHKGQNYVFNIDLKDFFFSIEQPRVWKRLQLKPFNFPLPVANVIAGLCSMKEVRELEDGTKQEIFVLPQGAPTSPILTNMICDKLDHRLAGLAKRFGLHYTRYADDITFSSMHNVYQPKSEFMKELQRIILDQGFHINNKKTRLQKLGSRQEVTGIIVSNKLNVTQKFIRDIRNILYMWDRYGYSVAYSNFFPKYKNEKGHVKKGNPDLINVIWGKLMYLKMIKGEEDSVYKRLHDKFISLVEKTFDENKTTDQHITYVETTPISEFEKRNNTQIFIEISQPYVELEKDENNPDKTKEVEKTSHRYAYFMLNGKKIYASVNKCIKTEEESKKDYLAISTCRDAKGKPFWLVHKIDKVTVPSQLAVDIDELNNELDSLLNM

SEQ ID NO: 18 - protein, 507 aa, unidentified
  source 1..507: note = Bacteroidaceae bacterium; note = Related to JAFXRB010000011.1
MNKGKIIKYATVMQTKVDLLKLLNSIKKMELEDCGLSKEFHPITMKQLNYYCNPKHTFHRYKQFVIPKKTGGKRIITAPQKGSFRLMLSALNQLFKFLYTPSDYAMGFTEGRSIVTNADVHKGQNYVFNIDLKDFFPSIRQPRVWKRIQLPPFNFTKEVANVIAGLCSMQIKKEDGTLDYVLPQGAPTSPIITNMICDKLDRRLAGLAKRFGLHYTRYADDITFSSLHYVYSLNGEFRKELERIIADQGFTINDKKTRLQTRAMRQEVTGITVSDKLNVTQKYVREIRNLLYIWEKYGYVDAVSKFLPKYKVEKQRKGNPDLINVLSGKLLYLKMVKGEEDSVYIRLSQKFNKLVADFMDVTRRSATGLMYIKTYTIDEFEKRFNTKIKIETFETNTKEKEINVKTENEGQAKKKTHRYASFILSNEEGEDIKQNISIRRNVKWNDDPKTKRKLAVSQCQKGNAKPFWLLHYRAEKQAVEQKDVSIEDLNNVLDNLLSTLDDGTTIS

SEQ ID NO: 19 - protein, 482 aa, unidentified
  source 1..482: note = Related to DVLS01000070.1; note = Candidatus Avibacteroides faecavium
MDKTRIARLAHLMKGKDDLLSLLNDIKRDMMAQAGAGGSFYPFTMKHINYYCNPGNTWHRYKSFQISKKSGGTRQITAPRNESFKLILRCLNELLKAVYSPSAYAMGFTEGRSVVTNAEVHKGMNYVFNIDLKDFFPSIEQARVWKRLQIAPFNFPVPVASVIAGLCSMQDARTMDDGTTAVRYVLPQGAPTSPIITNMVCDKLDRRLAGLAKRFGVRYTRYADDITFSSMHNVYQVGGEFRQELQRIIAGQGFTMNEAKTRLQKRGARQEVTGIVVNDKLNVTQAYVRSIRNILYIWDRHGYGVAYAKFLPVYKADKGHVRRGNPDLVNVIDGKLMYLKMVKGDADSTYLRLRAKFDKLSGDVHDPSKTTDHAITYVETTPLPEFERRNATTVVIATPEPCDGGAAAHRYAYFEIGGKKVYASVNKAVKPEDEGRKDLLSISSCRDKDDKPFWLVHLSSKTVTPALVDVDALNTELDSLLD

SEQ ID NO: 20 - protein, 446 aa, unidentified
  source 1..446: note = Related to RKDY01000002.1; note = Porphyromonadaceae bacterium
MNKELFLEEKYIKTKKKYRKIVTYVDGENLLREKHERIVSLLKQECSDSIFAKAYIEHSSIVKNAKAHMYNDIFLFFDVKDFFPSIHQARVWKRLQLKPLFFKQPIANILAGLCSMKEKAEDGSIRYVLPQGAPTSPVITNMICDNLDRRLAGLAKRFGVVYSRYADDITFSSMHNVYNTSGEFRKELKRIVEGQGFTMNEAKTRLQKLGSRQEVTGIIVSDKLNVSQKYVRDIRNILYIWRKYGYDTAFNKFFPKYKEAKGHVKKGNPDMVNVLDGKLMYLKMVKGEDDSVCKRLRSQFDELCNSLHDDTKTTQQGITYVETLPVLEFERKHNTTIAIMTTKPKEFFIVQKNQEATEDTQKSISENFIPHRYASFKLGGRMQKASVNKSLKKEEETQKDLLSISNCRDAKGKLFWLVHRSDKVTVPPAKPVDIDELNDDLDKLLN

SEQ ID NO: 21 - protein, 499 aa, unidentified
  source 1..499: note = Related to NZ_JACICA010000001.1; note = Alloprevotella rava
MDKNSISKATQQLETKEDLLRLLNQIKQDEMTEYGMSDKFYPFTMKHLNYYCNPNNSFHRYKQFKIKKKSGGFRLITAPRNQSFMLLLRYVNEVFKAVYTPSDYAMGFTEGRSVVTNANKHKGHNYVFNTDLKDFFPSIHQARVWKRLQLKPLLFKQSIANILAGLCSMKEKTEDGNIKFVLPQGAPTSPIITNMICDNLDRRLAGLAKRFSVVYSRYADDITFSSMHNVYQTSGEFRKELKRIIESQGFTMNEAKTRLQKFGSRQEVTGIIVSDKLNVSQKYVRDIRNILYIWHKYGYDTAFNKFFPKYKEAKGHVKKGNPDMVNVLDGKLMYLKMVKGEDDSVYKRLRSQFDALCNSLHDDTKTTLQGITYVETLPVLEFEKKNNTTITIVTTKPKEFYTEHTSQEATEDTQKSISENFIPHRYVSFKLGGRMQKASVNKSLKKEDEDRKELLSISNCRDAKGKLFWLVHRSDKVTVSPAQPVDIDELNDDLDKLLN

SEQ ID NO: 22 - protein, 483 aa, unidentified
  source 1..483: note = Related to JXQI01000021.1; note = Prevotella sp.
MDKNDIAKAAQLLETKEDLLHLLNKIKQDEMAECGMSDKFYPFTMKHLNYYCNPNNSFHRYKQFKIKKKSGGFRLITAPRNQSFMLLLRYVNEIFKAVYTPSDYAMGFTENRSVVTNANLHKGRNYIFNIDLKDFFPSIHQARVWKRLQLKPLSFKQPIANVVAGLCSMKEKMEDGSIRYVLPQGAPTSPIITNMICDNLDRRLAGLAKRFGVVYSRYADDITFSSMHNVYHPMGEFRKELKRIVESQGFVINKDKTRLQKLGSRQEVTGIIVSDKLNVSQKYVRDIRNILYIWRKYGYATAFNKFFPRYKDAKGHVKKGNPDMVNVLDGKLMYLKMVKGEDDSVYMRLKTQFDELRHKLHNTSQATPRGITYVETTPVLEFEKKNGATIEITRSKPSEKAIEPFVSHRYATFPLGGKRQWASVNKTLKPEEETQKDLLAISHCRDANGKLFWLIHRADKMMVRPPESVNIDELNKELDDLLA

SEQ ID NO: 23 - protein, 476 aa, unidentified
  source 1..476: note = Related to HF986315.1; note = Bacteroides sp.
METKEDLLDLLNKMKKDEMAESGMSHKFFPFTMTYLNYYCNPNNTFHCYKQFKIRKKSGGFRQITAPRNRGFILLLHYVNEIFKAVYSPSDHAMGFTEGRSVVTNAGMHKGQNYVFNIDLKDFFPSIQQARVWKRIQLKPLCFKQSIANMIAGLCSMKEILEDGSNRYVLPQGAPTSPILTNMVCDKLDRRLAGLAKRFGLNFSRYADDITFSSMHNVYQGNGEFRKELKRIIEDQGFTINEAKTRLQKLGSRQEVTGIIVSHKLNVTQKYVRDIRNILYIWKKYGYSTAFNLFFSKYKQDKGHVKKGKPDMVNVLSGKLMYLKMVKGAEDSVYVRLRTRFDELTIALKDAHNTTTQGVTYVETIPLLEFEKNNHTDVVITTFKAREEVNAEDENKVIAHRYAYFTLGGHKELASVNKSLRSEEEKDKSPLSISSCRDAKGKPFWLIHRSGKVVVPTLSPVNIDDLNNDLDTLLSI

SEQ ID NO: 24 - protein, 482 aa, unidentified
  source 1..482: note = Muribaculaceae bacterium; note = Related to JAFULJ010000027.1
MDKTHIIKHSLQLQQKEDLLNLLNQLKFDEMNAIGIGDKYHPFILKHIDYYCNPNNTFHRYRQFKIKKKTGGFREITAPRNRSYVLLLRYVNEILKALYMPSKYAMGFTDGRSIATNAGKHINSNYIFNIDLKDFFPSINRARIIKRLQIRPFNFSPKIALLIAGLCCMRKELLSDDGKIFYSYILPQGAPTSPIITNMICDKLDHQLAGLAKRFGLTYTRYADDITFSSNHNVYHDNSIFRKELERIIKSQGFNINEKKTRLQKLGHRQEVTGIIVSDKLNVSQHYVRDIRNILYIWDRYGYNIAYARFFSKYKAEKGHIKKGNPNLINVLDGKLMYLKMIKGEKDSVYQRLYSKFKMLSNYIDNNNPISPQSVKYIETMTISDFETKNNTEIVFKIDDNNSTPKRSAYFTLNRTKISISIKKNISNSKLNKEHLAISTCIDANNRQFWLIHPINVERTPSPIDIDALNNDLESLLNLQYG

SEQ ID NO: 25 - protein, 481 aa, unidentified
  source 1..481: note = Related to JAFRQB010000001.1; note = Prevotella sp.
MDRKQIAQQASQLKDKGDLLNLLNLIKKAEIEDMGFDSSMYHPFTEKQLNFYCNPNHTFHRYRQFKIKKKSGGTRQITAPRTQSFMMMLSAVNELFRSIYTPSEYAMGFTDGRSVVTNASAHLGMDYILNIDLKDFFPSIHQARVWKRLQVPPFNFNQPVANLLAGLCCMKESCEDENGNKKDVFVLPQGAPTSPIITNMICDKLDYYLSRLAKRFNMNYTRYADDITFSSMRYVYSKKGKFVLELERIIKEQGFTINEAKTRLQKRGDRQEVTGIIVSDKLNVTQKYVRDVRNILYMWDRYGYNVAYGKFFPKYKEEKGHVKKGNPDLINVIDGKLMYLKMVKGENDSVYEKLHAKFQKLANKDVISEKTNSKGVTYLETIGVKEFEKKNFTTVTFAISEKGKHYAYFMLNDKKMLVTVNKTLTIEEEQDKDVLAISSCRGKDEKPFWLIHRKDKVMVPPPPAIDVDELNAELDSLLNTC

SEQ ID NO: 26 - protein, 487 aa, unidentified
  source 1..487: note = Related to JAFQZK010000038.1; note = Muribaculaceae bacterium
MDRNYIAQQAAKMETKHDLLSLLNRIKISWFEDMGMTVKFHPFTMKQLNYYSNPNHTFHRYSQFKIKKKTGGFRQITAPRSKTFKLMLMCLNEMFKSIYSPSDFAMGFTEGRSVVSNASIHKGQNYIFNIDLKDFFPSIYRVRVRARLQAKPFCFNENIAMLLAGLCSMKISSGHNDGRDYVLPQGSPTSPIITNMICDNLDRRLAGLAKRFGLRYSRYADDITFSSMHNVYQTNGEFRTELRRIIEGQGFTINEAKTRLQKQGSRQEVTGLIVSDKLNVTQHYVRDIRNILFIWEHYGYNAAFTRFFPRYKAEKGHVKKGVPDLINVLDGKLMYLKMVKGAEDSVYIRLFSKYRTLADKAHSIDNTTEHGVTYVETIPLHDFEVNNSTEVIIDWVVPTSDDENGQPKPKRRTASFTLDGKRVYASVNKNVKKEDEQKKELLAISNCRDAKNKQFWLIHYVNKVTVPPAEPVNIEELSNELDALLNS

SEQ ID NO: 27 - protein, 474 aa, unidentified
  source 1..474: note = Related to JAFXWY010000545.1; note = Bacteroidales bacterium
MDREFIINYHGDFLTLLNKVKKVMLEENGMGDLFHPFSLRQITYYSNPNHTKNRYQQFEIKKKTGGMRLITAPRNKTFKMILQCLNEIFKAIYTPSDYAMGFTEGRSSVTNASIHKNQNYVLNIDLKDFFPSITQSRICNRLRTKPFEFPDKIALVISGLCCMKITTKDENGNDVVRYVLPQGAPTSPVITNMICDKLDRRLAGVAKRFGLKYSRYADDITFSSMHNVYQKDGEFWNELNRVITAQGFSINEKKTRLQTKRMRQEVTGIVVNKKLNVLQKYVRNIRNILYIWGKYGFIAAQSRFLPKYKADKGHVKKGNPDMINVLEGKLLYLKMVKGEDDSVYQRLREKFDRLKNDALGILKTNTFSNVTYIETLPLSDFENKNGEVVITYSEKKHKRYAYFNLDGNKKLVSVSLDITEEEEKAKDNFAISLCQDAKGKRFWLLHKKTKVTVPTPKPVDLDELNNDLDSLLNI

SEQ ID NO: 28 - protein, 483 aa, unidentified
  source 1..483: note = Related to RKEV01000037.1; note = Prevotella sp.
MVKNTIAMQARQITSKEDLLNLLNRMKMDEMAESGMADSFCPFTMKHINYYCNPNNVFHRYKQFCIKKKSGGTRQITAPRNKSFRLMLQYVNEIFKSLYEPSDYAMGFTEGRSVVTNANIHKGQNYVFNIDLKDFFPSIEQARVWKRLQLEPLNLQKQAANLLAGMCFMKVSSEDGAVKFVLPQGAPTSPILTNMICDKLDRRLGGLAKRFGLHYSRYADDITFSSMHNVYKMDGAFRKELERIINDQGFKMNPEKTRLQKLGARQEVTGLIVSDKLNVTQKYVRDIRNILYIWSRYGYDTAFNKFFPKYKAEKGHVKKGNPDMANVLDGKLMYLKMVKGEDDGVYLRLKTKFDILARRLNDTSNASARGVTYVETTALLDFEKKNGTSIEITMSKRPENATESFTPHRYAIFTLGGKNHMASVNKTLKPEEEKRKDILSISHCRDAKGKQFWLIHRTDKVMVRPDELVNIDELNKELDDLLS

SEQ ID NO: 29 - protein, 408 aa, unidentified
  source 1..408: note = Bacteroidales bacterium; note = Related to JAFXTE010000053.1
MDREEIANTIRLIETKNDFLELLNRIKRENIDFADNQDQKTYPFTMRQLNFYINPKHTTGRYKEFYIKKKSGGMRRITAPRTKTFQLMLSAVNEILKAVYVPTQFATGFVEGRSIVDNAVPHQNQYYVFNTDLKDFFPSIDQARVWKRLQVKPYIFPEKIANLIAGLCSMQMISKEDGEDTIRYVLPQGAPTSPILTNMICERLDRQLAGLAKRYGLRYTRYADDITFSSLHNIYQEGGEFRKELEHIIKEQRFTINNEKTRLQKAGERQEVTGLVVNQRVNVPNQYVRNIRNLLYIWDRYGYDVAYNCFLPKYQKEKGHVKKEKPNLSNVIEGKLLYLKMVKGENDPVYRRLFDKFNSLTTPDHAQEIEMSEGVSIEQLVALMEPDISDIDKLNNDLDELLMRSYGG

SEQ ID NO: 30 - protein, 399 aa, unidentified
  source 1..399: note = Related to NZ_KV793777.1; note = Porphyromonas sp.
MEKKILATKVRSLATVGDFLTLLNQMKREDQGVEEDPHPFTLKHINYYRNPSHEGRYRSFKIPKKSGGCRVISAPRNKTFRLILRYVNEMLKALYTPSEYAMGFAEGRSVVTNAQIHLRQNYVFNTDLKDFFPSVDQARVWARLQIKPLSLQRPIAGIIAGLCSVRLETDEGTVRYVLPQGAPTSPILTNMVCDTLDRRLGGVAKRFGLRYSRYADDITFSSMHNVYEVGGDFRSELRRIVEDQRFVINEKKTRLQKRGARQEVTGLTVGERLNVPQSYVRGIRNLLYIWRKYGEGEARARFEESYMAEKGHLREKCPDMILVLEGKLCYLRMVKGPNDSVYRRLSTDFDRLLHADEGAVEPLPSGGERLLAEGLALTASAPVDLEALNFDLDQLLNNG

SEQ ID NO: 31 - protein, 536 aa, unidentified
  source 1..536: note = Related to JAEUGO010000081.1; note = Muribaculaceae bacterium
MDKQTVINKAQDLETRHDLLNLLNEIKADMLGSAAYPFSMKKLLILCNPKNDGDKKQERYRTFSIPKKSGGERTISAPCGNLKWMQLCLNEIFKALYTSSPYAMGFAEGRSIVDNARMHTNQNYVFNIDLKDFFPSIDQTRVWKRLQLAPFNFNPKIASIIAGLCSMRTIRYRENLPFEEAFVLPQGAPTSPLLTNAICDTLDRRLHGLAKRFGLHYSRYADDITFSSMHNVYQPGSDFRKELERIIFDQRFTINAKKTRLQHCSVRQEVTGITVGQKLNVTRKYVKDVRAILHIWEKYGINAAYATFYPRYKSEKCQLHRGEPNLENVISGKLCYLKMVKGETDPAYARLSAQFSRLTSSANPTQKPRDIDYLFTMPLLAFEKKLGCKLEYRTRTHDNKPYACFHFQDRFFVVAVSKNLDVNNLPENVEISLTRMAVPIPFYLAPGEPIPEVKPTKAQVGYLLHKPYTGKKRKAVDNDQSASTGVPDSLREFVLDLATKFPKLQLQDEMGIIAGQQEDDMLSRLVDSNFDLSILP

SEQ ID NO: 32 - protein, 538 aa, unidentified
  source 1..538: note = Muribaculaceae bacterium Isolate-102 (HZI); note = Related to RIBI01000006.1
MDKQTIKEKAKALETRFDLLNLLNEVKADLLGSTAYPFTMKKLLIFCNPKNDGEKKQERYRSFSIPKKSGGERTISAPCGNLKWMQLCINEIFQALYSPSPYAMGFAEGRSIVDNARMHTNQNYVFNIDLKDFFPSIDIKRVWNRLQRAPFNFNAKVAYTIAGLCTMRTIHYREDLPFEEAFVLPQGAPTSPLLTNAICDTLDRRLHGLAKRFGLHYSRYADDITFSSMHNVYQPDGDFRKELERIITTQRFMINAKKTRLQHCSVRQEVTGITVGQKLNVSRKYVKDVRAILHIWEKYGINAAYATFYPRYKSEKCQLHRGEPNIVNVISGKLCYLKMVKGESDSVYTKLFAQFTRLTSTEKPVTKPNDIDYLFTMPLIAFEKKLGCKLEYRTRSHDNKPYACFNFQDRFFIVAVSKNIDINNLPGNVEISLTRMAAPLPFYVAEGDPIPEIKPTKIQVGYLLHKHYTGKKRKNEIVTITSDESNDVSDGLREFVLGLAEQYPEFQFRDDMGIIESQQENDILSRLVDSNFDLSILP

SEQ ID NO: 33 - protein, 538 aa, unidentified
  source 1..538: note = Related to BK020991.1; note = Siphoviridae sp.
MDKQTLIEKAQALETRRDLLKLLNEVKAELLGSSAYPFTMKKLLILCNPKNDGDKKQERYRSFSIPKKSGGERTISAPCGNLKWMQLCLNEIFKALYTASPYAMGFVEGRSIVDNARMHTNQNYVFNIDLKDFFPSIDQARVWKRLQLSPFNFNAKVASVITGLCCMRTIRYRVDLPFEEAFVLPQGAPTSPLLTNAICDTLDRRLHGLAKRFGLHYSRYADDITFSSMQNVYQPNGDFRKELERIISDQHFTINSKKTRLQHCSQRQEVTGITVGQKLNVARKYVKDVRALLHIWEKYGINAAYATFYPRYKSEKCQLHRGEPNIVNVISGKLCYLKMVKGETDPVYTKLFAQFTRLTSTENPVAQTKDIDYLFTIPLIAFEKKLGCKLEYRTRIHDNKPYACFQFQDRFFIVAVSKNLDINNLPGNVEISLVHTAHYNTNFHSSEDTDLNFKISQLKVGYLLHKHYTGKKRIDEASAPSPNTTLDVPDSLREFVLGLAEQFPELQLRDDMGIIESQQETDILSRLVDSNFDLSILP

SEQ ID NO: 34 - protein, 530 aa, unidentified
  source 1..530: note = Muribaculaceae bacterium; note = Related to JAGAST010000027.1
MDKETLVSKARALETPKDFLYLMNEIKADLLGDNSYPFSVRQLHILCNPKNDKKRYFSFEIPKKSGESRQICTPSGNLKWFQICLNELFKALYTPSPYAMGFAVGKSIVDNARMHTNQNYVFNIDLKDFFPSIDQARVWKRLQIAPFNFNAKIAGIMAGLCSIKSLRYSGEEPFQECFVLPQGAPTSPLLTNAICDTLDRRLHGLAKRYGLHYSRYADDITFSSMHNVYQSDSVFRKELQRIITEQRFTINPKKTRLNHCSLRQEVTGLTVGLKINVSRKYVKDIRAILHIWEKYGYNAAYATFYPRYKSEKCQLHRGEPNLENVISGKLCYLKMVKGESDPVYSKLYSQFIRLTEATIIAQDKHNIDYLFTMSKCDFENKLGVSIEFRERADDKKKYGCFYFQDRFFVVAVSKNIDINNLPENLQISLTRMQKPVEFYLRPGEPRAAALPTITRIGYLLHKPLRGYKPEPKAGNISNDISNELKSFVINLANTYPELQLKDDMGIIESSNEDNLLARLVQSNFDLSILP

SEQ ID NO: 35 - protein, 513 aa, unidentified
  source 1..513: note = Related to JAFXFD010000128.1; note = Muribaculaceae bacterium
MEKRYLTEKAQALNTTVDLFNLLNEIKCDILGDNSFPFKWNRFLALSTPGDYLHRYYSFKIPKKSGGFRSIYAPLYNLRWIQICLNEIFKAIYTPSPYAMGFAAGRSIVDNARMHTNQNYVFNIDLQDFFHSIDRHRVYKRLQFAPFNFNPEIANVIAGFCTIKSFVRSGGSSSIDCYVLPQGAPTSPLLTNAICDTLDRRLQGLAKRFGLHYSRYADDITFSSMHNVYQEQSEFRQELERIIADQGFTINPKKTRLSHCSKRQEVTGLVVSQKVNVNPKFVKDIRAILHIWEKYGYNAAYSSFYPKYLSEKCQLNRGYMNLANVISGKLCFLKMVKGAKDPIYIKLNEQFASILKSQKSTKGESERIKYLMTMTKRDFEKKIGTKIHFNRSRYDAKIYGYFYYHGKSFLVAVSQNLDITNLPDETQISLCEFVKYLDCEYDSDPRKLKSSQRYYGVVYLLHKPHYGLNMKNKKIPKQVKEMVINFANRFPELELKDEFGIIDEYNKTQIDKN

SEQ ID NO: 36 - protein, 544 aa, unidentified
  source 1..544: note = Related to VULT01000011.1; note = Sodaliphilus pleomorphus
MDKELLISKIRNTTTRWKLLDLLNEIKADLAGTAAYPFTMSKMMRLCNPRIGLDRYHSFEIPKKSGGVRLIFAPEGNLKWMQLCLNEIFKALYTPSPYAMGFTQGRSIVSNAVRHLHQNYVFNIDLCDFFPSISQARVWKRLQLPPFNFTKDVASVVAGLCSIRMLDIVDGNVRLVSYKLPQGAPTSPLLTNAICDTLDRRLAGLARRFGLHYTRYADDITFSSMHNVYQDGSPFRHELERIVSGQHFKINAKKTRLNHRGERQEVTGLTVGEKVNVARRYVKDVRAILHIWERYGMNAAVAKFYPRYKTEKGSLHNGDPDMENVIAGKLCYLKMVKGQHDPVYVKLQEQFDRLTSAKPEAHDLEISWEYLQTLPTSDFEAQLGVKIDYGISNLGKQYASFVFNGKKIYASVSRNISISNLPKSLYISLCRQIDYKVKYTGEASQRHAVIDPGTPYGRMMLGCPLPEDLAVRYIYVVHRALPKDKPLKYVHTPQVAPELKDIVGKLNELMPGALTADGALLAGDRPKDTLTQLVESGFDLSILP

SEQ ID NO: 37 - protein, 544 aa, unidentified
  source 1..544: note = Related to JAAVDT010000061.1; note = Bacteroides sp.
MDKELLVSKIRSTTTRMELLDLLNEIKVDLAGSAAYPFTMQKMMRLCNPKLGENRYRRFEIPKKSGGVRTIFAPNGNLKWMQLCLNEIFKTLYTPSSYAMGFTQGRSIVDNAKKHLNHNYVFNIDLSDFFPSIDQARVWKRLQMPPFSFSKEIANVIAGLCAIEMVYDEDDKDPVKTYKLPQGAPTSPLLTNAICDTLDRRLAGLAKRFGLHYTRYADDITFSSLHNVYQEGSAFRNELERIVIGQNFRINPRKTRLQHRSKRQEVTGLSVGEKINVCRMYVKDLRALLHIWEKYGINAAIAKFYPRYKAEKGYIHKGEPNIENVLSGKLCYLKMVKGKFDPVYCRLQEQFNRLTLTSTNKKNVELSWEYLQTTPVNDFETQLGVKIEYAVSKRGKPYSYFMLKGERIMISVSQNISIDKLPKNLYISLCRQVDYKLRYTKQQFSVPEVIDNTTAYGRMKLGCPRMEDLAVRYLYVIHRQLPKNHPSKYIRTPEVTPELKDVVNKLSELIPSLFDVDCVQATDVEPKDTLTRLVESGFDLSILS

SEQ ID NO: 38 - protein, 544 aa, unidentified
  source 1..544: note = Related to JAAVCQ010000011.1; note = Bacteroides sp.
MDKELLISKIQNTTTRWELLNLLNEIKADLVSSTAYPFTIQKMMRLCNPKLGNNRYRKFEIPKKSGGVRTIFAPNGNLKWMQLCLNEIFKALYTPSPYAMGFVEGRSIVNNAEKHLKQNYVFNIDLSDFFPSIDQARVWRRLQLPPFNFSKEVANIIAGLCSIEMKKEGDETPPVKSYKLPQGAPTSPLLTNAICDTLDRRLAGLAKRFGLRYTRYADDITFSSMHNVYQNGSQFRIELERIISGQHFKINPKKTRLHHRGQRQEVTGLTVGEKINVCRSYVKDIRAILHIWGKYGINAAVAKFYPRYKAEKGYLNKGEPNIANVISGKLCYLKMVKGEMDPVYSRLNDQFSRLVDTNSGAKDIEISWEYLQTLSTDDFEKQLGVKIKFSVSKQSKQYAYFILKDEKIMVSVSRNISIDHLPKNLYISLCRQIDYKLKYTGELYTRPDVIDNSTAYGRMKLGCPIPGDLAVRYIYVIHRAIAKDKPTKYIHTPEVAPEIKNVINKLNEFMPGAFTVGRVESTSVKPKDTLTRLVESGFDLSILP

SEQ ID NO: 39 - protein, 605 aa, unidentified
  source 1..605: note = Related to JAGHUA010000031.1; note = Bacteroidales bacterium
MENNEIVARVSKISDVESLYKLLDDIRKSDRETYIRKMDFTLAHIKRYANPNLTYKRFSLVNIPKKSGGTRQICIPNVRLGVILHCLNEVFKALYTPNEFATAFCVGRSIVNNAKVHIGHNYVYSIDLEDFFGSIQQARVWKRLQLPPFNFRQPLVNAIAGMCCVKMQPSIKNNRSTADYILPQGAPTSPLLSNAICDTLDRRLTGLAKRFGLCYSRYADDITFSSNHNVFQDNSDFCNELNRIIADQKFTINVKKTRLQKRGSRQEVTGLIVCEKVNLCRKYVRSIRQILYIWKWYGVHDAYSSYRKNNNISEYKGEEGFKLIILGKLNYLKMVKGETDPVYIKLRTEYDNIVNGTYHHQSSSIHFKFVNTQSLEDFESEHGRIGIAVGKSGKRYAYWKKLNRYLRFISISNSIKEFNREDLCISECATAGGGKFYLLRNKSKRKKYTDVLEADFKKSLIWETCSKLSQSKPYEFDIVTMWNSGMFDVGEYSHDDSYHYINIAETQYTGTWTNLQQELTRELKRICFDIKFINGQTSFIVKGKSIGLSLQWPWNPPYEEELNNTAVLVQAKIPKNKYPEMEAFIKSYFELVVSEQMYYDSLNIF

SEQ ID NO: 40 - protein, 526 aa, unidentified
  source 1..526: note = Related to NZ_CP007034.1; note = Barnesiella viscericola
MEKNVIIKRASNLETKEDLLLLLNDIVKDELGKDDAFSFSMKQLMYYCNPNNVRGRYSHFSIPKKSGGCRNIAVPSRGLGNLLHYVNIMLKAIYQPSDYAMGFVEGRCVVDNAMRHVGQNYIFNTDLENFFPSIEQPRVWKRFQLSPFNFKRPIANILAGLCCIKEKNDDGSFIYVVPQGAPTSPLITNSICDVLDRRLNGLARRFNLHYSRYADDITFSSMHNVYKVGGDFRTELKRIVEDQHFRMKESKTRLQKIGERQEVTGLIVSSKVNTSAAYVAEIRNLLHIWEKYGYNEVYKRFYPKYKADKGYIKKGEPLLENVLYGKLQYLKMVKGYKDSVYAALQARYDRLTSPINASSEQKYDYLRSFTLAEFEEIVGNQIRYSLSKNGNLYGRVNLNDNDIIVSITNAAKVQLVKNKIITDESMIASVKTSKSTIPANSRPGLYVVLTAKNGKSLFWMMTYYDPTVTDIDLSSVSVSELVDIWEQEGINAAIEAYENGILFKQDNKSFEKLKGGKQKFYRPSSF

SEQ ID NO: 41 - protein, 594 aa, unidentified
  source 1..594: note = Related to nan
MEKSEIRKRATEIESKEDLLLLLNDIVKDELGKDDAFSFSMQQLNYYSNPNNVRGRYHHFSIPKKSGGKRNIAAPSKGLGHILYYVNILLKSIYQPSDFAMGFVEGRCVVDNAMRHIGQNYVFNTDLENFFPSIEQPRVWKRFQLKPFNFKQPIANLLAGLCCIKEKHDDGTFKYVVPQGAPTSPLITNAICDTLDRRLNGLARRFNLHYSRYADDITFSSMRNVFKAGGDFRMELKRIIEGQNFKMNEAKTRLQKKGERQEVTGLTVSNKVNTSSAYVAEIRNILHIWEKFGYNDAYKRFYPKYKESKGHVKKGEPLLENVLYGKLQYLKMVKGVKDPVYVALQARYDKLTSPVNAEVKQKYDYLRSFTLAEFEEIVECQISYALSKEDNLYGKVILNGKDIIISISNEAKTQLVKNKIVTDEALVASVKPIKNVISVNSKPGLYVVLTAKNGKAPFWMMTYYDPTVTDIDLSQVSVAELVNIWEKNGIDAAIKAYEDGILLTSEDASMANKNSKDKKNTPMQKRKSASSKDESVYMGDIDFIDVADIAAIEEEIKSGNLGEVKLSFSKNDEADNSGNDELDTIIDEGSFDDL

SEQ ID NO: 42 - protein, 592 aa, unidentified
  source 1..592: note = Related to NPIZ01000015.1; note = Prevotella sp.
MEKSVIRKRAAELQSKEDLLLLLNEIVKDELGKDDAFSFSMQQLTYYSNPNNVRGRYRHFSIPKKSGGKRNIAAPSKGLGHILYYVNILLKAIYQPSDYAMGFVEGRSVVDNAIRHIGQNYVFNTDIENFFPSIEQPRVWKRFQLKPFNFKKPIANILAGLCCIKEKNDDGTVKYILPQGAPTSPLITNAICDTLDRRLSGLARRFNLHYSRYADDITFSSMHNVYKEDGDFRTELKRIIEGQNFTMNEAKTRLQKIGERQEVTGLTISNKVNASTAYVAEIRNLLHIWEKYGYNEAYKRFYPIYKESKGHVKKGEPLLENVLYGKLQYLKMVKGYKDPVYAALQARYDKLTSPVNAEVEQKFDYLRSFTLAEFEEIVDGQINYALSKEGNLYGKVVLNGKDIIISISNDAKSQLVKNKIVTDETLVASVKPTKSAIPVNSKPGLYVVLTAKNGRVPFWMMTYYDPTVTDIDLSEVPVTELVNIWEKNGIDAAIEAYENGILLKGEGANKAAKDAKGKKKTKKPQKGVFLPSMSESVSLDVDYIDVADIAAVEEEIRSGKPTKLSSSFTDEYNDLDSDELDTIVDEGSFDDL

SEQ ID NO: 43 - protein, 562 aa, unidentified
  source 1..562: note = Related to JAFRTY010000007.1; note = Bacteroidaceae bacterium
MEKREIAQRASMLQNKEDLLQLLNDILKDEISSDHSFSFSMRQLSYYCNPNNVRGRYRHFSIPKKSGGQRHISAPSRGLSHILYYVNIMLKAVYLPSDYAMGFVEGRSVVDNASRHIGQNYVFNTDLENFFPSIAQPRVWKRFQLAPFNFNQQIASILAGLCCIREKQEDGKFTFILPQGAPTSPLITNAICDKLDRRLSGLARRFRLHYSRYADDITFSSMCNVYHENGDFRTELKRIIEDQGFHMNIAKTRLQKRGERQEVTGLTVSNRVNTSREYVAEIRNLLHIWEKYGYNDVFKRFYPQYKANKGHVKKGEPMLENVLYGKLQYLKMVKGYKDPVYAALQARYDRLTSPVNAEAKQGLDYLRSFTIAEFEEIVGSPISYYLSKDNKIYGKSMLNGKEIAISITRAAKHQLAKSKIITDESLLASIKPVKYNVTANSNPGLFVVLAARNGHTPFWLMTYYDPTVTDIDMSNVPPTELINIWEEKGIDAAILAYTEGKDQGPNKKQEKSKKKGKRSETKKLVSNIDLLDFDIDGALDIDDISSLVADFDEASAISLDDL

SEQ ID NO: 44 - protein, 506 aa, unidentified
  source 1..506: note = Related to JAFXXQ010000016.1; note = Bacteroidaceae bacterium
MEKREIVHRASQLQNKEDLLQLLNDIVKDELSNERAFSFSLKQLSYYCNPNNVRGRYRHFSIPKKSGGQRNIAAPSRGLSHLLYYVNIMLKAIYRPSDYAMGFVEGRNVVDNASRHIGQNCVFNTDLENFFPSIAQPRVWKRFQLPPFNFNKQVASILAGLCCIREKHVDGKLTYILPQGAPTSPLITNAICDNLDRRLSGLAHRFGLHYSRYADDLTFSSMHNVYQENGEFQTELKRIIEGQGFRMNIGKTRLQKLGERQVVTGLTVSNRVNTSSEYVAEIRNLLHIWEKYGYNDAFKNFYSHYKDKKGHIKKGEPMLENVLYGKLQYLKMVKGSNDPVYAALQARYDKLTSPVNAEIKQSLDYLRSFTIAEFEEIVGSPINYRLSKDNNLYGQAMLNGKEIAISITGAAKHQLAKSKIITDETLLSSIKPIKYSVTSKSKPGLFVVLTARNGHAPFWMMTYYDPTVTDIDMSNVPASELVDIWEKEGIDAAINAFEEGFLEDFV

SEQ ID NO: 45 - protein, 553 aa, unidentified
  source 1..553: note = Related to JABZTC010000018.1; note = Prevotella nanceiensis
MEKSELLKKILALQTKEDLLQLLNLIVKDELRQENAFTFSMAQLMYFCNPNNVRGRYTHFSIPKKLGGKRQIAAPTAGLRNILYYINIMLKAVYTPSDYAMGFVEGRNVVSNATLHVGKNYVFNTDLENFFSSIEQPRVWKRLQLPPFNFSRPIANIIAGLCCIREKQENGQFIYVLPQGAPTSPLLTNAICDSLDRKLAGLARRFGLHYSRYADDITFSSMHNVYQNNREFITELKHIIIGQNFHINEAKTRLQKHRERQEVTGLTVNSGVNTSKKYKAEIRNLLHIWEKYGYKEAYKRFYPHYKETKGHTKKGEPMLENVLYGKLQYLRMVKGAKHPVYVALQERYNKLTSPINGHSKESFDFLRAFSLSDFEIMTNNPVQFAISSTHNLYAYTMLEGKKILISLTNAVKEILIKKGDITNNTATSHEEIIKSYIPFNSTTQLYVVLTAKKGHAPFWLMTDYDPTTTGLHFCSMPISQLIDIWETKGIDEAIATYEKNSTFTKVKNIESSSEKNESVFDKFPIKENSDEDIQFLHKLFEDGTQKNDTLFTL

SEQ ID NO: 46 - protein, 790 aa, unidentified
  source 1..790: note = Related to JABVZU010000003.1; note = Phocaeicola sartorii
MDKGEIAKKARILQTKTDLLALLNEIKADDLGEKGYPFVLRQINYYCNPKNTKGRFVTFAILKKSGGIRNIAAPSNGLKMLQTYLNVILGSLYTPSSHVMGFVKGRSVITNASRHLNQNYVFNIDLKDFFSSIPQARVWKRLQLPPFSFPQEIANVIAGLCCIEMIVQDEQGQVRTKYVLPQGAPTSPVITNMICDTLDRRLSGLAARFGLNFSRYADDITFSSLHYVYSENGAFRKELKRIVEGQNFTINEAKTRLQKKGDRHEVTGLIVSDRVNVSRTYVRNLRSLLYIWEKYGYDAANEKFVYYYLDDKPASSTCMPNMVNVIEGKLQYLKMVKGGDNPVYLNLYSKFELLQYIYHNKDNGEEQSMSDVESMLHQSSMSVEGVVAQWKNRDIFSITGTLLNECKRSVSPLIVKKVAASLMAYLSASLVNNIKKRAELQWYMLRDINDAMNGQPRTRKIDGEEEKIHRPKLVVAFLKQFTSTENLKYTTHTWERMIDGKYKWTDFDQFFHSYESELKDKTGSGIPIFDIYNCNIHLYNLVRNFLLPPSKEEYPWQTDYGLKLSYCTPEGVIQNWMKENPDKQPMEIPLSVFPESYRPKQRVQGQTLVDFRDVIDIFKNAIEYRDDNLYWDVSDIFKLTDFSLDDSVLDTLSGITFYTDTILVREALKIIADNIIVRPQHRHLKVQAIRGKDGDQKYVSLEILHVESFSNKSLDDDKLQLKGNKGQLSAVKQKLVSLCDFSVESRFRKGDEMGDYRIDYLYSEEVNAEPRVTKLDAPAEGFKYILKFYL

SEQ ID NO: 47 - protein, 476 aa, unidentified
  source 1..476: note = Related to JAFVAP010000165.1; note = Bacteroidales bacterium
MDLPQIKKKATELETKENLLDLLNEIKQEDLQEQAYPFTIKQLNYYCNPNRTKNRYITFEIPKKAGGTRVISSPSNGLKSILHYLNYILQSIHTPSKFAMGFVKGKSIIDNASQHTNQNYVFNIDLKDFFPSIHQARVWKRLQLPPFNFNKEIASIVAGLCCMKVEPQEENEKPLYVLPQGAPTSPTITNIICDNLDRRLGGLAKRFGLRYSRYADDITFSSMHNVYQNDSDFRKELERIITDQHFTINEKKTRLQKLGSRQEVTGLIVSHKINVTKKYVREIRSLLYMWEKYGYNVAYCKFFPKYTEEKGRIYEGIPDLISVIAGKLMYLKMVKGDGDTMYTRLFAKFQKLANKETIAEKTNLAGVTYLGTIGILEFEKYISTTIIFEITEKCNLYAYFKFNEKKIMVSVNKSLKHSLTLEEAMDKGELAISLCRGKEGKPFWLIHRKDKVLVPPLPLVDVDELNVKLDSLLLFS

SEQ ID NO: 48 - protein, 506 aa, unidentified
  source 1..506: note = Related to JAGBAX010000023.1; note = Alistipes sp.
MERSEIHYQASGVKTTLDLAQLLSEIKEDALGIIKARAFQEKQITYYCNPKRTDRKRYINFTIPKKSGGERTISAPVRGLKSILFSLNTLLQALYEPSKYAMGFTQGRSVVDNAKIHIGQRYIYNIDLKDFFPSIDKSRVWKRLTLPPFNFNSDIAHTIAGLCTMRIVEDGKERFVLPQGAPTSPILTNAICDTLDRRLGAVAKRFGLRYSRYADDITFSSMHYVYGKDSEFIKELHRVIKSQNFTINESKTRLQSLGYRQEVTGVIISDKINVAKRYTREIKTLLHIWDRYGYMAACESYTKSHHVKNDNFKRVGYPKLESVIAGKLQYMKMVKGAEDAVYQTLQTKFSTLVKGIKKIEFTIGGRDIAYLQTMTREQFRKEKLADITIDATNKVAYYEFGDQKHNIVISRSISEDILSQLATSPANDECWNKYRISLCENNNVQFYLLHKCFKERKFRVRTDIKLEDIDNIFTYLDSPNNRNENNKITDKKSSNIFERVIGWLRR

SEQ ID NO: 49 - protein, 497 aa, unidentified
  source 1..497: note = Related to JAFYXB010000050.1; note = Alistipes sp.
MISTDEIKHDFAAIEAPKDLLNLLNKVKRSVLGGKYHPFSFDQLFYYSNPRREDVVRYHSFTIPKRSGGTRTISSPVAGLKSILTTLNDIFQAIYRPSKQAMGFAAKRSVVTNAQIHVGQRYIFNTDLKDFFTSINRSRVWRRLTLKPFSLSDDIADIVAGLCTMRDRDANGRVRYVLPQGAPTSPIITNMICDRLDAKLARLAKRFGLRYSRYADDITFSSMHFVYGKGGRFISELHDIITAEGFEINDTKTRLQHLGIRQKVTGLVVSERVNVSKEYARELKLLIHIWLRYGYLHALDSYTQKHQHTKGGIANLEAIIKGKLNYMRMVKGANDAMVQRLQAAFNELKHDSIRLEHRFDSWLPTLTFNATYTRSEIEALEGISLKLRVDTTKVCAYLAIDGNEYPVTISRHISSATRLELMHSESNSAVWRNHRISICSNEAGSFILLHKRLRRYKPKAEAETESYKVIDIDTFIAMLNATEQDFHLETLCLNAPF

SEQ ID NO: 50 - protein, 503 aa, unidentified
  source 1..503: note = Related to JAFVXG010000004.1; note = Rikenellaceae bacterium
MNRQEIQQAVAAIKSTEDFVLLLNKVKREALGGKAYDFKLKQITYYCDPKRENIERYRHFTIPKKGGGERQISAPVPPLKSILFSLNTILQAIYEPSSHVMGFVQGRSVVDNAKMHIGQTYVYNIDLKDFFPSIDKSRVWKRLTLPPMNLSSDLAHLVAGLCTMRLEEGENVRYVLPQGAPTSPVITNMICDNLDRQLLKLAKRFGLRYSRYADDITFSSMHYVYNENGAFVKALRRIIEKQRFTINPRKTRLQQPNQRREVTGLVVSDKVNVTRQYTRELKTLLHIWQTYGYMDARESYRRARIKSMTVFDKKEGFDLAAVVSGKLLYMKMVKGEDDPVYRRLYKQYRDVYVNKQSEIYEAQATYIEYIQTMTKAEFEEKMQTRISINLDKSLNWAATYGEGESRGRLRLSSKITKEVLAELAADTTGEGAWSKYCISLCNNGASQFYMVHRPLVPKQYTTAVRFLMEELQAELEEIGIDNLLEELDDLKANPEKLNVVKTL

SEQ ID NO: 51 - protein, 503 aa, unidentified
  source 1..503: note = Related to JAFWYW010000205.1; note = Alistipes sp.
MNTQEIRQTVKAMKSTEDLLHLLNQVKQDALGDKSHPFHLKQITYYCNPKRENVVRYRHFTIPKKGGGERQISAPVNGLKSILFSLNTILQAIYEPSSYAMGFVAGRSVVNNAKMHIGQRYVYNIDLKDFFPSIDKSRVWKRLTLPPMNLSSDLAHLVAGLCTMRLEEGENVRYVLPQGAPTSPVITNMICDSLDRQLAKLAKRFGLRYSRYADDITFSSMHYVYSENGAFVQALNKIIEKQHFTINPRKTRLQQPNQRREVTGLVVSNKVNVTRQYTRELKTILHIWEKYGYMAARESYRRARIKSMTFFDKKDGFDLAPVVLGKLLYMKMVKGENDSVYKRLMGQYRDLTKADNGVTYQAKHTKLTYLQTMAKAEFERQLLTSLMIDVEAPKLRKVYFAEGESNRYLRTSGKITDEVLAELAADVEGVGIWSKYRISLCDNGHSQFYMLHKKLVEVQYTEAVLLQLEELQAELEEIGIDNLMAEFANFQAHPEQYEVLLTL

SEQ ID NO: 52 - protein, 536 aa, unidentified
  source 1..536: note = Related to JAFXAS010000015.1; note = Alistipes sp.
MGREQIRTAALEIKNIKDLRRVLNLVKRDALGDKAHPFHLKQITYYSNPRRAEVVRYKDFTIPKKCGGVRNISAPVAGLKSILTSLNTILQAIYEPSKYAMGFVPGRSVVDNAKIHLGQNYIYNIDLQDFFPSIDKSRVWKRLTLPPFNFTSELADVIAGLCAMRMEIEGNGSRCVLPQGAPTSPTLTNIICEKLDRQLGGLAKRFGARYSRYADDITFSSMQYIYAADGEFMAELHHIIATNRFTINEKKTRLQKKGERQEVTGLVLSDKVNVMRRYARELRTLLHIWEKYGHLAACESYMKVRKANPVYRHKGGMPTLDAVLMGKLQYLKMVKGEEDTTYKALYARFCKLTNKAPQGVKYPTPYSSHIVYLHTMSRSEFEEALRTTIKYREDKEPKLYFVIGDVERPITWSHSVPIGQLLENSEDGYKLWGKYQISLCDNGTTQFYMLHKRLVAPPYTNDGRKLTERLQKELAALVDSDIFTQVLGVDEEPMCPKIDPSEGEQLALKNEKWNDALDIMARLEDMDIPEPPEVTL

SEQ ID NO: 53 - protein, 458 aa, unidentified
  source 1..458: note = Related to JAGBZI010000078.1; note = Proposed Tidjanibacter sp.
MRDIRDLRSLLNRVKRDALGDNAHPFHLRQITYYSDPRRTDVVRYKSFAIPKKSGGVRAISAPVAGLKSILTSLNTILQAAYEPTRYAMGFVEGRSVVDNARVHLGQNYVFNIDLEDFFPSIDKSRVWRRLTLPPFNFSVELADVVAGLCTMRVEAECEGDKPRYVLPQGAPTSPTISNIICESLDRQLAGLAKRFGAKYSRYADDITFSSMTYIYSAEGEFVAELRRIIAANRFTINEKKTRLQKVGQHQEVTGLVLSDKVNVARNYTRELRTLLHIWDKHGFMNATVCLMRARDKNPVHRHKWGKPSLEAVVGGKLNYLKMVKGEKDSTYRNLYEIFERCYSRDKRYFAREDTKVGGLKFLITMDVFTFMATMNILLEYNKGGSPEVFFRWGDYKCPISVSRMVPVAKLFENAGEGICKMNNFELSLCDDGSTRFFLLHRRLPISSWMKFKLVDEL

SEQ ID NO: 54 - protein, 529 aa, unidentified
  source 1..529: note = Proposed Tidjanibacter sp.; note = Related to JAFTUI010000023.1
MERTEIRTTALAMKNIKDLRRLLNQVKQDALGDKFRPFHLNQITYHCNPKRATHQRYKNFTIPKKSGGERVISAPVAGLKSILFSLNTILQAIYEPSKYAMGFVQGRSVVDNAKLHLGQNYIYNLDLKDFFPSIDKSRLWKRLTLPPFNFPSELSDVIAGLCTMRLEEDGKETRYVLPQGAPTSPTITNIICEKLDRQLGGLAKRFGAKYSRYADDITFSSMNYIYSNEGEFIKELHRIIADNHFTINEKKTRLQKVGERQEVTGLILSDKVNVVRTYTREVRTLLHIWEKFGHMAACESYMRARKLNPTHRHKGGMPSLDAVLMGKLQYLKMVKGAEDATYKALNSRFAKLQGQELAPIKYAKKPLAYVHTMNREEFEETLSSQIEYNPETTPALFFKVGDDIRPITVSQTVPVKELFAKGDEAAELWRKYQISLCDNGISLFYMLHKKLVAPQHTKAGKRKTVELQEELSALVESDIFSQVLNEDKVDGKNYKVVSMEDIASDRVEIANRERLIALMEADIPEPDNL

SEQ ID NO: 55 - protein, 518 aa, unidentified
  source 1..518: note = Related to JAFNYI010000087.1; note = Alistipes sp.
MRDVRDLRLLLNRAKRGALGAKAYPIHLRQITYYADPRREDVLRYRNFPIPKKSGGERLISLPVDGLKSILRALNTLLQALYQPTAYAMGFVQGRSVVDNARVHLGQNYVYNIDLKDFFTSIDKSRVWRRLTLPPYNLPSQLADIVAGLCTMRLEEGDKVRYVLPQGAPTSPTLTNIICEKLDRQLAGLARRFGLRYTRYADDITFSSMHYVYSSDGEFVTSLRQIIEQNHFVINETKSRLQYRGERQEVTGIVLSDRLNVARQYTRELRTLLHIWQRYGYLAARESYLNHHAEGSKCRLCIRDTRLESSIMGKLQYLRMVKGETDALYMRLKQRFDELMKEKGSAVKYAKYGEFSYLYTVDVPLFESTFNTRICYNAESDVKLYFVDGGVIKPIALSSRLDAGKLFASDNDENRWHGLQISLCESHSTQFYMLHRRLVNPLFSKPRHKKRSSPMDEYVELFNSNANSALIDEFFFRNYGRRMTIDDLGDVVAQSDESGAISELAHILDADITVLAPK

SEQ ID NO: 56 - protein, 473 aa, unidentified
  source 1..473: note = Bacteroidaceae bacterium; note = Related to JAFUSZ010000030.1
MEREVLIMRVERMKDKEDLLALLNDVKADELGDKSYPFTMKQINFYCNPTSVPNSKRYNDFFIAKKSGGMRHISAPVNGLKSIQTYLNIIFQAIYEPSQWAMGFAQHRSVVNNAQMHIGQNYVFNLDIKDFFPSIPQARIWGRLQVKPFNFNKQLANVIAGLCCMKVVTEESERYILPQGAPTSPLLTNAICDKLDFKLSRLAQRYGLNYSRYADDITFSSMHNVYQKESRFLRTLFQIIQEQGFCINEAKTRLQKRGSRQEVTGLIVSNKVNVTRKYTEDIRNILYIWQRYGLTVAYQKFSKYYKKEKGHVKQGEPTMENVLAGKLDYLKMVKGESDSTYLKLKGTYDTLMNHILEGADGSIKYIDTHSISDFEKNLKTKIEIKKSKKGKQFASFILDGDEKIVSISKNAEDITRDKLFISLCEDNEKKRFYFIHRQMWKRGLETKRTEENSLDLDEILAQLCNSNFDLSLL

SEQ ID NO: 57 - protein, 473 aa, unidentified
  source 1..473: note = Related to SUYG01000053.1; note = Prevotella sp.
MDREKIKLRVEHMKDKTDLLALLNDIKADELGDRGFPFTMKQINFYCNPFSIPNSKRYHDFFIAKKSGGARHISAPVNGLKSIQTYLNIIFQAIYEPSRWAMGFAQNRSVVDNAQMHIAQNYVFNMDLKDFFPSIPQARVWGRLKVPPFNFNPELASVIAGLCCMKLVNEDSEKYILPQGAPTSPLLTNAICDKLDYKLAKLASHYGLIYSRYADDITFSSMHNVYQKDSRFMKTLFKIIQEQGFQVNEVKTRLQKKGSRQEVTGLIVSDKVNVTRKYVEDIRNILYIWQKYGLTTAYQRFIVHYQLEKGHIKKGAPHLENVIAGKLDYLKMVKGEDDSTYVKLRKLYNVLMGVPLYGNSETAIKYLDTQRITDFEKRIGTKVEMKLSKNGKKYASFLIDGEKQVATISKNSEKLEFTNLVISLCENQQKERFYFVHRPFGKDVDVKKKKHSSMTLDEILAKLCETNFDLSYL

SEQ ID NO: 58 - protein, 382 aa, unidentified
  source 1..382: note = Lentimicrobiaceae bacterium; note = Related to SUWU01000046.1
MDKERIIETLNTHDCKTALLTLLNDAKQEYLGDKAYPFELRQITFYSNPASDVKRYKDFEIPKKSGGTRKISAPVEGLKIILKCMNMILQEIYEPSKYAMGFAKNRSVVDNAKRHINQNYVFNIDLKDFFPSITRARICARLKVKPFEFSDDIARMISGLCTMKVTDGENIKYVLPQGAPTSPTLTNIICDKLDHKLAGLAKRFGLNYSRYADDITFSSSHNVYQEESDFRKELQRIITEDGFVINDKKTRLQKRGGRQEVTGVIVCEKANVTKKYVKEIRNLLYIWERYGYDEAVKRFHPRYKAEKGYTKKGNPNLDAVLGGKLLYLKMVKGENDSVYKRLQGKYDHLMEVKNPIINQTDNQTNNEALISELENLLDELLK

SEQ ID NO: 59 - protein, 789 aa, unidentified
  source 1..789: note = Related to JAFUDU010000007.1; note = Prevotella sp.
MTQSDIISLVSQLETKEDLLALLNKLKFEDLGERSFSFNIRQLNYYANPNHTKGRYRSFEVPKKKKGAMRTISAPSNGLKMLLRYVNVILQALYRPGENTMGFVHGRSVRDNASRHNHQNYILNLDLADFFPSISQARVWKRLQCPPYNLAKPIADIIAGLTAVKEVTTDESGNECVRYVLPQGAPTSPVLTNIICERLDRRLQGVGKRFGANYTRYADDITFSSMHNIYQQDGEFMQEVIRIIQDQGFAVNKEKTRLLKKGSRQEVTGVIVGDKVNVGRDYIRSIRSLLHIWEAFGYTAASAKFRQQHLKDKNGYVKGEPAMESVIAGKLQYVRMLKGYDDPVYQRLRQKLDWLLGMSDPEAAILQNPDYKVLETMPLPTFEEQNACQVQFSMSPNGNRYAFYHQRDNRMTVSVSHDITQTVKPFLAISLCQRRDGSRFHLIHKPIPQVPVRQEPAVKEIEIRHWHQPAMVTGFLRRFTEKGALKYTTHLWTPAEDGSYQWQDFETFYQSYRKELYEKKDDQININDLYHYVPTLNALIRNFLIESKSPSLYWSKEYKLAVSYGSPKGFIADWMRQTGKQPFEMPLAELPKEYVPAAPVQGRTLVYFNDVVGIFKNAIEFRDDQFYYAVKGIFKSVYHHVDQQKLSTLRGLSFYTDTFQVKKALRLIASNMESRTEYPEVEISAQYIDGDDNSPRRLRVTILQRDSFSDKSIYDDKLLLRHGSGQMGSIKSLLRSLCDFSVESRFRAHDDFLHYRIDYLYTTDADAPPCLVQLDKPTEGFKYILTFAL

SEQ ID NO: 60 - protein, 515 aa, unidentified
  source 1..515: note = Bacteroidales bacterium; note = Related to JAFRXO010000051.1
MTKEAIVTAASKVQTTRDFLNLLNKIKMDDLGDKGHPFIMPHLNYFIHPARNKKSYKEFRIPKKTGGFRVISAPKALLKSFLTYTNKLLQAFYDAPDYVTGFVPEKSVVDNAEKHIGMNYVFNTDLQDFFPSISKSRVWATLKFPPFNFNDTVADAISGLCCTEIYVNGETRRALPQGSPCSPILTNIVCRNLDRRLHRLAKEYNLRFSRYADDITFSSNRNVFQKGSEFRNKLEGIITEQHFIFNEKKTRLQTKCQRQEVTGLIVSDRVNVTREFVRELDNLLFIWEKYGEADAYAKFLLHYTPKQNFHSYKPNMQAVIQGKLLYIKMVKGADNEVWRRLQRRFNKLSGAKPSTVEATLKYKYTIADFEKKIGQALDFELNKDGVIYCTFSLNGKKTSVALSHYVRTRISNILAKSDTAALEKFKTSYMLVFYEQDNTNFWRIERKRTWVKTNLADLIDTSSLAEALLSASAISEKGDELTSTPMKSTDEVLAALVDSDFDLKILDEWDKIRSS

SEQ ID NO: 61 - protein, 521 aa, unidentified
  source 1..521: note = Related to JAFQZW010000007.1; note = Bacteroidales bacterium
MNKEAIVEEASKLESTHDLLILLNKIKMDELGDKGYPFTMPQLNYYINPIRNKKSYRNFRIPKKSGGYREISAPKAILKSLLTYTNKILQALYEAPGSITGFVTGKSVVDNAEKHIGRNYIFNIDLQDFFPSISKSRVWATLKLPPYKFNDTIADAIAGLCCTEIVIDGETRRALPQGSPCSPILTNIVCRNLDRQLNKLAKKYNLTYSRYADDITFSSNHNVYQKDSEFRQELDDIIKKQNFSINSKKTRLQQKNHRQEVTGLVVSDRVNVTKDYVRDIDNILYIWDHYSEDDAYARFLTHYSPKHNLKHRIPNLSSIIQGRLNYLKMVKGADNEVWRRLQRKFNKLTGTNKSSNDENANIKYIYSIPDFEKKVETQIIVTLGSNDNVYCYFTINNYKTSVNLSKYVKTRLKNIVSENNQDLLKRFMANCILIFYEKEGSCYWKIERRRKHSMISDPKDFDLNLLLLKIEEVTLEPKKSSIAQTDNTSTSKSTTDEILDELVDSGFDLNILDKWDKIKSS

SEQ ID NO: 62 - protein, 515 aa, unidentified
  source 1..515: note = Bacteroidaceae bacterium; note = Related to JAFZZI010000013.1
MTKEAIVAAAAKVKSTHDLLILLNKIKMDDLGGKGYPFIMPHLNYFIHPARNKKSYKEFRIPKKSGGFRVISAPKNMLKSFLTYTNKLLQAFYEGPEYVTGFVPEKSVVDNAERHVGMNYVFNTDLKDFFPSITKSRVWATLKRPPFNFNDTVADAIAGICCTEMVIDGETRWVLPQGSPASPILTNIVCRNLDRMLHKLAKKYNLRYSRYADDITFSSNRNVFHKNGDFQKELIKIISSQNFSINEKKTRVQNKNQRHEVTGLVVSDRVNVTREYVRGLDNLLYIWEKHGEADAYAKFLAHYTPKQNLHPHKPNMRVVIQGKLLYLKMVKGADNEVWRRLQRRFNKLSGAKPSTVEATLKYKYTIADFEKKIGQTLAFEPNIDGVIFCSFNLNGKKTSVTLSQYVRTRLSNILVKNDAAALEKFKTSYMLVFYEHDNSGFWRIERKRTWVKTNLADLIDTSSLVEAPLSAAAIPEEREESTNTAGKSTDEVLAALVESDFDLKTLDEWDKIKSN

SEQ ID NO: 63 - protein, 454 aa, unidentified
  source 1..454: note = Paludibacteraceae bacterium; note = Related to JAFSJL010000028.1
MTKEAIIAAAKDIKTTHDLLKLLNNIKMSELGDKGYPFIMPHLNYFIHPARNKNSYKTFSIPKKSGGERTISAPTRLLKSFLTFTNRLLQAFYEAPDYVTGFVPEKSVVDNAERHIGMNYVFNTDLKDFFPSITKSRVWATLKHQPFNFNDTIADAIAGLCCTEMEIGGKSQWVLPQGSPCSPVLTNIVCRTLDHKLHKLAKKFNLRYSRYADDITFSGNRNVFHKDGEFIKKLNRVIAQQNFTVNEKKTRIQNKNQRQEVTGLVVSDRVNVTREYVRSLDNLLYIWEKHGESEAYTKFIVHYIPKQNPYKERPNMRSVILGKLQYLKMVKGSDNEVWRRLQSRFNQLSGVTPSIESAVIKYLYKVSDFEKKIGQKLKFEIFDKKVVRCFFPLNNQHTDVMLSRYARTRFSNLIVQDDFVKLEQIKSSYMLIFYEQGGSGFWRIERKRRQKLKT

SEQ ID NO: 64 - protein, 526 aa, unidentified
  source 1..526: note = Related to JAFUYF010000001.1; note = Bacteroidales bacterium
MTDKAIVAAASKLESTFDLLTLLNKIKEDELGDKAYPFKMDHLNYFINPKRNRASYRTFTIPKKSGGVRTISAPVKLLKSFLTYTNILLRAFYEAPDCVTGFVPAKSVVDNAEKHVGMNYVFNTDLKDFFPSISKSRVWATLKTRPFCFNDTVADAIAGLCCTYVNEKGEEDNIALPQGSPCSPILTNIVCHNLDWKLSGLARRFGLNYSRYADDITFSSMHNVYQEGGEFMAELRRIIEGQHFRINEKKTRLQKKGERQEVTGLVVSDRVNVAREYVRDLDNLLYIWKKHGRAAAFAKFSGRYIPKQDLKAPAFDMDRVVAGRLAYLRMVKGEESQVWRRLQKRYNTLSGKKEKTVGTDIKYLNFYTIENFSAATGLELHLVMDTISIPRETPEEAGVMRVPVAYFMSGDRRIDVELSHYMQTRLRNILESGDGKALAEFKHKYIIAYCHSSTGYFWMIIRSMPKMGNNADVSEKGAGFILSDLFCSEGESVLSDDKSTDQILSQLVASNFDLKILDQWDKIKNS

SEQ ID NO: 65 - protein, 487 aa, unidentified
  source 1..487: note = Bacteroidales bacterium; note = Related to JAFZME010000158.1
MTDTAIRQAASLMECQSDLLSLLNHIKVDELGGKAFPFTHDQLYHFCSPRRNRKHYHTFTIPKKSGGVRTISAPTKMLKSLLRCTNTLLKAFYDAPEDVTGFVRERSIVDNARAHAGMNYVFNTDLKDFFPSISKSRVWATLKTSPFNFNDRIADAVAGLCCTCLNGEDEPERIALPQGSPASPVLTNIVCRNLDRRLRGLARRFGLHYTRYADDITFSSMHNVYQEGGEFMAELRRIVLGQHFELNEKKTRLQVRSARQEVTGLVVNDKVNISRAYIRDLDNLLYIWQRHGRSAAFLKFVGRYVPKGVWFGQAHNMERVVAGRLAYIRMVKGECRAWRRLQDRFDRLIARGNHPVGSGGKDFIYTSFYTLDNFMKFSGLELQFILEDGRPKVFFVKDGVRTDITLSHYVRTRLRNILQSGSKEELRKFTARYIIAHCAFTYMSDAEGLFWLIIRSVPRKKIASLGNKDLAELITDLSLEKVEDEAL

SEQ ID NO: 66 - protein, 556 aa, unidentified
  source 1..556: note = Bacteroidales bacterium; note = Related to JAFUDT010000010.1
MNRDAIIKAASQMETLEDLRRLLNEIKEDEFGDKAYPFSERQLKYYINPKRNKQSYRQFTIPKKSGGVRAISAPIRILKSLQLCTNRILQAFYEAPDYVTGFVPARSVVDNAERHLGMNYVFNTDLKDFFPSISKSRVWATLKTRPFSFNDTIADAIAGLCCTELELDGETRVALPQGSPCSPVLTNIVCHNLDWKLNGLARRFHLRYSRYADDITFSSNHNVYQPEGEFMIELRRIVNDQRLTINEKKMRVQKKGQRQEVTGLVVSDRVNVTREYVRSLDSLLFIWEKHGEDVAFSNFLKHYVPKHNRRFRSPDMSKVILGKLMYLKMVKGEDSPVWQRLQVCYENLAHREPAASSDIQYLHSFAIDVFEKGSGVQLTFSMTDGKLKCLMEYKGREIRVCLSQYVQKRLAPIVESNNLEALEKLKKQLHIGYCMASLLETSVVNHFWLLYRKRPVVKDLPITLTEEKEIQSHIERYLKESAGVRKASDRNINAGESMKESVSVTSEIGTEEKKVKAESEADSKTGKTIDEVLDVLVSKNFRDLSILDKWDKIKTN

SEQ ID NO: 67 - protein, 517 aa, unidentified
  source 1..517: note = Bacteroidales bacterium; note = Related to JAFYYM010000038.1
MTREAIVHAASKLETTHDLLVLLNRIKMDELGDKGHPFTMPQLNYFINPKRNSSHYKTFYIPKKSGGQREISAPTHILKSLQTYMNRILQAFYEAPEYVTGFVPSKSIVDNAERHIGMRYIFNSDLKDFFPSIPQARVWGTLQTRPFSFSKEIASAIAGLCCVEARDENGKLIHVLPQGSPCSPTLTNIVCHNLDWKLNGLAKRFHLKYSRYADDITFSSDHYVYQDDGEFFREFRRIVAEQHFKLNEKKTRTQKRGERQEVTGLVVSDRANVAREYVRDLDNLLYIWEKHGHNAAFAKFIARYTPKQDLKQSSPDMKSVIMGRLMYLRMVKGEDSLVWRRLQKRFNRLADKKESCGGTNIQYLHAYPIEAFEKAVGTDVSFTLEDDFVRCSFTLNGSAHSARLGKYAKTRIRSILESGNEDAMLKFKEKFHIGFCHMDGTPEEDHFWLIFRRPPRAKGLEITDVDEILSLTDYVGLPENGETDSADSLTTDATLEALVSSDFDLNTLDKWDKIKSN

SEQ ID NO: 68 - protein, 360 aa, unidentified
  source 1..360: note = Bacteroidales bacterium; note = Related to JAGBPC010000032.1
MTNLEIAHAASRVANLPGLLALLNRIKEDEFGNRVYPFTLQELNYYINPKRSRSGYRIFSIPKKNGGDRTIASPVKILKSFQICVNRLLQALYEVPECVCGFVPGRSVADNAARHTGMRFVFNADLQDFFTSIPQARVWGALKTRPFSFPPVIASALAGLCCMEVDGADGPRYVLPQGGPASPVITNIVCHNLDWKLSGLARRFHLHYSRYADDITFSGDHFVYEEGGVFLTEFRRIVAEQNFRLNDKKTRLNRRGERQEVTGLVVSDRVNVPREYVRDLDNLLFIWERYGRDAAYAKFLSRYTPKKGRMVKKPDMEAVVRGRISYLKMVKGADSPVWKRLRKRFDILIGRAYFSTTTCS

SEQ ID NO: 69 - protein, 503 aa, unidentified
  source 1..503: note = Related to JAAYJQ010000010.1; note = Bacteroidales bacterium
MNRQEIIAATAKLETRYDLLILLNRIKVDELGEKAHPFTIRQLNHFCHPHRNTCSYKVFTIPKKSGGFRTISAPGRLLLSLLTYTNRIFQAVYEAPSCTVGFVPGRSVVDNAKMHVGRDYVFNTDLQDFFPSITQARVWATLQLPPFSFNKTIANALAGLCCSEILINGEIRNALPQGAPTSPVLTNIICQKLDRRLTGLAKRFHVHYSRYADDITFSSDHDVYQEGGPFLTELKRIIGEQHFTINESKTRVQKKGARQEVTGLVVSDKVNVTREYVRGLDSLLYIWERYGRKEAVSSFLRHYTAKHNLKKQVPSMERVLRGRLMYMRMVKGEDDPVWRRLQRKFNGLSERETFPGNDVKYEASYRIEEFEQAIGTKVEFLSSGTESSTSRPSNAQPQAVFSLHGIIRSIYLSKYCKTRLEKVLDSGSEEEMDKFRKQCIISLCHRADDPDYHFWLIHRPGRVRSSVTVLEILGADEVFHSAESAAKDILNKLIDSNFDLSVL

SEQ ID NO: 70 - protein, 556 aa, unidentified
  source 1..556: note = Related to JAFOQL010000759.1; note = Bacteroidales bacterium
MVRNDLIIQECSRLASLKDLLFLLNRVKREEYGFGAHPFTMEQMLHFSDPRRNRRHYDTFAIPKRSGGQRTITAPRGMLKSFQKVANRVFQAFYNAPPCVQGFVTGRSVVGNAGIHVGMNYVFNSDLKDFFPSITQARIWTVLQAPPFNFPKRIASVLAGLCCTDLEYVMARCADGGTSVKGTSKAKSVLPQGSPASPILSNVVCKNLDRRLSGLAKRFGLRYSRYADDITFSSQHNVYQKDGPFMKEFQRIVRTEGFTINENKTRLSRRGQRQAVTGLTVNDMVNVPRKYVRDLDCLIHIWKRYGASDAYAKFLSRNMAKVSGAGLTYFPKMEDVLKGRLAYIGMVKGRHSPVYQRLLGKMDTVRHRTSLGAFRYVHSWRISEFESLTGFSLDMEKDPSGKWYCRFGPEGHRVFVCMSRWCRSRLTGILETNDQAALNEFKRMNRIGLCFDARSMNMEARCESQIVDELSPYLDGPYSGHRFFWMIFRRVSPNSGPHKSFFELVDKRVSKEGRELMKTLGLKPVSISKGPLLTNTDPVSPTDCFDDTYDFYIRPF

SEQ ID NO: 71 - protein, 491 aa, unidentified
  source 1..491: note = Bacteroidales bacterium; note = Related to JAFRXO010000051.1
MERQEIREAASLMTNRHSLLTLLNSLKKDDLGDKAHPFTMAQLNYFCHPTRNAKHYKVFTIPKKSGGVREISAPVKMLKSFQTYTNMLLQALYEPTSAAMGFVPGRSVVDNAMNHVGMNYVLNLDLKDFFPSIPQARVWGALKSKAIGFNQEVASAVAGLCCTEIDFYDGKPVLTTVDLPKGAKTEKRNVLPQGAPTSPILTNIVSRNLDRRLKHLAARFGLNYTRYADDITFSSMHNVYQEEGEFMTELRKIVAEQNFTINEKKTRFQKKGSRQEVTGLIVSDRVNVTREYVRSIGSLLYIWERYGYDSAFARFFQHYTLKVNRVSPPSMERVLQGKLMYLKMVKGEESLVWQRLQDRFDKVCSKKPVKVSDINYVAAYTMPAFEKQFSTEISFFAKEIPGKKEKGPVISYGASFKSGNEGIIISVSDSCKELIASAIGDEKAVTDLKKMLYVAYCKRGEFPYWLVMKSRPRNIYASTVRRKEGDLFFHG

SEQ ID NO: 72 - protein, 607 aa, unidentified
  source 1..607: note = Related to JAFYOT010000249.1; note = Bacteroidales bacterium
MNIILHNIIYYFRLNGNKLPVHKEKTIQVCLERFINVSMTQKQIIGKVHGLKTKMDLLNLLNALKKEDLGKDYHRFTLAQLNYYCNPNRTPHKRYRNFTIPKKSGGVRNISAPVRGLKSMLTYLNIVLQAMYQPTDAAMGFVPGRSIADNAAMHTCRNYVFNTDLKDFFPSIQQPRIWKILQLKPFSLNKELASVIAGLCCMQDANGNGVLPQGSPCSPILTNIVCRNLDRRLTGLAKRFNLKYSRYADDITFSSDYNVFQDDSEFMNEFMRIVADQNFTINEKKTRLQKSGQRQEVTGLIVNKKVNIAKEYYRDIRSLLYIWSRYGKEQAYAKFCVRYKASKAYNAKKKGMPSMPAVISGKLLYLKMVMGEDSTAYAKLRDNFLKLCPEQKNVLKNTNLTYLASYRLDEFESAFGTNVKFEYKPFSNVSGKSKTMGSFLLEEEIVSVSVNVRCDSIVDKYLANPDEKELEKIKRRLYISLSERGNDRFWLITIARMNNEHKKSYKGSYVAKVKVRPEEIKKEGIELKREVYAEIIRPTEILENNDLDPTHPGPHYYNSTYRKWVPVDDEQFEDIPDSEEIDAMLASLVSSGFDLNTLKEWDKIKKN

SEQ ID NO: 73 - protein, 550 aa, unidentified
  source 1..550: note = Related to JAGBVU010000006.1; note = Bacteroidales bacterium
MSRTFISVGMNKQQIIEKVRGLKTKVDLLNLLNALKRDDLGKDCYRFTLNQINFYCNPNHNPSRRYKDFTIPKKSGGVRTISAPKGSLKSILTYLNVIFQAMYEPSEAAMGFVPGRSIADNAAMHVGRNYVFNTDLKDFFPSIHQARIWKMLQLKPFSLSTELASVIAGLCCMQDPNGTVDKSGKIIGVLPQGSPCSPILTNIICRNLDRKLLGLAKRFNIRYTRYADDITFSSDYNVFQEGSEFMKEFTRIVTEQRFKINGSKTRLQKSGQRQEVTGLVVNKKVNVTRDYYRDLRSLLYIWQRYGKEQAYAKFCIRYKESKTYKRKQNEMPDIVAVVSGKLLYMKMVMGEESTAYLSLKNKFISLCPEQKQILDTNLHYLASYRLDEFERAFNTQVVFAYKPQNRVVGKSKTMGTFVLGEEKHVVAINIRCDSIIDKYLSAPDDKLMKGLRKRLYITLSERGSERFWLVTIARMNNEHSRSFNESYKAKVRNEIETNSGEPVDVIDSMYEMDVYDCFPENIDIDGLLSEFVKSEFDFNTLNSWDKIRKN

SEQ ID NO: 74 - protein, 664 aa, unidentified
  source 1..664: note = Related to NPJH01000006.1; note = Prevotella sp.
MKDISTLRCEIKKMRTHLDLFYVLNEVKKHYAETEGISFYPINRSNFEYYISSKTNRNQYYKEFDIRKKYNDGKRHIIAPFMGLKDIQKAISLMLQLIYTPYNNVNGFVQGRCIMQNAYPHVFQNYIFNIDIKDFFPSIHQARVWKKLQLPPLNFPVAIANAIANVCCYELINDDDTKIGVLPQGAPSSPILSNIVCERLDWKLRKLARENNLIYTRYADDMTFSGMYNAFSPKSEFIIKLYATIHEENFVVNESKTSLMKRGAHQEVTGLVISDKVNVPRSYIREIRSLLYIWERFGEKTASYRFALHNSNRKDKTLSEIGTLENVLLGKIEYVKMVKGANDSTYLALKGRLDKLLGAELSKKEKRRESREKKLRKVVPHNLEETQKFFHLFDYPEGFKYLTHDFPEGEEWSVDKLKEQCIGILKNYSNYSQIPTSLWALVNVFVIGKYYKKTDWIDYEGHDQRITYSDFVGGEGHPILGDHKEVIERFKNTIRVRMRCLYNLCVSWNDPKYGLNITMDKNELNKADFYTNVFILKKSVQRIFQMFASRNDKKDVNIHYHKEDIKNRRCHILTITQQDSYSEKGVDELRPKLHGGGGDFATLKHDLSGYCNWSVLSVWNEKPAKWNILRESDVDEIEEVTDKPVGFTHILTFYGNKLEEDIHH

SEQ ID NO: 75 - protein, 628 aa, unidentified
  source 1..628: note = Related to NZ_LT985324.1; note = Prevotella sp.
MAKEFGVEYYPISWEDYCYFSSPKRSVRNYISFEIPKKSGGYRHISAPVRGLKEIQKCLNYLLELMYYPKDNVTGFVRGKSIVDNASPHIGKNYIFNVDLQDFFPSIDQARVWKKLQLRPLCLTKEVASAIAGLCSMEIEDEKGNKRYVLPQGAPTSPMLSNIVCERLDWKLSGVARRFGLTYTRYADDITFSSMHNVYQHDGDFCKELRHIIEDEHFTLNTSKVKLQKRGGHQEVTGLVISDKVNVPKAYVREIRSLLFMWECYSYAVASQKYALYHNAYVKHRTYGEFVSLENVLDGKIEYLKMIKGCKNPLYLTLRSRLDKLIGKSTKKNKDCEVIEVVNNKKEVKKHDIEATYEVLHLFEEPNGLKFLTHDFPDASWSIDKLLKQCRTVFNEEAKGHPNIPQSLYSLVHTFMSGVSNNIKGWLGYDEKLHTETWNDWEKKKEHPIKRYGDIIDIFRNTIRIRSPKLFDLIKALEGQNTQFVFDYDSKELKKADFYTNVYMLRWCLVHVLLMFGQYPEHKELNISCTRSSMNGWIVYTIQFTQVGSFPSADINDAIKRVNEGAGDLGVIKEKMRSYCNWSIISKWNDKNLRWNILRSEGVKEIEEIAEQTIGFTHEFVFYKIKSN

SEQ ID NO: 76 - protein, 380 aa, unidentified
  source 1..380: note = Bacteroidales bacterium; note = Related to JAFZIR010000019.1
MNRETIAEKAEKMTEKQDLLHLLNEVKVDMLGDKAHPFSLRQLCYYCNPRVNRKRYTDFEIPKKSGGKRRISAPVNGLKSILSCLNIIFQAMYEPSENAMGFAVGKSVVDNAKIHVGKNYVFNTDLKDFFPSIHQARVWKRLQLPPFNFNQNIANVMAGLCCMKVSSPEGDKYVLPQGAPTSPIITNMICDKLDRRLNGLANRFGLTYTRYADDITFSSMHNVYQEDGEFIKELRRIIEDQNFTINDSKTRLQRKGSRQEVTGLTVCAAPNVTKQYVHNIRSLLAIWEHHGYDIAYRRFLPRYIGEKGHVKKGSPNLDSVLAGKLLYLKMVKGADNPLYAKLQCRFDNLIGTMNGEMTSDTELRFLYTMGAKEFDFTHSK

SEQ ID NO: 77 - protein, 523 aa, unidentified
  source 1..523: note = Related to NZ_CP091788.1; note = Prevotella sp.
MDKFETRKRVSSLQTKADLLKLLNDLKVNDLQENAYPIPMKAINFYCNPAHEKRYKSFSIPKKSGGQRVISAPCRGLMSILTYLNVMFEAMYEPAPCVCGFAIGKSVVDNANNHVGKNYVFNLDMKDFFPSIQQARVWARLQAAPYNMKKDVANIIAGLCCMKTSDGKFVLPQGAPTSPILTNMICERLDRRLTGLARRFGLSYSRYADDITFSSMHFVYSGDGDFMKELNRIVSEEHFSLNDKKTRLQKNNVRQEVTGITVNEKANVTRKYVREIRQLLYIWKKYGYNDAYSKFYPKYKAEKGHVKKGEPVLENVLSGKLLYLKMVKGEEDSTYLRLRKQFDKLSGDTILHKSTSDEFKYILTYDLSNFIAVNSIIPFKLHIKDEDLQTTASGNYKGKMELNGEYMSVFISKGVLKQIRTAEQGDYTDMWKCYISLCESAKGRFWLIHRGKHDEATHNPAPQKTISQIIDIWAKKGLEKAKEVFENVHYPTGDSIDIKAILDVWEEKGADAAEQLYEQYVKQ

SEQ ID NO: 78 - protein, 555 aa, unidentified
  source 1..555: note = Related to HF989231.1; note = Prevotella sp.
MIAERAAQMKTRADLLLLLNDIRHDELAEAGREEDYHPFTQPKFNFYINPNHTQGRYREFYIPKRSGGRRRISAPRTGTYKYMLHALNLLLGSLYTPSLSAMGFAPGRSIVTGAEKHVGQHYVFNTDLRDFFPSVRRARVKARLLLPPFGFTEEVAIAVAGLCTVRVEAPGDDGQPARPIYVLPQGAPTSPLLTNAVCDRLDRRLTGLARRCGANYTRYADDITFSSPHNLCVEGSAFRAELARILAVEGFEMNEAKTRVQRSGQRQEVTGLVVNRRVNVCRHYVRSLRAVLYVWRRYGYDAALAALLRHDRVVPERRGRRRLPDLTRVIEGRLLFVRQVRGTADPLYARLQAAFDALVASMSAQKCENGLTFIWTVPLEQFEKQYGATVKIHFFPAEPTSQPTSSDSAAETNAPSADAQSAPTAMASCRFTLPRNRAKGGDTYDAQVELPLTVSRRLTPQTPREGMAVSFCRATKGIPFLLLHRQGAVTVAIITGSGMAGGSQPAGNAPGIFATLPVYGKRRLASAVQADQGEPPVDVDALLAELENYLTDHNG

SEQ ID NO: 79 - protein, 468 aa, unidentified
  source 1..468: note = Related to JAFZPB010000162.1; note = Muribaculaceae bacterium
MLYLLNDIITDAYGSQAATINMWQFNYFSNPNRCKGRYRSFQIPKKSGGARTISAPCKSLKYILRIVNILLQAIHKPSTAAKGFVPRLSIVDNAAPHVGKNYVLNLDLKDFFPSISEARVRARLMAKPFNFTDEVATTLAGLCSYRPYSKETAHQRIAPCVLPQGAPTSPTLTNAICDRLDMLLSGVARRFNLTYTRYADDITFSSNHYVFSRDGEFMTEVRRIIADQGFEINEKKTRLQRRHEHQEVTGLTVNEKVNTARRYARDIRNLLYIWNYHGIADAERSFLWNYDKRQRRVPDMINAISGKLEYLKMVKGANDPVYVRLSKKFESLQNGNTVLGYKIHKTWTINRFRFTHGYISVGYERNELLDRLKYDDIPDLFKNAVCIDGPHPYFYIEKRIKYQGQLYLHRQFLRVLRNIETEFLEFLNGGECRRTFFVSECTRKNKDGRLWKGFLVHHAISRDGSHFL

SEQ ID NO: 80 - protein, 575 aa, unidentified
  source 1..575: note = Related to MNQV01000214.1; note = Phocaeicola vulgatus
MNDLRTLISKINNLSDLTKVLNYFKHRETNSEENLFTEDVLESYANPSKKVARRYKTFYIPKKNGKLREISAPNRNLKEILHYLNMMLAEVYQAGPSAMGFVKGRSIVDNANLHVGQNYVLNLDLSDFFTSISQSRICKRLQLAPFNFNENVAKAISGLCCKKVVKGGKKGYALPQGSPTSPILTNAVCDFLDKKLRHLSTRNGVKYSRYADDMTFSSMHNIYQENDTFMKNLFSIIKEERFTVNPDKTRLQKRGERQEVTGLTVNDKVNTAHKYTRELRNVLYMWEKYGYKDTYTSFYKHYKATKGHIKKGEPVLENVIIGKLDFLKMVKGENDVVYTKLRSRFEALNPNIYDSKNTNSRSKVNYIELYSVVEFEKAFKTKIKFIMSGEGKLSAVYKNGKKENSIYVSNAVKDIVFTEKAKPRKNCRFTISSMESFFVALCRSNCVNYWMMLANEPARERHIHPKYNNLPINQLLKEWEEKGLEAAADLLSSILVDETFSSNGDRKEPALPKLGKKKRKKKSSMGVLEELMIEDYMDDMELQASLTDFEDEETIEYNTKAIMKLLKGDKDGKEE

SEQ ID NO: 81 - protein, 580 aa, unidentified
  source 1..580: note = Muribaculaceae bacterium; note = Related to JAFRRT010000017.1
MMERDKIFELSQKMKTVRHLAFILNKMKCEEFGTMEFPITAKQLRHFSSPKIADKRYKTFQIKKKSGGIREINAPCYQLKIILYFLNKILKAVFTPNDCVNGFAEGRSVVSNAQCHVGHHYVFNIDLKDFFPSIPQPRVWARLQLPPFNFSQEIANVVAGLCCHPNADGTNVLPQGAATSPLLTNAICDTLDRRMKGVAKRFGLHYSRYADDMTFSSMHNVYHEGSDFRLEIKRIIEEQGFKMNEKKTRLLRDGQRQEVTGLTVNSTVNVSRHYVKYLRWILHIWETEGYSKAYSKFYPKYKKEKGYIKKGEPVMENVIGGKLNYLRMVRGSNNAAYLKLQARYDKLQQLVFIDNETDKGESYIYVQPYKMAEFCQDFSTSIVLEISARNKLVGRCVLCGMDKTIAISKSTQKKLCPDLEKKKPGDVITSDLLPECHVTLCRSKGKNFWLITEFKPLRSIYLSIQNAQVNIDELLDIWDTLGLDSAVSAFMNSINVSNFKNNNSKEGSNINENGVLSKENNPGVLESSQEKHEQYIVGLGEKLPQNTKKVIDQHRQYDTGTDSSIIDVDDVDWDVLEYSI

SEQ ID NO: 82 - protein, 573 aa, unidentified
  source 1..573: note = Paludibacteraceae bacterium; note = Related to JAGCXD010000267.1
MKTVKHLAVLLNKMKCDEFGSRKHPITAKQLLHFSTPKIALKRYKTFQIRKKSGGVREINAPCYQLSIILYFLNQLLKAIFTPNECVNGFTEGRSVVTNAQRHIGHHYVFNIDLKDFFPSIPQPRVWARLQLPPFNFSQEIANVVAGLCCHPNADGTMNVLPQGAATSPLLTNAICDTLDRRMRGVAKRFGLHYSRYADDMTFSSMHNVYQDGSDFRLELKRIIEEQGFKMNEKKTRLLRDGQRQEVTGLTVNSSVNVSRKYIKDLRWILHIWETEGYAMAYSRFYPKYKKEKGYIKKGEPVMENVIGGKLNYLRMVRGDNNAAYLKLQARYDKLQQLVFVDNETDKGESYIYVQPYSIADFCNDFATSISLEVSTRKNLIGKCDLFGIEKIIAISKSTQRKLCPNLDSKEPGDIISSELLTKCHVTLCRSKGRNFWLITEFLPHRSKCLSIQNAQVDIDELLEIWDELGVEAAIKAFTDSFVADCVNLKTTVEPKDGPASKNTNAVVQVSGINPTDIERLLAMAGQAEQDPISFAEPISADDWDELNMGTDVDDVDFDDLNDIDKDNPIASI

SEQ ID NO: 83 - protein, 568 aa, unidentified
  source 1..568: note = Related to NZ_CP033459.1; note = Pseudoprevotella muciniphila
MEKAEIRDKAMVMKTTKNLARLLNTIKQEEFGSKRYKITPRQLYHFAYTNIAPNRYKTFHIHKKSGGLREINAPCYQLGIILYFLNKVFKSLYTPSSSVTGFTEGRSVYDNAKMHVGHHYVFNIDLKDFFPSISQGRVWTRLQLPPFNFTQEIANVVAGLCCHKNAGSTLNVLPQGAATSPILTNAVCDKLDRRMRGVAKRFGLHYSRYADDMTFSSMHNVYQEGSEFRCEVKRIIEEQGFQMNDAKTRLLRDGVRQEVTGLTVNSVVNVSRKYISDLRWIIRVWEKEGYAKAYSKFYPKYKKEKGYIKKGEPIMENVIGGKLNYLKMIRGENNPAYKKLQERYNRLQQVVYVDNETDKGTSYVYVQSYTMKEFQKYFATTVTLEVSAKGKLVGKCLLAGMEKIIPISLSTQKKLCPDLESKKSGEQVISKMLTKCHVTLCRAKGKNFWLITKYEPKRSKCFSIQNTKIDIDTLLNIWEQYGTEGAVDVFQQSIYNGQRISKEGIDGLILNFILESKYPKLDTNKTQKPQKSESETLSEEEMAQLSEFADLIDSSDIDELPFTIQLNP

SEQ ID NO: 84 - protein, 569 aa, unidentified
  source 1..569: note = Paludibacteraceae bacterium; note = Related to JAGCXD010000191.1
MEKNEIKYRLKNVKNLEDFAKLLNDVKIDEFKTAKYKITEKQLLHFCNPKTVPNRYKAFYIKKKSGGLREINAPCYQLGTILYILNIVFKAVYTPSESAMGFTEERSVVTNATFHIGHHYVFNIDLENFFPSIPQARVWKRIQHPPFNFPKEVANVVAGLCCHTNADKTKNVLPQGAATSPLLTNAICDTLDRRMRGVAKYYGLHYSRYADDMTFSSMHNVFEEGGDFRLEIKRIIEDQGFKINDKKTRLQRDNERQEVTGLTVNQRVNVSRKYVHDIRWILHCWEKDGYGKAYALFYDYYKRTKGYIKKGEPVMENVIGGKLNYMRMVKGENNATYRKLLERFLKLQGLVYVDTETDKGMSYIYVYSYPVSEFNALFKTDLSLEVSAKNKLIGKFQIEQRDKVLAISKRTQDYLCKDIAQKQPGEEVKTERLTSCFVTLCRAKGKNFWLLTKSEMKRSKCLSLLNAHIDIDKLLDIWEKRDINEASEALNYAITEGKPILTFEERMFENLNLSGFGILETVKGKSHSKSVSFESIADQLSKFESLENIEELLMENDLDDSLDIGEFKD

SEQ ID NO: 85 - protein, 530 aa, unidentified
  source 1..530: note = Related to FR900399.1; note = Prevotella sp.
MKLLNEIKLHEFGTNKHPITVKQLMHFSNAKLGDKRYTVFSIKKKSGGLREISKPCYQLKCILYVLNIFLRSLYTPRECVMGFTTGRSVVGNAAVHAAHHYVFNIDLKDFFPSIPQARVWARLQLKPFYFSKEVASIIAGLCCNRNSEGKNVLPQGAATSPLLTNAICDKLDRRMCGVAKRFGLHYSRYADDMTFSSMHNVYKDDSDFRKEIKRIIEDQGFTMNDKKTRLLRDGRRQEVTGLTVNSKVNVSRKYMQDLRWYISMWEKEGYAKAYSRFYISYKKEKGYIKKGEPVMENVIGGKLNYLRMVRGASDAAYQKLQQRFDKLQELVFVDNQTDKGAQFVYVQPYTYKEFTSLFNTDIQLEVSAGNKLVGKCTIDGIDKFISIVKAAQRQLCPTLDGRKAGDIVESSGLSKCYIALCRSKGKNFWLMSLKPLRRSKTLSIQNAKVNVDDLFALWNNEGFEKAAAAFDDFVNKSKAIPECKEKPKKEYLDGNNTLDIQSENNIVERSTSGCNFSEDDLLAAGADVDF

SEQ ID NO: 86 - protein, 955 aa, unidentified
  source 1..955: note = Bacteroidales bacterium; note = Related to JAFPVK010000006.1
MKKGNDILIPPAYFLNDYKEGFYIERPERDWSQCELWKNLPFVLEVGDNTIATIVKGADKRRLKYVYVHIYQSTNDGRWFLSPTWSDKILTEYPFQEVKTQEEIESRIAILKEKVKKLNEEQEQEIKLPIDEFIKKHISEIDTTRKLALFITKLMKTLFSEKHFVTEKQLLYFSTPKAGKRYKTFKIRKKNGGLREINAPVHHLDKILFVLNIIFKSLYTPNNAVMGFTEGKSIVDNAARHTGQHYVFNIDLKDFFTSIPQARVWGRIQCAPFNFSRAVANVVAGLCCATNSETGKNVLPQGAPTSPLLTNAICDRLDRQLTALSKKYGLHYSRYADDITFSSMHNVYQEDSDFRKKLKTIIEDQNFCINDKKTRLLRTGQRQEVTGLTVNSKVNVTRKYVRDIRYILHLWESKGYAFAYSKFYKFYKTEKGYIKKGEPVMENVIGGKLNYLRMIKGAGNECYQKLLQCYNKLQQIIYVDNNTDKGHNYVYVQQYTLTDFENDFKTKITLQISDDEKLVGKCNLFGMDKTISISHKTQEELCPIISHLKVGDTFTSELLKNCFVTLCRQKGKNFWLITHKELDRSRCLSIQNAQIESEKLLKEWEQKGFEFVVKQFQTEILKKSDVPDYVSERDIKEFIYFVTHSKNFDRKQKLQRDSLLARDMAKRKAQPQEFKPMSVSYTANFLANFNRPDGFKYLTHDFDTESNMTLPDLREQSYKLLESEKGKIPDSLYVLIYAYLSGKTWRDAFGDNNNISINDKKWIQWSKENDNAHPITNSDFESEILKFKKAIRIVPPLLQTIVDKICEKYELHVTTKKLDKADFYTNTYILSNVLDRILQMMKRRNENVDYQRDVEVSYKREITNDVVYKKIIILQKDSFPENTFEDVSTRMNNNTEAGDLGAIRKILNGYCYWSIETKWDDKSLRWNILSDDDAPETEPIEDTLAVGFRHILTFM

SEQ ID NO: 87 - protein, 1037 aa, unidentified
  source 1..1037: note = Bacteroidales bacterium; note = Related to JAFYAR010000035.1
MDKNKYITIKNAVFDNYNEDCFFFEIPSMDLSNANSWHHPFLLYDGTNIYSILRGADKSKLRFAYCYIHQSKKSGQFFFNISLTDKIIQKYNCKKISTKDEFETLKEQLKQKVKLLNKEYSQDVLPLDEFIKKNINSLNNTRDLAFFLTKIMKVIFSENHFVTENQLKYFCSPNIPNRYKTFKIQKKSGGLREINAPTNRLNKILCALNIVFKTIYTPHNAVSGFTQGKSIADNAIKHIGQNYVFNIDLKDFFTSIPQKRIWGRLHVHPFNLRGQVANVVAGLCCCKNSETGENVLPQGAPTSPLLTNAVCDKLDKQLFKLSKKYGLHYSRYADDITFSSMHNVYQEDSDFRRELKIIIEGQNFCINDKKTRLLRSGQRQEVTGLIVNSKTNVTRKYVRDLRYILHVWETKGYAVAYSIFYRFYKKEKGYIKKGEPVMENVIGGKLNYLRMIKGTSNECYQKLAQQFDRLQQIIYVDEDTDNSKQYVFVQSYTINEFEHLFNTKITLQISARKKLVGKCELYGSEKIIPISHLTQDELCPEITKFHVGDIVKNEKLDSFYITLCRQKGKNFWLIINKELIRSRCLSINDIIIDTENFFHLWETEGFIIVVKLFQFVLNKYGNFDTEKVVNFINDLSKRNEISKKKRLTKKRKLQIEEALKDDSFKKIKETEIQEFVYFITHYKQFTYKQKMYVNRLLTRDLATKYIEKTEIVIDDGKHRCGVRCEYISPKKLQKFLFDFNQDEVLKYTCHPIDSEEVIEEINKQCKTDIYSVEAHSKLILERFESKFKNVKSSRNMQGLIFAYLKGPKEWSSNRVVINWSSNELISWSNENKGKIASPGKNIAAKQKNYGFKLPNPFVSSINGQRVATFTNLVIFFKTLFHIRRDNSLKNIITYNNKSIENVNITFSSNFNENIELFTDVDKLLQAYKNIIKICTDCSLEGEQPVFEISFYKEENNVYFCIHHINTKYGKTLDDSLKRIGESQSNLIKNQINGLCDLFIEADFGNKEYARINLWDESDELKAQNIAEMQGVKYILRF

SEQ ID NO: 88 - protein, 892 aa, unidentified
  source 1..892: note = Paludibacteraceae bacterium; note = Related to JAFZLC010000057.1
MNFCFPDKMITNCENNILENERNLKISLKEHFEPIENIEEQGVSNKDNTKSLSIDKLIKEHIFKTDSPNKLAWLISKIMKEVISENYFVTEKQLKYLSTPKVSNRYKTFKIKKKSGGTREINAPTNRLNNILYSLNLIFKSLYSPHEAVCGFTEGRSIRDNALRHVGHHYVFNIDLKDFFTSIPQARIWARIQCAPFNFSPSVANVVAGLCCVYNEELGKNVLPQGAPTSPLLTNAICDKMDRKLAALAKKYGLHYSRYADDITFSSMHNVYQEESEFRKEMKNIIEGQGFCLNDKKTRLLKSGQRQEVTGLTVNSKVNVTRKYVKDLRCLLHIWETKGYNTAYSYFYPLYKKEKGHIKKGEPVMENVIGGKLNYLRMIKGESNACYQKLQQRYDKLQKIIYIDNNIDKDITFVYQQFVLQDFEKNFSTKISLQISPKEKLIGKCNIFGMEKMLSITLNTQKELCPNLNTLNVGDTVNSPILKDCYVSLCCQRGRNFWLISHKQLEGSKYLTIPYIKINPDILLKKWEETNLEYVAWKFYFAISNKIDISTLENSIQEFVYFVTHNKHFNNTQKLQVAKLLARDYQKSCEEQNDKLIYSQENKNNEGKIIEQQKIFDPIDTARFLSLFNEPTGLKYLTHDFDPDNCPETINELIEQTENVLKTKKRIPESLYALIENFSFGKKEWLDTFGKSHSSSIDKTDWIEWSENFHSHPINNPNFRNEIEIFRGTVRIDKGLLSKIIDVAAQNTALKIEKEKIDTADFYTNTYLLYLSIKRIFEMMNHRTEFPNVFVSYKRGHDENGAMLRKIIISQKGSFPQKTLQESIDRLNNHKEAGDFGAIKKYLNGYCFWSVETRWEGKSSRWNILRNANTPETEELDLESDGFTHILTFYLV

SEQ ID NO: 89 - protein, 649 aa, unidentified
  source 1..649: note = Related to JAAVFW010000009.1; note = Bacteroidales bacterium
MNLKDQNLINSDSKNKTKKRVLAHQFQGIFFNMGNSDLTEKRKKISTAEELAAVLDEIKQIEFASVRYSISVKMLRHFSSDKITPKRFRTFHIRKKSGGLREIKAPCKQLDVILTCVNILLKSIYEPSDVAMGFAPGRSVLNNAQVHVGHNYVFNIDLKDFFPSIPQARVWKRLQLAPFNFSQEIANILAGLCCSYDANVNANVLPQGSPASPLLTNTICDKLDRRMKGVAKRFGLHYSRYADDMTFSSMHNVYQAGSEFRLEIQRIISEQGFRMNDSKTRLQKRGFRQEVTGLTVNDIANVSRKYISDLRWMLHVWEKEGYAKAYALFYPKYKHEKEYIKKGEPVMENVIGGKLNYLRIVRGENNPAYRKLQARYNALQELVFVDNETDKSKSYVYVQPYALADFQELFNTTISLTVTREKKLVGKCIIDNREKTLSISKSTQKTLCPNLGNLNTGELVNSEELAECYVTLCRHKGKNFWLITKFEPKRSRCLSIQNLKITPDEILDYWDRYGLEKTIEDLTQFIQYADPEDSFKDWRLLADFEHTIDRGKFKISKKDLIVFFLKNKNVTSLHRKKAMQLMIDSIPINTDSENIDIEKLLDIWEEKGLDEAVLAWKEMSRKKKSKKKNPDPDPIVNDDAPQFDLVFDW

SEQ ID NO: 90 - protein, 650 aa, unidentified
  source 1..650: note = Related to JAAVDW010000016.1; note = Bacteroides sp.
MEKLDLTEKLKNINTAEQLATVLDEIKQIEFGSVRYSISVKMLRHFSSDTIAPKRFRTFHIRKKSRGLREIKAPCKQLDVILTCVNILLKSIYEPSDVVMGFTSGRSVLNNAQVHIGHNYVFNIDLKDFFPSIPQARVWKRLQLAPFNFSQEIANILAGLCCSYDANVKANVLPQGSPASPLLTNAICDKLDRRMKGVAKRFGLHYSRYADDMTFSSMHNVYQEGSEFRLEIQRIVSDQGFRMNDSKTRLQKTGSRQEVTGLTVNAIANVSRKYLSDLRWILHVWEKEGYAKAYAIFYPKYKDEKGYIKKGEPVMENVISGKLNYLRMVRGENNPAYRKLQARYDSLQELVFVDNETDKSKSYVYVQPYTVVDFEELFKTKLTLTVTRDKKLVGKCEIDNREKTLAISKTTQKLLCDNLDNLNAGDIVHSEELSECYVTLCRHKGKNFWLITKFEPKRSRCLSIQNLRIAPEEILDYWEKYGIEKTTEKLVLFVQFANPGDSLKDWNPSENSEHTIDRGSFKISKDDLIVFFLKNKNVTSLQRKKAMQLMIDSIPVNRYSENIDIEKLLDIWEEEGLDAAVLAWKEMSKINKSKPISHKKKANTKNQSSQDTFLEEIGISEEELASIQQEMAKCGGKPIGKPIAGSYSLV

SEQ ID NO: 91 - protein, 661 aa, unidentified
  source 1..661: note = Related to JAAVCY010000011.1; note = Bacteroides sp.
MENSNLTEKLKYISTAQELAVVLDEIKQIEFGSVRYSISVNMLKHFSSDTIAPKRFRTFHIRKKSGGLREIKAPCKQLEVILTCVNILLKTIYKPSDVAMGFTSGRSVLNNAQVHVGHNYVFNIDLKDFFPSIPQARVWKRLQLAPFNFSQEIANILAGLCCSYDPNVNANVLPQGSPASPLLTNAICDKLDRRMKGVAKRFGLHYSRYADDMTFSSMHNVYQEGSKFRIEIQRIISEQGFYMNERKTRLQKTGSRQEVTGLTVNAIANVSHKYISDLRWILHVWEKEGYAKAYAMFYPKYKHEKGYIKKGEPVMENVIGGKLNYLRMVRGENNPAYRKLQTRYDALQELVFVDNETDKSKSYVYVQPYTLVDFQELFSTTISLAVTREKKLVGKCVIDNREKTLAISKSTQKSLCPNLDNLNAGDLVISEELAKCYVTLCRHKGKNFWLITKFEPKRSCCLSIQNLRIAPEDILDYWEKYGIEKTVEELTLFVQFANSGDSLQNWNHSENFEQTIDRGGFNISKNDIIDFFLKNKNVTSLHRKKAMQLMIDSIPVNTDSENIDIVKLLDIWEEKGLDAAVLAWKEMSKTKKLKPNSTKKKATERDRSSQNTFLKEIGISVEDLAALQQEIGEGGGTPIDLDIDWDDIPFADDDSEIIGEL

SEQ ID NO: 92 - protein, 657 aa, unidentified
  source 1..657: note = Related to MNQI01000006.1; note = Bacteroidales bacterium 43_36
MNKTDILEQLKTMKTVEDLAVLLDAIKQDEFGSVRYSISAPMLKHFSSDKIAPKRFRVFHIRKKSGGEREIKAPCQQLYVILTCLNVMLKACYEPSDAAMGFTSGKSVLNNAQVHVGHNYVFNIDLKDFFPSIPQARVWKRLQLSPFNLSQDVANVLAGLCCAFDAEAGHNVLPQGSPASPLLTNSICDKLDRRMKGVAKRFGLHYSRYADDMTFSSMHNVYQDGSEFRQEILRIIEEQGFCMNDKKTRLQKKGARQEVTGLTVNAVANVSHKYISDLRWILHVWEKDGYAKAYALFYPKYKHEKGYIKKGEPVMENVIGGKLDYLRMVRGENNPAYQRLQARYYALQQLVFVDNETDKSNSYVYVQPYSMPEFHELFHTEVKLVITREGKLVGKCEIDGREKTLAISKSTQKSLCPDIESMHTGEIITSDELAKCFVTLCRNKGKNFWLITKFEPKRSRCLSIQNLNVSPEDILTLWEKEGLASTVEELTLYIQYANPTDSILSWNPLADSKNTIDRGSFNFTKEDIIAFFLKNKNVTASHRKRAMQLMMANIHEQSDGDGINVVELLNIWEKDGLDAAVKAWKESTNKQVQQKTKAKKSKSNSASKFTRETGFSKEAFGTFRQEIALDGGTPVEIDIDWDDIPFDIDDSGVIGGL

SEQ ID NO: 93 - protein, 488 aa, unidentified
  source 1..488: note = Related to JAAVFD010000014.1; note = Barnesiella sp.
MDKLVVIEQLKKMKTVKDVAVILDTIKRYEFGSISYNISEKMLKHFSSDTIARKRFRTFYIRKKSGGFREIKAPCQQLQVILTCLNILFKSIYEPSDVAMGFTSGRSVLNNAQIHVGFNYVFNIDLKDFFPSISQARVWKRLQLPPFNFSLEIANVLAGLCCTYDESLKLNVLPQGSPTSPLLTNAICDKLDRRMKGVAKRFGIHYSRYADDMTFSSMHNVYQEDGDFRVEISRIIDEQGFHINESKTRLQKKDTRQEVTGLTVNAVANVSRKYISDLRWILAIWEKDGYDKAQALFNPKYQQEKGYIKKCEPALVNVISGKLNYLRMIRGESNFAYQKLAKRFEVLQEIIFIHHKNDVKNFRINTKFELKYSRCLRNQNLKVSLDGLLDIWEKGGIESAVEELAESGYMSITSRDSIVSGNEHLLNYFLNNPKLTMTHRKRLIRLLLAYIPSKPLKTDIEQLLSIWEKEGLDAAVREWKKLKDNKAN

SEQ ID NO: 94 - protein, 523 aa, unidentified
  source 1..523: note = Related to JAFUKZ010000065.1; note = Muribaculaceae bacterium
MKKLEIRNRLIAIKTVEDLAELLNEIKKDEFGTNRYEITDKQLKFYSSDKYTSKRYRTFHIRKKSGGLREIKAPCYQLNIILRILNIALGAVFEPDSVAMGFAPGRSVVNNAQKHVGHNYVFNIDLKDFFPSIPQARVWKRLQLAPFNFSQEIANVVAGLCCSYNEERGQNVLPQGAPTSPLLTNAICCNLDRKMKGLAKRFGLHYSRYADDMTFSSMHNVYQEGGEFRKELLKIISEQGFTINDKKTRLLKTGCRQEVTGLTVNAIANVSRKYIQELRWILNAWEKYGYAKAYALFYPRYKSEKGYIKKGEPVMENVIGGKLDYMRMVRGANNVAYKRLQTRFDKLQQVVFIGSEEEQTQAKKFMYVQPYTMAEFKEYFHTEVSLTVTKNGKLVGKCTIAEMEKTLAISHATQDYLCPDLKQHKEGDCVESKKLEKCNVILCRAKGKNYWMITNKDHKRDKILSIQNVKINPDDLLDLWEKEGYKAAAEEITIDNRKGMPVLLTLPGLELERSFDIKRKDNE

SEQ ID NO: 95 - protein, 466 aa, unidentified
  source 1..466: note = Related to JAFYUK010000058.1; note = Muribaculaceae bacterium
MEKLEIRNSLIAIKSVEDLAELLNNIKNDKFKTSRHKITDKQLKYYSNNKYAPKRYRTFHIRKKNGGLREIKAPCYQLNIILRMLNIAFESVFEPDSVAMGFAPGRSVVNNAQMHIRHNYVFNLDLKDFFLSIPQARVWKRLQLAPFNFSLEIANVVAGLCCSYNEERDQNVLPQGAPTSPLLTNAICGNLDRKMKGLAKRFGLHYSRYADDMTFSSMHNVYKEGGEFRTELLKIISEQGFTVNDKKTRLHKAEHRQEVTGLTVNTKANVSRKYIQELRWILNVWDKYGYAKAYALFYPRYKSEMGHIKKGEPVMENVIGGKLDYLRMVRGATNPAYKKLQERFDKLQQVVFLETEEEQPKTQKFMYVQPYTMTEFKEYFLTEVSLIVTKKGKLVGKCTIAGMEKNLSISHAAQDFLCPKLNLCKEGDSVVNEKLNNCYVILCRAKGKNYWMIGLIGQKRNILKMK

SEQ ID NO: 96 - protein, 529 aa, unidentified
  source 1..529: note = Related to JAAVBM010000118.1; note = unidentified bacterium
MDNNTIIDRYKKIHDAGAFLGLLNAMKIEEYGEKTEKFSTRDLKVFIWPNNPERYSTFTIPKKSGGVRHISKPCPKLKYMLRYVKQFLQAFYNPMPCVQGFTTGRSVVGNAGMHLHQNYVYNVDLSDFFPSISQGRVWKRLQLPPYNFPVGLCNIIAGLACAPYETPEGVKYNALPQGAPTSPILSNIVCEQLDRRLTGLAKRFGLHYSRYADDMTFSSMHNVYQDNSEFIRELQRLITQQGFRFNEKKTRLQIRGSRQEVTGLTVGTKVNVSRRYIKELRSVLHVWEKFGYSEAFAWFYSRYKRDKGSLKKGEPVLEQVIEGKLNYLKMVKGNSDSTYKTLAGRIEACMTALDEERPKHGKRNVLVSYELKDFSTRFSNVSMDFSTSPDGIVSGSLTVDSVATPIYFDKIFRKLSSANKAKVLKAISQDTSDWFISEIEDLDKRYRNKFNHFWLISRYRPHQSTTVDKSEITRLLLELWEKDGLDAAVDEWKKLIKYDPSQKSESMQATSLQNPQNVLDSFFYEHLNK

SEQ ID NO: 97 - protein, 486 aa, unidentified
  source 1..486: note = Related to JABUTH010000081.1; note = Veillonella sp.
MERTEIANRVKAMISQEDLLQLINELKAEDLGDNAYPFSMRQLRYFCNPNNESRRYIHFDIKKKSGKEPRHITAPQKTLKMILTYLNQILQAVYEPLPCVMGFVSNRSVADNASKHIGKLYVYNIDLKDFFPSIDQARIWKKMQCPPFNFCNQEDPNAPQRRVLADMIAGFCCMKKPMEDGEIKQRYVLPQGSPCSPVLTNIICERMDRRLTGLAIRFGATYTRYADDMTFSSMHNIYQDDSEFIKELHRIISDQNFRINPAKTRLCTTKMRQEVTGLTVNEKANVSRKYLKELRRNLHNWEYYGYNEAYKRFYARYKMEVGHKKHGEPVMENVLGGKLLYLKMVKGESDPTYQKLQKRFDILVEAKEGRMSQYADSKFRYIVTYRIAEFEDIISTKIQIGVSDNGYKYAFYENGSKRTYISLSKNIGKEGIHTLFISLCENQKGKRFYLIHRAIEEKAKVETKQTLHLDAMLDKLLETNFDIDSI

SEQ ID NO: 98 - protein, 529 aa, unidentified
  source 1..529: note = Related to JAFZQM010000005.1; note = Bacteroidales bacterium
MTPNEIANEAKSLQTPTDLLELINKIRLSEDAQTHRALSLKELALYCNPDSSKVKRFRTFFIPKKSGGKREISAPVSKLDAFLWPLDLILKSVYEPKSCVMGFTYGRSIVDNAKAHLGQNYVLNLDLENFFPSITQGRVWKRLQVAPYNFAPKVASVIAGLCSIKKVNDDGETRYVLPQGAPTSPVLTNIICERLDRRLLGVAKRFNLRYTRYADDITFSSMHNALKIGGEAFQEIKHVIEEQGFAINSKKTRLQKVGERQEVTGLILSEKVNTPRSYVRDLDQILYVWDKWGYEKAYARMMLVKGEKAYRKNGLTTLERVIGGKLDYLKMVKGENDKVYLKYLSLFNRLKKQGAHSDDSLNYVATYTVASFQELFKTDLIFKEEGEHIRASFRLNDVFHPVRITSFASKAISDKGKEKESLYISLCEDENLFWLIHIREPKAAPSTDLILPIKKIIKIWEEKGLAAAIKAEEEARKKQSRAEETKKPTLRAMMMAKYFPELAEIEGEFKDLPSLMDMINHLEEDGETN

SEQ ID NO: 99 - protein, 584 aa, unidentified
  source 1..584: note = Paludibacteraceae bacterium; note = Related to JAFXVO010000013.1
MDENEIKDRVGKLRTKEDLLDLLNSLKVAEYGEGVHLFTMKQLNFYCNPKYGKRYQSFRIPKKKKGEFRTISAPVAALKSIQHFINVILSVLYKPTDVVTGFVKNKSVVDNALRHVGMNYVLNIDLENFFPSIPQVRIWWLLQQKPYGFSKEIANVIAGLCAIKQPKKEVESPKNAIEDYDYVLPQGSPTSPILSNISCEHLDHKLQKLARSFGMNYSRYADDITFSSEEYVYSRKGKFWTQLRRIISEHKFSINENKTRLLRKGVRQEVTGLTVNKTANVSKKYIKEIRRHLNTWEKYGYAIAFKNFYPIYKLEKGHVKKGEPDLMNVLSGKLLYLKMVRGESDPVYSKLNTRFKNLTTGEDSSIVFGSMSYHNTQKVTEFEKTMDTEIKINRTQGTLKSYFFETKSIATKKRRKKENSPSEPQVTKVDVRISENANFEHKKDLFISLCRNEKGETFYLMHKELFSTDEKNERKLELDKMLSALVRGGKVHLEVLEKDIVNEEKPIYEDTMSVVEFEKKHRCKVELSEDKKYAVAKYKVKRENIKISPKVNPEEYREHSISKYTKGSDSSYYLIHRKPRTDKK

SEQ ID NO: 100 - protein, 445 aa, unidentified
  source 1..445: note = Bacteroidales bacterium; note = Related to JAFXDI010000014.1
MEIDIVSSVKKLRTKSDLLRLINRIKEIKFVEVGLQKKFSPVTIKQLEYYSDPNNTYRRYRKFSIPKKSGELREIHAPRNANYKVILRTLNEILNTVYEPSEYTMGFVRGKSVVTNALSHVGKNYVYNIDLKDFFPSIDYLRIAKRLQLSPFCFPRQIAIIIAGLASIRTDEGDAVLPQGSPLSPILTNIICDKLDRKLSRLAEKFGLSYSRYADDITFSSYHNVYHQDGEFCKKLKSIIEKQGFKINENKTRLQKRGQRQLVTGIKVNTETNVDRSYINQIRNLLYIWKRYGYSVAEQRYYEWRLKNKPLSYKRTSLASYLNGKIQYLRAVKASGYSTAYIHFLFEYEYLYKETFKKKKRYGINYIETTPLEQFEKKLGVQIDINKKVDADGQSHRFSVFEYKFIPTFISVSKDITPEDETNKSKLSISRCIDQRKKEFWLIHY

SEQ ID NO: 101 - protein, 321 aa, unidentified
  source 1..321: note = Bacteroidales bacterium; note = Related to JAGBVR010000009.1
MDIKDTNTLVSTIETIAPYNVGWALTDRVGDINNLASARLRTLSYKEFDIPKKSGGTRRITAPVGKLKDVLKCLSVILTPYYEPGGCVHGFTTQRSVASNASVHMGKNYVLNIDLKDFFPSITATRVQKALQKHGLNSEVAHLISRLTTLPMAIEDSQTLRNVLPQGSPCSPLLSNMVCSDLDRKLMGLARRFRVDYTRYADDMTFSSNHHVYAAGGEFFAELRSIIEDCGFTINERKTRLQKRGSRQEVTGVIVNEKTNAHRSFRKNLRAAVFAAETFGCTRKEYNSIMGKISYLSMLLNEERGCIYKYKAIMSKVMIKK

SEQ ID NO: 102 - protein, 321 aa, unidentified
  source 1..321: note = Bacteroidales bacterium; note = Related to JAFYOT010000249.1
MELKDTDALTRAIEEIAPYCAGWALTEKVGDINRLASARHRILAYKEFKIPKKSGGTRKITAPTGKLKGVLKCLSQILTTYYEPHESAHGFMPGRSVATNADVHVGKNYVLNIDLKDFFQSISSQRITRALTRHGLSQDVAELISRLATIPTVKEGSDISIHALPQGSPCSPILSNMVCVDLDKRLSGLAKQFRVDYTRYADDMTFSSNHNVYSADGRFFEALRSIVVECGFVLNEKKTRLQKRGSRQEVTGILVNTKRNSHRSFRKNLRAAVFSAETNGCTHREYMRIMGRISYLSMLRGKEDPCVKRMQAIMSKVAVTK

SEQ ID NO: 103 - protein, 338 aa, unidentified
  source 1..338: note = Bacteroidales bacterium; note = Related to JABUTR010000154.1
MSFTVPITVPLPETLPQLHEEMARIAVSTSGWAVHNPGGREFLSKAESRSFRQRFYREFSIPKKSGGRRRITAPTGYLKGAQKAIAVLLERLYEAPDMVNGFTGDRSVLTNAEAHVGRNYVFNTDLRDFFPSITAGMVRKTLEKEGVSPEVARYISVVCTITTGDGDLSEDVLPQGSPASPILSNMVCLQMDRHLDWLARRYGLTYTRYADDITFSSMHSVYGKNSPFLKGLKEIIEEYGFSINEEKTRLQKKGSRQEVTGLIVSDRVNVCRRYLKNLRAEVFRMEMQGFTIEEYRRVMGKIAFVGMVRGREDPLYRKLHNRIRSIKRHPEGFLAQPR

SEQ ID NO: 104 - protein, 338 aa, unidentified
  source 1..338: note = Related to JAFXUH010000085.1; note = Candidatus Methanomethylophilaceae archaeon
MKAMKPFKNIPDTLEQMCERIMIRLPLVCRKPQLLGMDDILPYRRRKVRMNSYHEFGIPKRSGGMRVIQAPCEELNYIQKAVNSLLREQWTPADEVCGFVQGRSVGMGAAQHVGMHYVFNTDLHDFFPSITAPKVFEMLMRELGMKPAVARLICDLCTIPVKEGYDVLPQGSPASPILSNIACARMDRRLKGLAECFGLTYTRYADDITFSAPYNAFKEGGTFRICLERIIREEGFSLNEAKTRLQKRGGRQEVTGLTVNEKVNVPRKWLKGLRACIHRMEVDGFSPEEMDAARGKVAWLRHARGGLDPLSQKMVMRLNALEVALYFDELPDEDGSKI

SEQ ID NO: 105 - protein, 328 aa, unidentified
  source 1..328: note = Bacteroidales bacterium; note = Related to JAFUHQ010000138.1
MNAFLYNLGPESLPVGTPDELCMSIMLALPAVCRRTLLPGTGSIRKFRHPARRTAAYRRFEIPKKSGGVRTIMAPTGDLKDILTTVNSLLSLYWEPKHSYVHGFTSGRSVVSGAEPHVGKNYVFNLDLKDFFPSITKQMVARGLERAGFDRRTARFLSEICTVPGDDGREILPQGAPTSPLLSNISCMMLDLRLAGLAAEFSLDYTRYADDMTFSAQYNAFGPRGDFRSLMETVIREEGFRINEKKTRLQKRGSRQEVTGLTVCRKVNVARKWIKDLRAQIHRMETVGFTPAEYRSVCGKVGWIRQVRGAVPMYRKLRARLRALPLPA

SEQ ID NO: 106 - protein, 337 aa, unidentified
  source 1..337: note = Muribaculaceae bacterium; note = Related to JAFYCU010000158.1
MTEDLRDYLRGCISTASIADMCVSINEIGPFVSGLSISNPVSVSLLLYYTDVRVRRAAYHEFQIPKKSGGFRNILSPCGELKEIMHTLAFILKELYVATPPAMAYIAGKSIVDNACCHLGRNYVFNVDLSDFFPSITAMMVEHHLVKIGVSPLVATVIATLCTYPTIIDHHVVNIVPQGAPTSPVISNICATTLDHRLSGLAKRFHLSYTRYADDITFSSNHNVYHPDGDFMIELCRIIDECHFTINRNKTHLQKRGDRQMVTGLLVCEKPNVGRKFIKDLRAHIHKIKFEEEPTLHDINVVRGKLNFLRMVKGAEDTTYLSHIKKLNMAIKGKHFV

SEQ ID NO: 107 - protein, 342 aa, unidentified
  source 1..342: note = Related to JAFRPT010000056.1; note = Muribaculaceae bacterium
MNAELREELRSHINVDTIEGLCKSINEIGPYVSFLGMDSSISVSTLKYFTQVSARRDAYRQFHIPKKTGGVRTITAPDGQLKDIMFTLAFILSELYIPSPEAMAFVPQRSIVDNAQQHLCKNYVLNLDLCDFFTSITSYMVERGLCELGISPVVAQCLSTICTYPEFKENRVQNVVPQGAPTSPVISNICARRLDRRLSGLARSFHLSYTRYADDITFSSNHNVYHQDGAFMAELYRIITDCHFAVNEKKTRLQKRGARQEVTGLSVSEKPNVSRKHVKNLRALIHKISLEGAPEMHDINVARGKLNFLRMVKGETDSTYIRLIIKLNKAVAGKHFADSIKA

SEQ ID NO: 108 - protein, 341 aa, unidentified
  source 1..341: note = Related to JAFUDZ010000100.1; note = Muribaculaceae bacterium
MSLQEYLIDHICLDTRESLCESINEIGPYVSGLSIDNTITVKHLRRHANARIRLGCYHEFRIPKKSGGFRTITAPDGQLKHIMTALAFILTYIYHPTPTAMAFVPCRSIVDNARMHVNHNYVFNIDLCDFFSSITADMIEYSLIRQGINSMVARDISTICCYPVSDGTHTRNILPQGAPTSPVLSNICAQTLDQRLTGLAQRFHLTYTRYADDITFSSDHNVYHDNGAFIQELRAIIAECHFVINTKKTRLQKRGSRQEVTGLTVNERPNVSRRYIKNLRAMIHHIELDEHPSCHAINVARGKLNFLRMVKGENDSTYIRLVIKLNLAVRGKHFASDTPTV

SEQ ID NO: 109 - protein, 338 aa, unidentified
  source 1..338: note = Related to JAFYQJ010000016.1; note = Paludibacteraceae bacterium
MDIDVSSRDALYNSIYKVMPYVSNTLLASPSVLYKKIRFYNNVKNRLSAYHEFLIPQKTGGTRKILAPNSDLKSLMSAIAFILNTMYMPSDSVMGFVKQRSVLTNAKKHVGNNYVFNIDLSDFFPSITDSMIEAQLLKMNIPPLATRIISSVCTYPQKMEGGTYRQVLPQGSSASPILSNICCISLDKALEGLAKRFHLTYSRYADDITFSSNHSVYQEDGEFMTELQKIIATHHFFINPKKTRLQKRGTRQEVTGVSVNEKTNVSRKYVKNLRALIHQIALAKKLSTKKVNVARGKLNYLRMIKGVNDNTYKTLCIKLNLALKGKHFTPKKKRSYVK

SEQ ID NO: 110 - protein, 393 aa, unidentified
  source 1..393: note = Related to CP039547.1; note = Duncaniella sp.
MHSLVHSAHCRSLDHPAHTKVRPMFSLLSQIDKIMRDQIVKYLKDITIGNPKELFDVLNFIAPLIDGWSLTEPKSGRQIMRFASVKARQSAYVDFTIPKKSGGYRKISAPVKPLKAIQSAINILLQAIFVPDEHATGFVLNRSVKENALIHVGQTCIFNMDLENFFPSITKLMVRQALHRELGDRLQSNDVINIICRLCTVSDSEGVEVLPQGAPTSPVLSNIVLKSLDKDMSKLAERMECKYSRYADDITFSHSKSIRRMSPFWQSRLYNIIAKYGLKVNEKKTKTFVPGTRREVTGVVVSDKINVPRSYIKQLRVLLHLWEKYGYAQAQIIFTRDFCKGMEKNLVNVIDGKINYLEMIKGKDDPTYRKFKSRFSHLQWKEKQYSNQIQNAI

SEQ ID NO: 111 - protein, 359 aa, unidentified
  source 1..359: note = Related to JAAVDH010000018.1; note = Bacteroides sp.
MREQVAEYLKNVTISSRKQLFDALNFIAPLIDVWSLAAPKSGQQFLRFSSAKSRTTGYVDFTIPKKTGGVRKISAPVKPLKEVQSAINTLLQLIFIPDEHATGFVLGKSVKDNALIHVGQTCIFNTDLENFFPSITKKMVRRALHTELGHILNSNDVINTICRLCTVPNSDGIEVLPQGAPTSPILSNIVLAGLDRDMAKLADRMECKYSRYADDITLSHSKPVRKMSSYLQSKIHRIILKYGLKVNEIKTKTYVPGRRQEVTGVVVSSKINVARTYVKNLRILLHLWEKYGYIQAQLIFIRDFCHGKEKNLENVIDGKINYLEMIKGKDDSTYLKFKRRLKLLQYKERQKTTYTKRAI

SEQ ID NO: 112 - protein, 359 aa, unidentified
  source 1..359: note = Related to NZ_CP039393.1; note = Muribaculum gordoncarteri
MRTQIADYLKDLTIGNRKELFEVLNFIAPLVDCWSLAEPKSGKQIMRYASANARKSAYVEFSIPKKSGGQRTISAPIKPLKAIQSAINILLQSIFVPDNHATGFVLDRSVKDNALIHVGQTCIFNTDLENFFPSITKIMIRKALHRELGDKLQSKEVINIICRLCTVPNSSGIEVLPQGAPTSPALSNIVLKSFDKDMSKLAERMGCKYSRYADDITFSHSKSIRRMSLFWQSRIYNIIAGYGLKVNEKKTKTLVRGTRQEVTGVVVGDKINVPRSCVKHLRVLLHLWKKYGYTQAQIIFTRDFCKGKEKNLVNVIDGKINYLEMIKGKDDSTYRKLKSWFNRLQWKEKQRSNQMQKAI

SEQ ID NO: 113 - protein, 359 aa, unidentified
  source 1..359: note = Candidatus Avibacteroides excrementipullorum; note = Related to DVIH01000092.1
MLDQIADYFKDKTIGNRKDFFDALNFISPLIDGWGLCEPLSGRRILRFVTKKSRQNGYVDFTIPKKSGGVRKISAPVKPLKEIQSAINILLQSIFIPSDSAMGFVAGRNVMDNALIHVGQTCIFNTDIENFFPSITKIMVRKALQRELSNKLTSHDVINIICSLCTVPNNVGVEVLPQGAPSSPILSNIVLKSLDNEMSKLAGRAGFRYSRYADDMTFSHSKPIRRMNPFWKSRILNIIEQHGLKINDSKTKTFVRGIHQEVTGVIVSDKLNVSRQYVKQLRVLLHLWEKYGYEQAQTIFSRDFCKGGTKNLCNVIDGKINYLEMIKGKEDSTYCRFKQRLKTLIWKQKQLSTNKTASV

SEQ ID NO: 114 - protein, 339 aa, unidentified
  source 1..339: note = Related to JAEKDI010000013.1; note = Muribaculaceae bacterium
MTGISGNYIRRFLSKNSRRKAYKSFKIPKKSGGFRSISSPVNDLKDIQRAINALLLSIFEPSPYAMGFCRNRGVDTNAKIHIGQTCIFNTDLENFFPSITKQMVRKALHRELGDVISSNEAINYICSLCTVPNDEGIEVLPQGSPASPVLSNIVLKALDRKLALYAELWECRYTRYADDITFSHNSTVRKFSQFKQLRIRSIIEEFGLKINEKKTKVLVQGERLEVTGVTVSSNKANVARKYIKQLRTLMHLWDKYGYEQAQHIYVRDFCGGIEKSLTSVINGKINYLCMIKGKQDSTYRRFKSRYETAEKKRKALSKTKVVLYRRSRNWNKKSSPAHL

SEQ ID NO: 115 - protein, 321 aa, unidentified
  source 1..321: note = Related to NZ_NFHT01000005.1; note = Alistipes sp.
MTDRPERTVRHFLPARVRAASYVEFTIPKKTGGTRLICAPVQPLKAVQRALGTMLQTLFQPSDAAMGFVTDRSVATNARCHLHQNCVLNLDLENFFPSITKARVRRALERELADRIPSSEVRSLICSLCTIPNQSGIEVLPQGAPTSPVLSNIVLKGLDRRLAAFAGAHGYNYTRYADDITFSHDRPIRRFSPFFMERVRTIIEEYGLKINDRKTKVSVKGERLEVTGLTVGEKVNVPKNYIKRLRTLLHLWEHYGYEQARLIYSRDFSQGTGKSLKTVIYGKINYLAMVKGREDPTVVGYRNRFRRLVRIAKAEERTSIS

SEQ ID NO: 116 - protein, 322 aa, unidentified
  source 1..322: note = Related to DWXH01000006.1; note = Candidatus Alistipes merdigallinarum
MTERPERIVRRFLPARVRADSYVEFTIPKKAGGSRSICAPIQPLKKVQRALGTLLQALFQPSEEAMGFVAGRNIAANARCHLNQSCILNLDLENFFPSITKTLVRQALKRELADRIPSSEVRNLICRLCTIPNQSGIEVLPQGAPTSPVLSNIVLKGLDRRLSAFAEAHGYNYTRYADDITFSHNHPIRRFSPFFIEKIRSIIEEYGLKINDEKTKVSIKGERQEVTGLTVGEKVNVPRNYIKQLRTLLHLWEHYGYEQAQLIYDQDFCQGTGKSLKTVIYGKINYLAMVKGRDDSTVIGYRNRFRKLVRVTKAKEQASFTS

SEQ ID NO: 117 - protein, 351 aa, unidentified
  source 1..351: note = Related to JAAVDA010000014.1; note = Bacteroides sp.
MKESHIAEAAREYLGTGTVKSPRDLAVAICRCGELLDLWPLGELTLSHLRRLSTKAVRKECYRTFSIPKRSGGARQIAAPTGRLRDIQRAINLLLQARVGVMECATGFVCGRSVTDNALPHIGSHVVVNLDIENFFPSVTKRMVRESLKRETREWLESHEAVNMLCSLVSMPDGEKGEMLPQGAPSSPMISNIVLGRLDRRLAGFARERGYAYTRYADDLTLSGREIRKMSAADMKLIERIVAEEGFKLNRRKIKQQGAGHRQSVTGLTVNERINVSRDFVKNLRVCLHLWETRGYEEASGIYRRDFRGGEDVDFARAIKGKINYIAMVKGRRDPVFMAFSRRLRLLTGRK

SEQ ID NO: 118 - protein, 441 aa, unidentified
  source 1..441: note = Related to NZ_CP072358.1; note = Prevotella multiformis
MATRTINGREYTKADFENQLRYLNDAQELANLLNELKAPYIYSDFRGKQLSFFADTNNIRRRCKTFRLRKKHGGYREITAPKGRLHDVLHILNIVLQTYDEPTPWAYGFVCGRSVVDNARPHVGKRYILNLDLKNFFPTITRRQVADCLMAEPFGFSSLAAELVSGLATVRTDNGEEVLAQGFATSPTLSNFICREMDKEIAGVAAAQGVTFTRYADDLTFSSDADILRPQGELAQQVKTIVERYGFILNEAKTHLQRRGRRQEVTGLMVTEKVNVSRRYVREIRSLLYIWERYGYEDACQAAWKSYKQQHGKTKGHQHHVPLNKVLGGKLHYMKMVRGSDDPLYLRFASRYTSLQQRSKGDIKEVEYKAYMGKCLSKSGKDRVTRTTVLSNDNTSTRQRGVTSSNPYDPGKKNKRILNFIVMVIIFAAIILIKLFLKSRL

SEQ ID NO: 119 - protein, 441 aa, unidentified
  source 1..441: note = Related to CP023863.1; note = Prevotella jejuni
MATRIINGREYTKADFENKLCHLSDAQELAAMLNELKLPWYYSDFRGKQLSFLADTNNVQRRCKTFRLRKKHGGYREITAPKGGLRGILNALNILLQTYDEPTPWAYGFVCGRSVVDNARPHVGKRYILNLDLKDFFPTITRQQVADCLTAEPFGFSSLAAKLISGLATVRTKNNEEVLAQGFATSPTLSNFICREMDKEIASIATAQGITFTRYADDLTFSADTDILRPQGELVQQVKAIVERYGFRLNEEKTHLQRRGRRQEVTGLMVTEKVNVSRRYVREIRSLLYIWERYGYEDACQAAWKSYRQQHGKTKGHQHCVPLNAVLRGKLNYMKMVRGADDPLYQRFVSRYTSLQQRSKGDIKEVAYKAYMGKYLSISAKDRTTSANVLPNDNTSSRQLGATSSNPYDPRKKSKRILNFIVMVIILVAIILIKLFLKSLL

SEQ ID NO: 120 - protein, 330 aa, unidentified
  source 1..330: note = Related to NZ_BAKO01000003.1; note = Prevotella fusca
MATRTVNGREYTKADFENRLRYLNDAQELAKLLNELKAPYIYSDFRGKQLSFFADTNNIRRRCKTFRLRKKHGGYREITAPKGRLHDVLHILNIVLQTYDEPTPWAYGFVCGRSVVDNARPHVGKRYILNLDLKNFFPTITRRQVADCLMAEPFGFSSLAAELVSGLATVRTDNGEEVLAQGFATSPTLSNFICREMDKEIAGVAAAQGVTFTRYADDLTFSSDADILRPQGELAQQIKTIVERYGFILNEAKTHLQRRGRRQEVTGLMVTEKVNVSRRYVCEIRSLLYIWERYGYEDACQVRGRATSCSTERQRGIRTTYLLIKFWVVS

SEQ ID NO: 121 - protein, 440 aa, unidentified
  source 1..440: note = Related to NZ_CP072374.1; note = Prevotella denticola
MATRTVNGNEFTKTDFDSRLRWLNEPKELSALLNEVLDAFCFTKSRPAQLRFFANTYNTQRRCRTFRLRKKHGGYREIIAPKGKLRDILHALNIVLQTFDDPTPWAYGFVCGRSVVDNARPHVGKRYVLGLDLKDFFPSITRRQVADCLTTEPLGFSSVAADLVAGLASVRTDEGQEVLAQGFATSPTLSNFVCQEMDREIADVAAAQNITFTRYADDLTFSSDADILRPQGAFVQQIKTIVERHGFRLNEAKTHLQRRGRRQEVTGLMVTEKVNVSRRYVREVRSLLYIWERYGYENACKAAWKSYKLQHGKTKGHLHHVPLNRVLAGKLNYMKMIRGASDPLYQRLAGRYAALRDANRDGIMNVEYNAYMGEYVPNSHRRRPAGDDGLYTENTAGRHRRSGTRDIYSPERKGNRILKFILKVAMWAAIILAYLYFRSR

SEQ ID NO: 122 - protein, 437 aa, unidentified
  source 1..437: note = Related to FOHY01000003.1; note = Prevotella sp.
MTSKTFARTDFDRQLRQLSSPAELAALLNGVLPAFFYAICRPAQLRFFANTANIERRTRTFRLRKKHGGYREIIAPKGAFADISRVLNTVLQTYDEPTPWACGFVRGRSVVDNARPHVGKRYVLSLDLKDFFPSITRQQVADCLAAEPFGFSPGAVELVSGLCTARLDGQDVLAQGFATSPTLSNFVCRKMDEQLAELAGQQAVTYTRYADDLTFSSDADVLRPTGDFVQRVEDIVRSHGFELNGSKTHLQRRGRRQAVTGLMVTDKVNVARRYVRQVRSQLYIWERYGYAEACNAAWKHYRLQHGKTKGQGHFVNLDAVLRGKLNYLKMVRGAEDALYQRLQSRYDRLWAKDRSAIGHAVRKAYAENYEAKQGQHGRQSWLTVGSKPTSAPAEDRYRAGSIDNPLPAEGSRSGVKRILKIALWVAALAAVAYFLLH

SEQ ID NO: 123 - protein, 478 aa, unidentified
  source 1..478: note = Related to FNBQ01000003.1; note = Bacteroidales bacterium KHT7
MIRQKQNLKFDKETVDRQLKNLESAKQLAQILYDAVNDVRREPYWLRTNSKNGYLYDSMPLEWRSVSQLNYYVDTAKDDYNRLRIFNIPKRKGGFREIVAPKPAFRVRLKAILKILQSYEEATPWAYGFVQGRSVADNAALHTGKNFVLNIDLSNFFPSITREQVKQVLSAKPFEFSPFAVDFISGLCTYRKDGVDVLAQGFPTSPLLSNFVCRQMDEDIAKVAAENNVTFSRYADDITFSSDVNVFDFNGAFYNKIKEIISSYGFVINQKKVRLQSKTRHQEVTGIVVNKKLNVSRRYIREIRTLLFVWKKYGYEAACCCAYRNNRKKDYHKYYHSIEVSKFLRGKINYLGIVRGKDDSIYLRFKAQFDELYKNESDVMKSYSDMLEKHRLRRENNSECEEMSDKSCGVSTNDEAGNSVSANSSTDGNGYQTRIDRNSYLRDADDKERRKKDRRTIILICFAFLIIFRLLVFIFFKA

SEQ ID NO: 124 - protein, 401 aa, unidentified
  source 1..401: note = Related to NZ_BAIZ01000017.1; note = Prevotella shahii
MAQVNRDVDLKALVGNQLQYIYSAEELTNVLNTLASNVGVPSDFRRNQMLCFADTRNDYRRVKRYFMHKKHGGRRPIVAPHHSLMHMLQGFNVLLQQYNPPTPWCYGFVRGRSVVQNAQLHVGKRYILNVDIKDFFPSITRQMVEDVLTAAPLRCSTEAAQLLSGLCTVIEPVGDVLPQGFPTSPTLSNMVCRKMDEELAAAAQRIGATYSRYADDMTFSCDNDVLRTTGSFYLQVSTIVEKYGFRLNDRKTRLQRRGRRQQVTGIVVSHKVNVSREYARQIRSLLYMWERYGYWETAKAALHAYREQNGKTRRHGEYLTLYTVLRGRLNYMKMVKGETDPTYLKLWNKYNQLMLRDKPKRRRVLTALTRIDQRLQAPTIILANRNERVARVLWQSLWRLH

SEQ ID NO: 125 - protein, 412 aa, unidentified
  source 1..412: note = Related to NZ_HE999452.1; note = Prevotella sp.
MARNHRDVNLKALIGNQLQYIYSADELTNVLNTLAYNIGEHSGFRRNQMLCFADTTKDNRRAKRYRMHKKHGGTRAIVAPHQSLLYMLKGFNALLQQYYEPTTWCYGFVKGRSVVQNAQQHVGKRYILNIDIKDFFPSITRQMVEDVLLAEPLKCSTEAARLLSGLCTAAEPQGDVLPQGFPTSPTLSNMVCRKMDEELAAAAQRIGATYSRYADDMSFSSDKDVLRPTGSFYLQVSGIVEKYGFRLNDRKTRLQRRGRRQQVTGVVVSNKVNVAREYARQIRSLLYMWERYGYWETAKAALRGYCEQYGKTRGHGEYLTLYAVLRGRLNYMKMVKGGTDPTYLKLWNKYNQLMQRDTPKRRRGTYGTNAHRPEPSSTNDYLGEPQRKGCAGVVALFVVLTLAGLLACNLLA

SEQ ID NO: 126 - protein, 412 aa, unidentified
  source 1..412: note = Related to KL205516.1; note = Prevotella loescheii
MARRNQNINLKTTIGNQLQYIYSADELTNVLNDVAKQIGVQAGFRTNQLQCFADTGKDDRRTTRYRMRKKHGGTRAIVAPHSSLLFMLQAFNALLQDFYVPTPWCYGFVRDKSVAQNAQQHVGKRYILNIDLKDFFPSITRQMVEDVLLAEPIKCSTEAAKLLSGLCTATEPQGDVLPQGFPTSPTLSNMVCRKMDEELAAAAQRIGATYTRYADDMTFSSDNDVLRTTGSFYMQLSTIVEKYGFRLNERKTRLQRRGRRQQVTGVVVSDKVNVTREYARQIRTLLYMWERYGYEDASEKALWNYRNQHGKTKGHSKRINLSAVLRGRLSYMKMVKGEADPTYLKLWNKYCALHAAGYPKSKTRKRGMRPANDDSMHVGGYLGDPPRRGCALVIAFFALLTFAGLLAWNLYA

SEQ ID NO: 127 - protein, 1015 aa, unidentified
  source 1..1015: note = Related to JAFWXI010000025.1; note = Alistipes sp.
MMTFIGFWTAINGLAAVNNQAAFGKLECLRYGDTTLPDRYKMYNIPKKFQKKGLSVRAIYAPNDRLKYFLKFANNILSEQYVQNNYAYGYVKGRNIVSNARLHTNKHYVCNLDLKDFFPSISYDRAYLAAKKHFKDIEPSILELCIKASCVSVDHKCFLAQGSPLSPLLSNVVCIDLDNRLYSYCSDNGFSYSRYADDMTFSTNHTDKSAIELHINTIKQIIKQSSFNINEEKCRIQSNQYNQSVTGLTVNEFPNVKKEYIKDLRNILYIWERYGYIDANRRYQRKYRIAKRIKPLSDIILPRMEDVIRGRIQFLKTVKGSNDNQYQRFNNKYTSLLNRDCNFIPTHKPNKYIEGSNFKIYHSILKDQDGNNYIQLDKFERAIVPDNCLSLLKLCQSNAWSKIIKTIFNIRPINKANYKWALQLNSNTRKNAVKYGLRAYNKREGGYEDAANLLRIAIELGNYNYFDQYLISCKLSNQSHNLIPENIEYLEANEYGTLLKKYAGYYSAKGFKISQIIGKSNGDSTVDLYKTPIHPIREEHNVTENIQWHNTTGVGIYLGVNEYRCLDIDNVNGDIERVIIMMLHLLHLPLDYSWVIKSGSGKGFHIIFKAENIEGFKADIVAFSTNKKNHRAFERIELRWQECFLVLPPSLHRSGNFYGFRNGDIPTYNPMHVKHNDINTLLDYFCGWTKFIELKYNNIDFDLVYRSKWGADSSCGSVSINLPIEWLSACNSPVCANELAIRYLIGESVSPDNNKAVQLFRKANNTLSAYNLASLIAIGYIDDIGEFNSLISKCKDHIDEIDVHFNNSKHRIERVIQIFNQTHQKKLYVFFDTETTGIPLDYNAPISDIDNWPRLVQLSWMITDEDGKLIKENDYIVYPKGFDIPTSSSAIHGITNEYANKKGIDIETVLAEFIEDLKGVSLVIGHNINFDINIVQAELFRLGMTDIFNDKRKVCTMKSSVDFCAIPNKYGYKWPTLQELHQKLFGEIFTDSHNALSDIRATKRCYFELKEKGIL

SEQ ID NO: 128 - protein, 656 aa, unidentified
  source 1..656: note = Related to JAFQZD010000117.1; note = Bacteroidales bacterium
MDEVIYFSDSDITERYRLASIPKRDSNGRFTKRRKVYMPTPRLKFFLQQANSLLSAIYSPPPCSFAFIKGRTIVGNATPHTNKKYILSLDIKDFFNSISIQKAVNAIKSAFPWQFRGEFIQAIVGASSLNGHLVQGSPLSPTISNIVCLNLDKRISSYCESLKISFTRYADDFTFSSNDFDFKRDSSFLDNITKLISEEGFALNNEKTHIQLYNNKQVVTGLVVNSKVNVARRYIKEIRNILYIWKRFGYDEALESFRFHYLHISRKIGSSLRSRISYEDEKRILHSRMVKKATNYSPRLDQHILGRLNFLKMVRGENDYQYLQLTQKFNELSKKLPYKKDKDGSYSFKSIQHFEWALGCLVLTDDVKNENGTQFFKMNNGGKAIISTKLLSFLSSVEPEYYSVALSLIKSKCRVKAINLEANLFIIWATPLDLKKYRWAIIDAVYRAARDRYESIHCLAKVERSEIESLHKDFQFAMNNGNYAMIHAYLDICNFLNLDSGLYPENFDLLNSNDKSILLQKWGWNYYSLYIDTVPTDKDGVPLSESTFDNYRRQWGSNFAHLRWKGADGIALVAGTNKWVIEVTDRNLDEDDVMRELLSNKEIEVCIIRKPTLLLVVNKDVLQEKEYQGFTIHKSGYYSIYPYKGEPMEIKTIELS

SEQ ID NO: 129 - protein, 489 aa, unidentified
  source 1..489: note = Related to JAFQCA010000048.1; note = Alistipes sp.
MPNCSNCYKTLDEGLNFCPYCGARVSHSGDKLCPSCNQIFNEYDGSFCGRCGSRLIVYEREQSTNGQHVINSVDDLIATINSFIPKIDSKADSISKEELLSFGNINNDRRYEIFYIPKKRRKYRMISSPTPRLKLILRCLNEIIYQHFAPAGYVTGFVRNLSIVDNGRIHVGQRYVYTIDLANFFESVTPDMIIPYLCKAPYNLNPEVADIVAKISCVKNRRKNSIGLSQGSPLSPVLSNIVCADLDKKLNGLASLYRAKYSRYADDITFSSSNNLYLQVNDFEKRIIEAVESSNFKINYNKIHLCGPQSRHYVTGIVTNSKVNVPREYISNIRNLLYIWSRYGVKEAYKRFDVWYKKYRKGKPTPFIGDFLRGKIEYLGAVRGKNDPIYKKFKNCLESLSQINFKTFYERPKRMKVSFNLSEPLVKYGRTYYTAETRYRGELVLISPKLNAYIESGVDYSPARVLATNCVVYKIFDKDGVKLLMTTEN

SEQ ID NO: 130 - protein, 381 aa, unidentified
  source 1..381: note = Related to JAFSDP010000008.1; note = Alistipes sp.
MATHLSTICSAEELRQAINRSITQSGYSPLSPARYKFLTTSVTMPYLYRHFTIPKRHGGGRKIDAPKKMMQAIQSALLPLLEGSFVPSSAVCGFVKNRSVVNNALPHIGCGVLLNIDIKDFFPSITHQMVTDALVSELKMGQEAAHALGWLCTIPKKGQRVLPQGSCTSPILSNIVCSRMDRELLTLCAAHGVTYTRYADDLSFSAKENCFEAGSEFRQRMEEIIKATSLKLNNRKTHIAYPGRRMEVTGLVVERRANVARDYILELRQLLYIWEKYGEKEAAISFSKHHGERTHRSPIRQIIQGKLAFMSQVRGNDDPIVKRYSSWFERLKKRPRKQQRKATPPPQPTPVTPPAKGGYLGMVALLVGLSMLMVVAVAAVF

SEQ ID NO: 131 - protein, 377 aa, unidentified
  source 1..377: note = Alphaproteobacteria bacterium; note = Related to JAFPOK010000749.1
MKSVDDFIKLLNGLRYSRYGEKCKPITRNLLYYYASNKVPISNLYTDIYIPKKSGGKRKIQIPCRGLKEIQGYIAEILNALFTPQSCVTGFVRGKNIIDNAKPHVGHKYLLSWDIKDFFSSIYAKLVKYCLVNDPFNFPDDIANLITNICGVRIEEDSCKRVLPQGSPCSPILSNIVFAVFDKYIVDHCTWRGVIYTRFADDMTFSADHDFYYDSRFSWGRVLPSNGQFYHNKHLRQFFYLAKRLNINKKKTRKCKQGQRKIVTGIVVNDKLNVKREYVREIRNLLFIWEKYGYNDAKARFNNHVHKSTPNAKPSELLNVLVGRIYFIKQVKGKNDPIFLRFKTKLKYLCSIMNTSKAVSIRLKTGLFIKGNLISLD

SEQ ID NO: 132 - protein, 424 aa, unidentified
  source 1..424: note = Bacteroidales bacterium; note = Related to JAFYYM010000038.1
MEDIDTKPRSGPSTVFHLLGLLNKAKRQEFGYRAWPFTLEQLFFFSDPKKNHIYYLHHFIPKKSGGVREISSPSWMLKMFQASAKRLLQDKYVAPDNVMGFVSGRSVADNAARHIGKNYVFNADLKDFFPSITRDRVISSLMKPPFCFGKEAALLLSGICCAHADLTQKGKDTYWVVRGEGKRGKLMDASNYHPAVPATLPQGAPSSPVLSNAVCLTLDKRLDGLAKRYKVTYTRYADDITFSSNHNVFREGDSFLKEFRNIIKSEGFILNEDKLRLQNKGQRQEVTGLIVNKKISVSRQYIRSIGSLLYIWERYGVDAAYGRFLKYKTDLEVTADNRQLCTYVHPHLLETMQGRIAYVRMVRGEDDPVWKRLNERFLKLKAQYESRGVIGNPTRILHSWTIKRFEQLSGFHLRYGPLYSFMSP

SEQ ID NO: 133 - protein, 521 aa, unidentified
  source 1..521: note = Related to JAFVPD010000015.1; note = Muribaculaceae bacterium
MTYEEKALREKAFDIETKEDLLSLLNDIKADLTHETSYPFTMQTMMRYSRPGVYSWRYKKIFVPKKTGGAREVYASWGTLKWLQVCVNELLQALYDPSDYAMGFVKRRSVVDNAKAHVYQNYVFNIDLKDFFPSITYSQVKNSLQQLPFGFNEEIAKIIAGLCTISDDTPDLMPKGKKERKRYFLPQGAPSSPVLSNAVCISLDRKLAGLARRFGLTFTRYADDITFSSMHNVYQEGSAFRIELENIIFKQGFRINAQKVRLHHRSRRQEVTGLIVGRKVNVPKQYIKDLRAVLHIWKKYGEGAAAASYYPRYRAGIKKETQFNLKAVMLGKLCYLKMVRGEDDPVYKRLSDQFDEVTSKRKKKCQPGVEYLGSCTLKTFERRLNVVIDIGEEVCKNKFTRIRLKNGTTLPIYISRLMPPNSRKDRVWVSLCRRTFEAGGFSVFYMLHNSYAIKSFVPPLKSDIFDETVSKVVDLVVAFPILHVEDECGVIQPKYIPQKISEVIDQFLAEKNISHKENIPF

SEQ ID NO: 134 - protein, 377 aa, unidentified
  source 1..377: note = Bacteroidales bacterium; note = Related to JAFSQF010000025.1
MNRTAILPPKKAVATAVTTRICDLWGCLHTKKDLLKLVNVALEGLYGERVCSVSMAQLNKAAYSSLNPDRYCTFKIPKKKKGEFRTIDAPEHSLKYIQQGLNMVLQTIYAPHPAAMGFVPRRSVVTGARMHLGQRLVYNIDLKDFFHTITSGRLYSRLTSKPFCLDGKVAGIIADICCYSGPDGRNVLPMGAPTSPTITNIICERMDTKLTRLAKAYGMQYSRYADDITFSGMANVFGEDSRFIKSLRNIIEREEGFTINPDKTRLCHRGMRQEVTGVTVNEKENVPRWYVGQLRTMLHNWEMDGHDRAQAVFERHYVPKFTRPSSGLPPIHHIENVIAGKLLYLKMVKGETDTTYKALNRRFAALMDCFIQTSQTI

SEQ ID NO: 135 - protein, 371 aa, unidentified
  source 1..371: note = Bacteroidales bacterium; note = Related to JAGCUU010000036.1
MRLDRNILDREAAKNAVKCRISDLCGCLHTKKDLLKLINVALEGLYGEKASMVTMSQLDKSLKSSPNTVRYYRFLIPKKKKGELRTIDAPEPTLKYIQQGLNLVLQTIYSPHSAAMGFVSHRSVVTGARMHIGQRFVYNIDLKDFFHTVTSGRLYNRLTTKPFNLDRKVAGIITDLCCYAGPEGKNVLPMGAPTSPTITNIICERMDIKLTRLAKAYGLKYTRYADDITFSGMANVFDEGSHFIQSMRNIIENEEGFTINPEKTRLCHRGMRQEVTGVTVNEKENVPREYAKQLRTMLHNWEMDGYDKAQAVFEHHYQADNPRYAATHSDFRPNLESVVAGKLLYLKMVKGETDATYKALNRRFNALRCDV

SEQ ID NO: 136 - protein, 380 aa, unidentified
  source 1..380: note = Bacteroidales bacterium; note = Related to JAGCVI010000021.1
MKKVAEITDRRAEVKAAETRIHDLWSCLHTKRDLLRLVNVALEGLYGMDARTVTMRQLNLSAYSSLNAHRYRTFQIPKKRKGEFRTIDAPDPTLKYIQQGLNFVLQTVHTPHPAAMGFVPHRSTVTGAKVHLGQRFVYNIDLKDFFHTVTSGRLYKRLTLEPFCLDGEVAGLITDLCCYMGPDGRNVLPMGAPTSPAVTNIICERMDGKLSRLARVYGLKYSRYADDITFSGMADVFAEDGRFIMSMRNIIVNEEGFTINPEKTRLCHWGMRQEVTGITVNSRENVPRKYVKQLRTMIHNWEMDGHDKAQAVFEKYYMEQNYTHNPDVKHHIENVVAGKLLYLKMVKGETDPTYRALDRRFRALTETGGRDTQGTGKNRL

SEQ ID NO: 137 - protein, 457 aa, unidentified
  source 1..457: note = Bacteroidales bacterium; note = Related to JAFYBP010000010.1
MKLDEHIKRQELLVQPDAKGASNGQLPDAQAAERGNVFERLPYYGKSSPEARQKAAERMPDLWRCLNTKGDLLHLLNVALGGLYGEWPQKITIQQLNKFAYTSLGAKRYTSFKIPKKRQGEFRTIDAPVPMLKYIQRGLNFALQCHYTPHMSAMGFVQHRSVVDNAKVHVGQRLVYNIDLKDFFPSITAGRLHKRLMAKPFSLSKEMASIITDLCCYTNAEGKHVLPQGAPTSPTLTNIICERMDRKLSRLAKAYGLKYTRYADDITFSGMANVFHENSRFLKSMRNIIENEEHFTINTDKTRLCHQGMRQEVTGLSVNRQENVSRKYVKQLRTMLHNWEMNGYEKAQEVFAKHYSETKKSNLLMKGTHHIENIIDGKLMYLKMVKGGNDCTYKSLDARFRALMDHLPATRIDGNNSPKVTVEIPMVPKEDDECWETIYNLEKILNNENNNNDGRQV

SEQ ID NO: 138 - protein, 470 aa, unidentified
  source 1..470: note = Related to JAFWTB010000069.1; note = Bacteroidales bacterium
MEIDEHIKQQEQQTHADSLEVTLGEPLEFTFVENANVFAQLPVHGVSANPNKNGISDTIVRVQDLWRCMKTRKDLLHLLNVALAGMYGEQSTILTMKQLCGYAYSTIEAKSYTTFQIPKKKKGEFRTIDAPVPMLKYIQRGLNFILQCVYTPHTAAMGFVQHRSVVDNAKVHTGQRLVYNIDLKDFFPSITAGRLYHRLMSKPFSLNEKVASIITDLCCYTNADGKHVLPQGAPTSPTITNIICERLDRKLARLARAYGLKYTRYADDISFSGMGNVFAEDSRFVKSMHNIIEQEEHFIINKDKTRLCHRGMRQEVTGLSVNQQENVSRTYIKQLRTLLHNWEMNGYDKAQEVFAKHYAETNTRNLKNKGTHHVENIIAGKLMYLKMVKGETDCTYKNLFARFKLLLENHTDTKIDKSKFSDDQAQNIPVDEGPKHVTNNETVQSVDIENSDEILSTFSSLEELLNNENE

SEQ ID NO: 139 - protein, 382 aa, unidentified
  source 1..382: note = Bacteroidales bacterium; note = Related to JAFTCA010000013.1
MNVAKHGQSKSLVPKPLELTQEKRRALADRVAILWPRLKTKADLKQLLNITLSGLFGPHSTFLTMNQLNYSIYSTIESKRYSSFRIPKKNKGEFRTIDAPMPLLKYVQQGLNFILQSVYTPHIAAMGFVPRRSVVDNAKVHTGQRLVYNIDLQDFFPSITAGRLFKRLMAKPFSLNKEVASLITDLCCHTHENGKNVLPQGAPTSPTISNIICEQLDRKLSQLAKAYGLKYTRYADDITFSGMANLFAENSKFCKSLKHIIEDEEGFVINPNKTRLCHQGMRQEVTGLSVNRFENVPRTYVKQLRTLIHNWEMNGYDKAQAVFAKHYTKNDPRHLLRKYAGRIENVISGKLMFLKMVKGENDDTYKSLVGRYNALMMAAGCL

SEQ ID NO: 140 - protein, 1078 aa, unidentified
  source 1..1078: note = Related to JAFXCG010000006.1; note = Bacteroidales bacterium
MEDLHIKNGIKTLWQNMSSKNELLSILNKAASILYGDDAKKIEMSHLTYHSYSTNNKKRYISFQIPKKKKGEYRIIDAPCKGLKLIQQCLNVLFHEIYAPNVAAVGFVQNKSIVDGAKIHLQQKFVYNIDLKDFFPSITSGRLFKRLQSKPFCLNEEIASIITDLCCNTNAEGKSVLPQGAPTSPTITNFICERLDQKLTNLAHAYGLKYTRYADDITFSGMANVFAESGKFCKSLRHIIEEEEKFKINTSKTRLLHRGNRQEVTGITVNERLNVSRRYIKQLRTMIHNWETKGYIEAQYIFQKKYNETNIKNSNGIHYIENIICGKLDYLKMIKGEKDRTYIKLKERFDKLLFGNTYSPLNNHIDKIFETLIASRFNEYKDKNASDENENKKEGKNYVNKSINTLVSELDSPMTLEEATETLVEGIDVISVRNGFTSTESRVIVEVSTIKKDTKSPSINLAVLTVPIGETSLIINDEIQEGKLFIDELKSLNDNPEDSNNLNIAKNIMGQNSRIRSVHAILNNVLNKLSEDPNNFRIYNNGRVGFTEDAQAFIRKELNRISRHLYLSDSATPMLGLTNNNEIVFTILDDNTFEDVLVPTGIVLGNTNVADAANSIKGAENIFHKNATKLTEYTTARIVRDLITKVEGNERVVRKNGKGYEAVKWQLRYDRLQKEADISNTSNKTAKEQIDAHNESREAYIRTAVKEGIIIINFNKDSLESNNYLKHKYLNRKNIAKILLNKMGKCFVTEEQVLNIVSQKKYVTEERAIELIRKYGGHNKKEIGKSNVVEYPDPKQTYQFLSFFSQNDGGLKNLTHDFNYGYIDYDVFIAQCKKEFEEIKKRFPNVQESVVRRIEEFAFKESPNWYIRLGNDKKYIRYGWSEPSFVEWYRTNKIHPAKDTHYNAEMIVPFKNSIQVRADNKNLIGLLSSLVTMAFGQNPCCNVEITQNVGEAQFYTDVDRLGQAIYQIFSTIKDYSEQNFCDKVIVDYYTENDFKILTITHIDSKPTKKSDDKDYLGGNGTTIKKALFGLCNYEVQAEFPDGAYRKIILSDNYEDFKKGRYLIDKDSIDGYKHIMKFY

SEQ ID NO: 141 - protein, 480 aa, unidentified
  source 1..480: note = Bacteroidales bacterium; note = Related to JAFPVH010000008.1
MSKKKANSKSDLKKVLDRNRHKEEKVAAKVGMQMEAEEEVAIIDFDDDSASSSEDVQIETTGNPKTEQKEDGVKQVTHPLSEEEKKECLEEIRERWPRIKTKESLLSILNIALILLYGRDARKLTLRMLNYYAYSSHNKKRYITFQVPKKKKGEFRTIDAPCAGLKMIQRALNLIFQTIYTPHEAAMGFVPHRSVVTNARVHVGQKYVYNIDLKDFFPSITSGRLFKRLLVAPFSMDKKMASIVTDLCCYTNADGKNVLPQGAPTSPTITNFISEHLDRKLSKLARAYGMKYTRYADDITFSCSSNMFAEDGKFCKSLRNIIENEEHFKINTDKTRLCHSGERQEVTGLTVNEQTNVTRKYVKQIRLFLHIWEAKGLPEAQRLFEKHYTPKTTRPNVGIPHIENVIAGKLLYLKMVIGEDRDMYKRLASRLDILVGNTQESNSTDISPKDKGVLSVPEKGKLPAEKEILIELNTLIELLE

SEQ ID NO: 142 - protein, 491 aa, unidentified
  source 1..491: note = Bacteroidales bacterium; note = Related to JAFSJF010000074.1
MAKKKNITKKQNLKKKLGQTSASKKTEVSELVSSGSEKAEEVLFAIEPIEDDLVRVAAAVTELEDIDSAKVSDEETISTQADALSKIDELPKYGGSPLTGEDLKQQLAKIVEGWHSMNGIDDLCVVLNMALQALHGMDAVKTTVGRLKLMVRKGRYVTFKIPKKKKGEFRTIDAPCSELKNIQQALNFVLQEVYSPNAAAMGFVKGKSVVTNAQVHLGQNYVYNIDLKDFFPSITSGRVFKRLLVKPFCLNEKVASLISDLCCYQKGENKVLPQGAPTSPTITNIICEKLDFKLTRLAKAYGLKYTRYADDITFSGMKNVFAEDGKFCTSLRNIIENEEGLKINSDKTRLCHRGMRQEVTGLTVNSKTNVSRKYIKQLRPLIHNWEVKGYDEAQAIFAKHYAETNIRNLRFKGEHHVENIISGKLMYLKMVKGETDSTYKSYANRFEKLCNDTFGAGSQKSQTLLTPLMDDGNVLSVLNDLATLIETNTSE

SEQ ID NO: 143 - protein, 436 aa, unidentified
  source 1..436: note = Related to JAFZPH010000008.1; note = Bacteroidales bacterium
MKNRIKNDMDYNTVINEIWRNLESKTDIVALINVSLKDLYGDKASKISLRKLNYYAYSKVNANRYVSFDIPKKDGSMRRIDAPCRGLRTIQRALNHVFQIVYTPHEAAMGFVPGKSVATNAKMHIGQRYVYNLDLKDFFPSISSGRVFKRLQAKPFGLKEDISRIITDLCCYENGEHRHVLPQGAPTSPTITNFICERLDVKLSRLAKAYGLNYTRYADDITFSGMNDLFDIDGKFCKSLHHIIEDEEHFVINQKKTRRCHAGMRQEVTGVTVNQNTSVSRKYVKQLRTLIHNWEVKGHDEAQAIFLSNYSSTKYHNFRGVHHIENVIEGKLLYMSMINGNEDSTYSQLVVRFKSLLETIVSGKANAEKGLGNDTSSLGKGGNCITISDILDIWGKSGMVDALEVFKENIGILTQKDTFPTGFKTSDGDPFLDSNL

SEQ ID NO: 144 - protein, 386 aa, unidentified
  source 1..386: note = Related to JAFPVX010000018.1; note = Bacteroidales bacterium
MRLTDCIGLQAQPQSVSPAPKDVSVRLRDLWRCLESKQDLLRLINIALEGLYGDMAQMITMKQLINMVYTANGEHRYTSFQIPKKKKGEFRTIDAPIPTLKNIQRGLNSVLQAVYKPHQAAKGFVKGFSVVDNARAHISQRYIFNIDLKDFFPSIHSGRVYARLLAKPFSLPPEIASIICDLCCFTNSEGHKALPQGAPTSPTLTNIICERMDRKLLKLAKAYNLQYTRYADDITFSGSTFMFAPEGRFCTLLQHIIEEEEHFTINRNKTRMGHRGTRQEVTGLTVNNKPNVSRNYVRQLRTLLHNWEMKGYQKAQTEFLAHYAEINTKNLQWDGTHKIENIIAGKLLYMKMVKGETDSTYKGLKIRFDQLMQNRRKYIKSLTNPI

SEQ ID NO: 145 - protein, 397 aa, unidentified
  source 1..397: note = Related to JAFZTV010000005.1; note = Bacteroidales bacterium
MTKQEIDEKIKAQWSAMETKQDFLRLLNLSNCALYAEKAQPFTFRQLLFHAHTTRNKKRYVSFKIPKKKKGEFRVIDAPNPTLKSMQRALNYALQVIYEPHAAAMGFVPGRSIVSNAQSHTNKRFVYNIDLKNFFPSISSGRVFARFQAKPFSCNKEVASLIADLCCYRNDFGTVLPQGAPTSPTITNIICDRLDVKLTRLATAYGLHYTRYADDITFSGMSNMFAEDGRFCQSVKHIVEDEEHFTINKDKTRLCHRGIRQEVTGITVNEKPNVTREYVKQLRTMIHNWESQGYERAQARFLEIYNKTNTRYHKAKGNHHIENIISGKLLFLKMVKGENNAQYKKLDERLVALESTHTDPIPQNRSNAVIPPAMGDNIISNEKEILEEFMTLNKLLE

SEQ ID NO: 146 - protein, 337 aa, unidentified
  source 1..337: note = Related to JAGCFV010000210.1; note = Salinivirgaceae bacterium
MDKDKLSLLSSLSKEELFNLFSTFVESQNAVQNTDSETVDFANQAKEMWHKLSNEADLRALINTVSVKVFGKFQYTEAQFGHCFNINHSRYTTFEIPKKKPGEYRTIKAPNPTLMGMQQCLNYVFQQLYQPIECATGFVPGRSIVDGARVHLSQKYVYNIDLKDFFTSVTAQRLVNRLQIEPFGLSEDMAQLVANLCCDKTKYDKFVLPQGAPTSPTITNFICDSLDRKLIKLAAAHNLRYSRYADDITFSGMQNVFAANGRFCKSLRHIIEREERFTINPAKNASLSSRNAARSNRHNCKPKTECFASLYQTVTCAVKQLGEKRIRHSASRILETL

SEQ ID NO: 147 - protein, 405 aa, unidentified
  source 1..405: note = Bacteroidales bacterium; note = Related to JAFUVT010000003.1
MPESEQKTEEKEAKVELLRILNVMKKKLYGDNSYPITMKQLNYHAYSKNNPKRYVQFQIPKKKAGEFRTITAPNAGLKAIQRCINALLLEQFEAHPAANGFVPGKSIVDNARVHLGQKYVYNIDLKDFFPSVTIGRVFACLQLPPFSFDKHTASLIADLCCHEGVLPQGAPTSPTLTNIVCSRLDWRLSKLARRFDLRYSRYADDITFSGMSNIFHEDGAFVKDLRHFVEKEGFLINETKTRTNSYYQRQEVTGLTINEKPNVTQRYVKQIRTMLHNWEASGYEAAQSVFFKHYHPTKNVNAEHHIENIIGGKLDYLKMVKGVDDATYIKLRDRFGDLLSGREKTNSTARPGNVIPVVDISVLNEGNIIDIELVNEEEQKSKDTHGLLDEKLQQLCESGFDLSIL

SEQ ID NO: 148 - protein, 357 aa, unidentified
  source 1..357: note = Related to JAFXXO010000127.1; note = Bacteroidales bacterium
MEQLNKFKKELYGENCHAITMQQLNFHAYSEHNSKRYIQFQIPKKKKGEFRTITAPNKGLKCIQRCLNAMLLRQFAPHPAANGFVPGKSIVDNARVHVGQKYIYNIDLKDFFPSVTIGRVFACLQLPPFKYDRETASLIADLCCHEGVLPQGAPTSPTITNIVCQRLDWRLSRLALRYNLHYSRYADDITFSGMTNLFHEDGDFVKALHHFVEKEGFTINEAKTRVNSYYQRQEVTGLTINEKPNVTQRYVKQIRTMLHNWEVNGYKYAQSEFLKHYHTTKYINFKGEHHIENVISGKLDFMKMVKGEKDHTYLKLKERFDRLTIIDVSGILDVWEKEGIDAAMDLFMNVKKHNGDE

SEQ ID NO: 149 - protein, 432 aa, unidentified
  source 1..432: note = Related to NZ_MJLH01000003.1; note = Campylobacter sp.
MEKSLKDEINAIIDDCCAKYSSFSIETFIDIVNEIHSKVFQESYLIEIETLKKIANSVDKYDKFEIPKRSGGVREIYAPKKNLKKILYYLNFIFQNIYVRNFSLYISPNGFIPNRSVVTNAKRHLCKNYVFNIDLEDFFPSIKQYKVSFMLQIAPFNMSKNDANLMAKLICYQDQNGESFLPQGAPTSPIISNFACRFLDIKLVNLAKQFRLTYSRYADDITFSSNYNVYDDKFMDALTLVIEEEGFKINKNKTRLQKRNMRQEVTGVIVNYKLNVYRTYIKKLRVLLHMVKKYGYEKANEIYNQKEQSDKQKDLKSTIAGKLNYLKMIKGSNDTTYMGLMNSYVELFDIKQKNKPPIPDDESLIVCETAEKLLKELTASNNLILTNIKNESNYLNLPKTQNVSNSKVANSEKAITTESLVDRILSKLREIL

SEQ ID NO: 150 - protein, 663 aa, unidentified
  source 1..663: note = Related to NZ_NHYM01000017.1; note = Helicobacter sp.
MNIKSINGIKNINDLIDIIYYYNDEHNIENNLHIETSTINFLAFYAKKKYKKFEIPKNNGEFRTIYAPTKYLKTILKSLNYAFQAIYKNNQVAHGFLPNKSVATNAKKHISKNYVFNMDLKDFFQSIHQARIWKMLQISPFNLPKDMANLLAGLLCYQYPRESKEKSFLPQGAPTSPIISNFICYRLDKSLLELAKKHNAIYTRYADDITFSSNINLYKKDSEFLQKIYRIINNEGFSINENKIRLQGKGYRQEVTGIIVNEKINVSKKYIKNLRALIYMLEKYGEKEANEFYYTNHAKSLNMVISGKLNYLKMIKGESDSTYLKLKEKFEKLAKNDVLIKEPNKESAQKTKRNPKQNPNAKHNPKALVDILRKFSQSDSPFKATVHNESNYPSYNGYDNFMTSLNKEWNEIQKDLNAYSYRLYNKLLGFLFKSTEELTNADNYKGWGESNVKIGWSSSEISEYCKANDKNNPFEYKLPDRYIIEHKNGSITTFGDICMKIFKYEIEFRDENQQFFKLIQDNRKKLGSGFNVKIDEKIQGVSFYSDTHLVSEAINKIFNQFIERKKYINIRVSMETTDEYHKFIFSQLESKCNKGSKEMLKEIKDGDFEDIKKRLFSLCDWSIEAKCSDGNFRINYLKSDNEKDIDKLPDAPEGFTHILRFYK

SEQ ID NO: 151 - protein, 545 aa, unidentified
  source 1..545: note = Campylobacterales bacterium; note = Related to JACXTV010000190.1
MSKTRVYELAKILKVTSKEIISKANELNIAVKSHSSSLDEDALKLITDAFATKPQIKNNTSATIKITLKDKEQTSLNEHIQKAFNELRNIEDLASLINKVNKTIYEHTHKIKVKHLTYHAYHSKDKYQVFKIPKKSGGEREIYSPSKGLKYILKTLNIIFQALYKPQSVAHGFLPNRSVVTNAKLHVNKNYVYNIDLENFFPNIHQARIWKRLQHPPFNLNGKRIEIANLLANLVCFQYEKSSNEKNFLPQGAPTSPMLSNIICHRLDKKLLELAKAYNVKYTRYADDMTFSSDHNVYQKNSEFLQKLFSIIQSENFKINPKKIRLQKRGYKQEVTGLIVNEKINVSRSYIKNTRALIHLVEKYGDEKAQKIFVEKNGSKNLDLVIFGKLQYLKMVKGSEDSTYTTLYQKAMNAYKMIEVEVTKSNNDEKKQTEIIKKNTINEQHNPKELVKILRNFTTCEKPPCALKAAVHSEEEYYQFNGYEDYIRNLKSAWRKIDNPLRNLSKRLHGKIYAFLFASDLGTQERVDKSKSKNSGWGDSGMTFG

SEQ ID NO: 152 - protein, 668 aa, unidentified
  source 1..668: note = Related to JAKKOW010000003.1; note = Aliarcobacter butzleri
MPINKVTPDQKNKIEILFNKISNIDDFLSLINKVNKIQYQEYKKLELKQLTYYAFINKSKYTTFEIKKKSGGNREIYSPKTGLKYILSAINIILQSVYKPTIATHGFINHRSIVTNAKNHTDKIYVYNIDLENFFPSIHQARVWKKLQLPPFNLCENKIQISELIANLVCYQHIEKTTEKNFLPQGAPTSPIISNIICERLDRRLLGLAKRFNLKYTRYADDITFSSNHNVYQKNSDFIKELNSIISKENFKINSKKTRLQKKEYKQEVTGIIVNKKTNVSKKFIKELRTQIYLLEKYGVKKSKSIYKEYYKKINGDIELIPNMMNVIYGKLKYLKMVKGQNDSTYLKLNNRFENCFKNKKHFASQNFTSYELKEFSNHQPQKMVELLKKFTSEEPLKSSTHPTKNNECYLDFIKELRVTWKIYEEEYKDFINEKLISKIYTFLCNPNPKNGWGIDNIKLGWTSSKLKKWCEKNPNLMPNKFPIENTIYTFQDIINYFKMEIEITPNRNNLYSFLFDIMDNELCQFEKLTDEETEEILDEAKFFIDTQWIKEGLELIFNEINQRSSVSKRIRIQAKKNKEFIELKITHINSFSKFSPEKLLERLENGVGSFPYIQQKFTSLCDIALQSKYHSSIFKINILNNYNDEEKLIKDINTEEEGFTYIFRFYR

SEQ ID NO: 153 - protein, 569 aa, unidentified
  source 1..569: note = Related to DQSZ01000242.1; note = Flavobacteriaceae bacterium
FVLNKSNVTNAKVHIDKNYIYTIDLKDFFSSIHQARFWKRLQFPPYNLDGTKIELANLIANLVFLQTEKQEEKNFLPQGAPTSPIVSNIICERLDRRLLGLAKRFNVKYTRYADDITFSSNHNVYQKDSELIIELNRIIANENFEINPKKTRLQKKGYRQEVTGIVVNSKANVRRKYIKEVRTYFYLIEKYGLEKAERVFVQHQYKNNPNLKNYKYLSSVLLGKLEYLKSVKGKEDSTYLKLKNRYDICFPKEETSKEKNLKLKKEPIHNPKEVVAILNLFTQNNNILKYTTHNWDKEELDSLDNFLKEIKIEWNKVNNRLKELTPRLHAKIISFLFSKKLGTLNLTDNRNKVWRWGMSQIQFGWSSPKLREWTKEGNSPFSYVLDEKYRKKIDGKSIDRFSDIVEVFKNEIEIRSDNNQLKKLFISKQKKYLGFDFNVEFVNLEGVDFYTDVQHLDFGLNEIFKEIKQRKLFPKIKIEAIKNIEAGFIELCITHIDSFPNKTKEEMIKEVEDGDFSKIKEKFTSICDWSIASKLSDGNYKINYLGGEESFEKLNEEPIGFTHILKFYK

SEQ ID NO: 154 - protein, 690 aa, unidentified
  source 1..690: note = Related to NZ_KE387264.1; note = Chryseobacterium gregarium
MELDSKDKIYIYNSFYKMNNKLDLLQLINFCKKKIYGEEAHPISLKQFNYHINPLYNNFRYNSFIVKKKSGGDRIIFSPNNGLKVIQKCLNLILQVVYKNPSKYATGFISGRSIVDNAKIHVNRNYVFNIDLKDFFYSIDQARVWGRLQVQPFNFSKKENKLELANIVASLCCHSIEVERFVEGTWIKNQKNVLPQGAPTSPVISNIICERLDYYLSAVAKRFGLKYTRYVDDITFSSDQNVYQVDGDFRKELEKIVQQEGFYFNVNKTRLQKRGFRQEVTGVIVNEKVNTNKHFVKRLKKWIYLWENYGYERASIFFKSEYEADKLNFKTTPSLVSVLRGKLNYLKMLKGDKDSLYLNLNSKFDKLLNGSIDQKSSLIKITKPAIPVIHQPQKLVAILKKFTTNNTALKYSTHTWDGGKDTEIFANIEDFLIMAEREYKTISYDLSILSKPLNAKIWTFLFSDNFSKNGWGMFNVRFGWNSMELHKYLNGNPNNKPESYILPEEFQQNIKKYGKSFLIQSFKNVIDLFKNEIEIRDENSTLEDIVISLHKTYLNGFNILKIENLANKNFYTDVDYLYKALELVFHNIQKRPQYPNVGYIGYDFEDYFCLEIMHFESNAKGKSFKDSKFTLKEGDFGTISNYLKNLCDWSIESSFSEGTYQVNFLSSKNISPYKLKSSSEGFKYIFKFYK

SEQ ID NO: 155 - protein, 690 aa, unidentified
  source 1..690: note = Related to NZ_QDFZ01000026.1; note = Chryseobacterium sp.
MELNSNDKRYIQATFFKMKNKADLLYLINFCKKKIYGEDAYDISMVQFNYHIVPSYNNYRYITFKVKKKSGGDRTIFSPNNGLKVIQKCLNLIFQIIYNLPSKSTTGFVPGRSIVDNAKVHINRNYVFNVDLKDFFNSIDQARIWGRLQIQPFYFSKKEKRLELANIIASLCCHPIEVERFVDGCWIKQIKNVLPQGAPTSPIISNIVCERLDFYLNAVARRFNLKYTRYVDDITFSSDHNVYQSDGEFRKELVRIITKEGFYFNTNKTRLQKRYFRQEVTGVIVNEKVNANKRFTKRLKKWIYLWENYGYRKASLFFISEYKDDKINLTSIPALEDVIRGKINYLKMLKGDKDSLYLTLKSRFDKLLNGPINHESQIIKIIKPPIPIIHTPKELVSILKKFSSNNTALKYSTHTWDGGKDNEVFDSIDDFLIKAEMEYKLISYELSILSKWLHAKIWTFLFSTDFSKKGWGMFNVRFGWSSIELRDFLNANPYNRPENYILPEKYQQGIKRYGRNFIINNFKNVIDLFKNEIEIRDENSILEDIIISLHKTHLNGFNIDKLENLSNKNFYTDVDYLYKALELVFHNIQKRPQYPKVGYYGYDFEDYFCLEIIHYESNAKGKSFKDSKFKLKEGDFGTISVYLRNLCDWSIESGFLEGDYRINFLASESIMPYEKIDFSEGFKYIFKFYK

SEQ ID NO: 156 - protein, 400 aa, unidentified
  source 1..400: note = Related to SEAO01000540.1; note = Chryseobacterium sp.
MTILPDQKDYIQKHFEAMQNKIEFLSLLNYAKSILFGEKGEPFVIRQLNYYINTASKAASYQAFEIKKKNGGTRNILAPNQGLKAIQSCLSLILQEIYIVNAAAKGFVKGRSIVDNASIHIQQYYVFNIDLKDFFSSIDQARVWARLKMAPINLNSSTNRQELSNIIAKLCCHELEVERLNMEGEWEKQKKNVLPQGAPTSPVLSNLICEKLDKRLTGVARRFGLRYSRYADDITFSSLHHVYNNEGDFVREITRIINEQNFHIKETKTRMQGQGYRQEVTGLIVNERVNVPKRYTKELRKWLYLWENYGHDRAYLFFKQSYLNDKIRDNRFKPDMIKILAGKLDFLKMIRGAEDHMYKKLQQRFLALIPKTSSLSKVLDTWEELGIEKAMEEYYAHRTA

SEQ ID NO: 157 - protein, 701 aa, unidentified
  source 1..701: note = Related to NZ_BMKD01000001.1; note = Mucilaginibacter rubeus
MELQKPQVEYIRKSFRKMQSKKDFLTLLNYVKNILYGEKFHPIVLKSLNYHSNPANNNRRYIKFSIKKKSGGSRIIHAPNKGLKVIQRCLNIILQALYDVDEHAFGFVPGRSIADNAHLHIGKAYVYNIDLKDFFTGVDQARIWARLKVKPFQLNGSVGRHELANLIAGLCCQSMIVERKGEDGAWLKEVRNVLPQGAPTSPVLTNIICQQLDYYLGRVALRFGLTYSRYADDITFSSSHFVYQKEGEFINELERQITDHGFYIKYSKTRLQKRGYRQEVTGLVVNSKLNVQRRYIKDLRKWLYYWENYGYKKASVFFESAYSADKGYLGATNPVMAKVIRGKLDFLKMVKGKDDPTFFKLNQRFEILTDIVKEELQNQNTAEPNCVAVPVIDGLPVLHTPLEVVKILKMFSINESALKFATHSWEAGLDDKIFKNYPDFIRKAKKEFNVVSSSLNELNPQLRAKILSFLFNKRVGIKWGMRRVRFGWSSPELKEAMERTPEMMPENMVLPEHAQFRVTSQRGGTQTIQKFKQVIDIFKNEIEIRNDGPVLEELIYDYHFKHLQSFEIMEFTNLNDKNFYTDVDYLHKALDLVFGNIAKYPGNEKLVGYRLIDDPSYYQLAIINYGSRLRGVSIASEKFLLTKGDFGTIKKRLNNLCDWSIETEFAEGSYRLNFLASDPNTASVEPIQYAVGFTYLFTFYK

SEQ ID NO: 158 - protein, 405 aa, unidentified
  source 1..405: note = Related to NZ_QMDV01000006.1; note = Pontibacter arcticus
MKLAEEKSQHILTAFSNLKSKEDFLELLNYTKIIIYGDKAIPFTLKQVNYYSNPRINIERYAAFTIKKKSGATRVIHAPTKGLKAIQKCLNLILQIVYEQHQHKAATGFIPSKSIVDNALLHVRSIYVYNIDLKDFFPSIDQARIWGRLKFPPFNLNDKTGRLEIANIIASLCCHEMEVERIKPDGSWQKEKRNVLPQGAPTSPTLTNIICQQLDFYLTAVAKRFNLKYSRYADDITFSSHHNVYQEGSIFLHELHRIIAAQNFHIKPSKTRLQKQGYRQEVTGIVVNEDVNVPKRFVKQLRMWLYYWEQYGYERAYTYFLQQYSADKGHTKKGRPDMANVILGKLKYLKMVRGADNHMYQKLAYRFEQLSKENLNQEDRPAHLNKVLSILIHKGLDEAMDFYKR

SEQ ID NO: 159 - protein, 742 aa, unidentified
  source 1..742: note = Related to NZ_LVWA01000005.1; note = Pontibacter flavimaris
MSIKEEQSQYILSSFSSMKSKEDFVGLLNYAKVIIYGDKAVPFTLKHLNYHSNPQVSKNRYTAFTIKKKSGANRTIHAPSKGLKAIQKCLNLLLQIVYAQHQHKAATGFVPGKSIVDNAKLHTNSIYVYNLDLKDFFPSIDQARVWGRLKFPPFNLNEKSGRLELANMIASLCCHQLEVERLQPDGSWQKDVRNVLPQGAPTSPTLTNIICQQLDFYLSAVAKRFNLKYSRYADDITFSSQHNVYHEGGEFLNELHRIIAAQNFHVKPSKTRLQKRGYRQEVTGIVVNEHASVPKRYIKQLRMWLYYWEQYGYDRAYSYFVQQYKVDKGYTKKGKPNMANVIKGKLDYLKMVKGSDSAVYQKLTERYDLLRKEEPAKTKLTIFSTISETSESDSSFIKIVVENSASPSIPDKLTREINIPKDTVLPHVLLIDNKLVIEGTTPTKKLLPHNPMHTVSFLKKFKIADGSGFKELVHDVILSDEIVDDIISKVKSHPNFIYHYKQERVSNIEYINVGIQSEVIQLINLFESEGIPFYKETGKHPFNNDEKYTEFAKKFKKKYRYGSGSEYSKLHQDILNIAIDQKIPQDCIEFLPDERAFNIRSGFFTWQPLIYRGLRHIFQCIADHSNIHGESLKHVDDKEVLVKAEKGDADGHKFIEVSILDKNSKATIDSDLLLHFYKESTAFKQDFRNLCDWFIECDFTAEPPKRINLLIARRLGSESVEIEPLSNPVGGFKHVLRFYDVR

SEQ ID NO: 160 - protein, 724 aa, unidentified
  source 1..724: note = Related to NZ_LRML01000007.1; note = Rufibacter roseus
MKTKKDFLGLLNYTKGILLGDKAVPFELKHLNYHSNPKANPKRYVAFAVKKKAGGTRTIHSPAKGLKAIQKCLNLILQVVYANHQHKAANGFVPNKSIVDNARVHANSLYVYNLDLKDFFPSIDQARVWGRLKFPPFNLNEKTGRLDLAGIIASLCCHSMEVERLDDAGNWKKEIRNVLPQGAPTSPTITNIICQQLDFYLTAVARRFQLKYSRYADDITFSSQHNVYHKDGEFLQELHRLIAAQNFHIKESKTRLQKQGYRQEVTGLVVNEEPNVPKRYIKQLRMWLYYWEQYGYDRAYSYFMQQYKADKGHLIKGKPDMANVIKGKLDYLKMVKGTESTGYQKLAERYILLTKQEPVAEEFTVSNDISGMSELVSSVIKVTLENSGLPSNPNKLIKAINIPKDTILPSVLLIDNKITTESTSSNKLFPHNPLHTVSFLKKFKIADGSGFKELVHDIILSDEVVKDIITKVKSHPNFIYHYKKERVLSIDYLNIGIRGEVIQLIDLFESEGIPFYKETGKHPFNNDEVYTVFAKEFKKKYRYGSGSEYSKLQQDILSIASDQKIALDCIEFLPDERAFNIRSGFFTWQPLIYKGLRHIFQGIADHSNINGEDIKCINGREVQVRAEKGEANFCKFIEISILDKNSKAKIESDLLLHYYKESTAFKQDFRNLCDWIIECDFTVEPSKRINLLTASHFNYNIDEIEPLDHLVGGFKHILRFYDIR

SEQ ID NO: 161 - protein, 705 aa, unidentified
  source 1..705: note = Related to PPEG02000007.1; note = Chryseobacterium viscerum
MKLDQATINHINTTFHKMKSKNDFLSLLNFVKGKIYGEKIHAFEIKNLNYYINTKSKQNRYTKFIIKKKSGEDRIIHSPAPGLKAIQKCINVIFQSIYEVNPAATGFVIGKSIVDNGIVHSGKNYVFNLDLKDFFSSIDQARIWGRLKVPPFNLNEQNGNLEIANIIASLCCHEMEVERFDAINNKWEKVIKNVVPQGAPTSPTLINIICQKLDFYLSAVAKRFSLRYTRYADDITFSSDHNVYHNNGEFLTEIKRIIKSERFDIKDSKTHLQKRGYRQEVTGLVVNVKPNVHSKYVKQIRHWLYIWEKHGYEYASKFFINPYLKNKINPKDNIPDLYIILRGKLNYLKMIKGSDNSTYIKLSNRFDLLNSSEKKVLQEQSERIILSKILPTTENDKVYILPIIHTPKEVVKILNKFTLNNSALKYSTHNWDSGQNEDIFKDLADFIKKARSEFYPASEQLKMLKKELHAKIFSFLFNEKVAEKGWGIHRIKFGWSSPELLKEMENNIIKPENCILPKNAQFILKTNTGNQTIQKFKQVIDIFKNEIEIRDENSILLNLLLEKHDMHLNGFEIKEAKDLENTNFFTDVDYFSKALTLVFENIQKRPEHKIVSYVIKEKSDSYILEIMHHNSTAKGKSYKDKKLSLQSGDFGTIKMHLLNLCEWSVESEFKEGPTRINFLHSNEDTLPYEKIDDVKGFKHVFKFYK

SEQ ID NO: 162 - protein, 689 aa, unidentified
  source 1..689: note = Related to NZ_JPRO01000006.1; note = Chryseobacterium luteum
MKSKNDFLSLLNFVKGKIYGGKIHAFELKNLNYYINTKSKQNRYTKFTIKKKSGEDRIIHSPVPGLKAIQKCINVIFQSIYEVNSAATGFVIGKSIVDNGIVHSGKNYVFNLDLKDFFSSIDQARVWGRLKVSPFNLNEQNGNLEIANIIASLCCHEMDVERYDAINNRWYNVTKNVVPQGAPTSPTLINIICQRLDYYLSAVAKRFSLNYTRYADDITFSSNHNVYQSGGEFITEIERIIRSEKFDIKDSKTNLQKRGYRQEVTGLVVNIKPNVHSKYIKQIRHWLYAWEKHGYEYASNFFIKQYLKDKINPKTNTPDLYSVLRGKLNYLKMVKGFENSTYLKLSNRFNLLIDFSDKNVTLTQSNQVTVSEVLPDLKNNKISKLPIIHTPKEVVRILNKFTLNNSALKYSTHTWDAGQNEDVFKDLPDFLKKANREFNPVSESLKTLRKELHAKIISFLFYDKVAEKGWGIHRVKFGWSSPELLAEMQITNIKPENFTIPEKAQFSLETTRGIQTIQKFKQVIDIFKNEIEIRDENSVLRELLIEKHNTHLNGFNIREMRNLENTNFFTDVDYFSKALTLIFENIQKRPQHKFVSYILKDEEDSYILEIIHHDSTAKGKSIKDNKLSLESGDFGTVRMHLLNLCEWSVESEFREGPTRINFLDSNQDTPPYVKIDQAEGFKYIFKFYK

SEQ ID NO: 163 - protein, 706 aa, Flavobacterium sp.
  source 1..706: note = Related to QJQY01000044.1; note = Flavobacterium collinsii
MKLDQTVIDYINTTFHEMKSKDDFLSLLNFVKKKIYGELTHPFEIKNINYYISSKSKQNRYTRFVIKKKSGGDRIIHSPVPGLKALQKCINIIFQCTYKVNPAATGFVIGKSIFDNAIVHSGKNYVFNLDLKDFFSSIDQARLWGRLKAAPFNLNESSGRLELANIIACLCCHEMEVERYDPINNQWYKAIKNVVPQGAPTSPTLINIICQRLDYYLSAVAKRFSVNYTRYADDITFSSDHNVYQKNGEFITEVERIIKVENFNIKDSKTHLQKRGYRQEVTGLVVNHNPNVHNKYIKQIRHWLYAWEKDGYEYASNFFIEAYLKDKINPKATTPDLSNVLSGKLNYLKMIKGFDNPTYIKLNARFESLLIKGDKKNKETTADQSLTMDGLSEIEYSKVSNLPVEHTPKEVVRILNKFTLNNSALKYSTHNWDAGQDDGIFKDLPSFLKKANSEFNPVSEHLKMLRKELHAKIISFLFYDKVAEKGWGTYRIKFGWSSPELLLEMQNNNIKPENFILPQSVQFLLETNTGVQTIQKFKQVIDIFKNEIEIRDENSMLRDLLLEKHDKHLEGFNIREMKNLENTNFFTDVDYFGKALTLIFENIQKRPEHRFVSYVLIDESDGYILEIIHHGSNAKGKSIKDKKLSLESGDFGTIKTHLLNLCEWSVESEFKEGPTRINFLDSDKNTLPYVKLDQADGFKYIFKFYT

SEQ ID NO: 164 - protein, 705 aa, Flavobacterium sp.
  source 1..705: note = Related to NZ_VAHC01000003.1
MKLDQTLIDYINTTFHEMKSKDDFLSLLNFVKKKIYGEDTHPFEIKNINYYISSKSKQNRYTRFVIKKKSGGDRTIHSPVSGLKALQKCINLIFQSTYKVNPAATGFVIGKSIVDNAIVHSGKNYVFNLDLKDFFSSIDQARLWGRLKVAPFNLNEQTGRLELANIIACLCCHEMEVERFDTINNQWNKVIKNVIPQGAPTSPTLINIVCQRLDYYLLAVAKRFSLNYTRYADDITFSSDHNVYQKNGEFIAEVQRIIEKENFNIKDSKTRLQKRGYRQEVTGLVVNHKPNVHNNYIKQIRHWIYVWEKFGYEYASNFFIKQYLKDKINPKTNTPDLSNVLSGKLNYLKMIRGFDNSTYIKLNDRFELLLNISIQKNENIVADQSTLLGMPEVENNENFKLPVLHTPKELVRILNKFTLNNSALKYSTHNWDAGQDEDIFKDLPDFLKKASKEFNPVSEYLKSLKKELHAKIMSFLFNEKVGEKGWGIYRVKFGWSSPELLKEMQISDIKPENFTLPQNAQFRLETNRGNETIQKFKQVIDIFKNEIEIRDENSILQDLLLEKHDKHLNGFEIKEMQNLENTNFFTDVDYFSRALTLIFENIQKRPEHRFVSYILVDEPDSNILEIIHHGSTAKGKSIKDKKLSLESGDFGTISMHLRNLCEWSIESEFKEGPIRINFLDSDKDTPPYVKIDQVDGFKYIFKFYK

SEQ ID NO: 165 - protein, 686 aa, unidentified
  source 1..686: note = Related to MTQF01000001.1; note = Flexibacter sp.
MILKTENIIFIKETFQNMKSKHDFLDLLNYVKPFIYGEKTQSFDLNHLNFHSNSNTKKYKSFIVKKKSGADRTINSPSKGLKAIQKCLNLIFQTIYDVHPSVYGFVKSKSIVNNANIHSGNHYIYNIDLKDFFSSIDQARIWGRLQYPPFNLNKERDLLEVANMISSLCCFKIDVERLDENNEWQIVNRNVLPQGAPTSPTITNIICQQLDFYLTAVAKRFGLRYSRYADDITFSSMHNVYNENSDFIKELNRVISSQNFHIKQSKTRLQKKGYRQEVTGLIVNAKPNVNSRYIKQLRMWLFYWENHGYEKANLFFGSQYFKDRGYVKKRVPNLEFVLDGKLNFLKMVKGAENGTYLKLYERFRVLSEKKISFQAVQISNIKEVKHDPQETVKLLKFFKYDNKYSFKQLVHKPVNENDFNFIEILKTANKQFMDFSVDNNNKLNIPKDLISGVQNLFEILRTSGIDFYNINNLHPLEDKNIGAKIQLFKGDYRFGNEKSESSILSDLIIRTALKKEFSDQINNIVYSFGENDNSGLFDYKQIIFYPELQKFQSKANFFTWVPNVKIALSIIFESILKHSNVNGNRNFTLEEKGIIINIERKAVNDLIKIELSILDKNSLLMGSIDNILSDMRRDFFPVLVGICDFKVQFKSIMEENYECRVLPYASKVKPIDEDPQGFKYIFTFYD

SEQ ID NO: 166 - protein, 692 aa, Flavobacterium sp.
  source 1..692: note = Related to NZ_LEKS01000017.1
MKLTQTDISFIKESFEKMRDKSDLVALLNYIKPILYGEKTYLFTVHDLNYHINNKNDNRYEKFEIRKKSGKSRVIHSPNNVLKSFQKCLNLVFQTVYKFHSSATGFIGGKSIVDNAKIHVGSNYVYNIDLRDFFPSIDQARLWGRLQYPPFNLNKENDNIQLANIIAYLCCHKYKVKRLIDGKWKIVEKSVLPQGAPTSPVVSNIICQRLDFYLSAVAKRFGAKYSRYADDITFSSVHHIYKENHAFILEVQKIIANENFTINPQKTRLQEGAYKQMVTGLVVNQNVNVSKKYIKELRMWLFFWETYGVQKATVKFNLYRAGQDIGSSSNMIKVIRGKLDFLKMVKGANNLAYLKLLKRFTELVSAQNSMQKKLDKQKHIETFKISDFNLHQKTTHHEPQKLVSLLNNFTAGSNLKYATHGWEEHETYDEFIIKLTRDWQKIEDDLFDLKKTFATKISVFLDSEKVEEIGWGAKTANERIYFGWKSKSLVEWSHANPNKSPFYFPIPQDKKVFFDGIQTNYFYDVTEIFKRQIEIREENNHLHNLFMDLRKNYLGYDFKLTSINTKGITFFTDVNTLKNGIIKIFESIKKRPQFPKIKIVVEHLENSIEIKIIHVDSICNRPINDNKILLANTGDFADLNKYFTNLCDWSIESNFIDGKSYRINYLDSRVGIDKISTISKREGFTFILRFYL

SEQ ID NO: 167 - protein, 442 aa, Flavobacterium sp.
  source 1..442: note = Related to NZ_CP089095.1
MILTPEFKFQVQTAFKEMQSKSDFLELLNIAKQMMYGDKTVPFSEKQLNYFITKDSQVIKSRVDFRIDLSKFEPFIEENVVIEKKNINRKDCYVPFIIKKKSGQDRTIHAPVKGLKEFQKALNIILQCLHEPHTAATGFVIGKSIVDNAKKHIGQTYVYNIDLKDFFPSVDRSRVWGRLLVAPFNLGTTVERKNIANFIATLCCTPMEVERFKEGNWIKITTSVLPQGAPTSPTLTNIICEKLDKRLNGVAKRFGLNYSRYADDITFSSKHNAYEVSPTKVEKIFASGTTFDCEVRKIITEQNFHIKETKVRLQKRGYRQEVTGLVVNDKINVTRLYVKQLRQWLYLWERYGYDKSYAIFLNIYLADKGHVKSEQPNMAMVIEGKLLYLKMVKGADDGTYLKLKKRFDLLLGTTSKNNSEAVNILDLIFDVGLDEAMTHYKK

SEQ ID NO: 168 - protein, 425 aa, Flavobacterium sp.
  source 1..425: note = Related to NZ_QLSZ01000003.1; note = Flavobacterium aciduliphilum
MQTKSDFLSLLNLAKLEIYGEKTIPFSEKQFNYYLTKDSSTFKSKIDFQIDLSGDSVVINENVIVEKKNQQRKSCYTSFAIKKKSGKDRTIHAPIKGLKEFQKALCLVLQCLYEPHSAATGFVLGKSIVDNAKKHVGQTYVYNIDLKDFFPSIDKSRVWGRLLVAPFNLGNSNERRTLANFIATICCTPMEVERFQEGKWITVTTSVLPQGAPTSPAITNIICEKLDRRLTGVAKRFGLNYTRYADDITFSSKHNTYEVSDSKVEKIFVAGSSFDCEVRKIISEQNFHIKESKVRLQKRGYRQEVTGLVVNDKINVTRRYVKQLRQWLYFWERYGYDKAYAFFLNYYLSDKGHIKFEKPNMAMVVEGKLLYLKMVKGANDGTYLKLKERFDLLVGTASKNNNEKATIVDLIFDVGLDEAMTHYKK

SEQ ID NO: 169 - protein, 452 aa, Flavobacterium sp.
  source 1..452: note = Related to NZ_OU957226.1
MKITLEQSKTIQEAFKKMDSKNDFLALLNEAKKLMYGDKTIPFEEKQLNYYISKDSIKNKSVKSEKNISTVLLKEETSFKASVRKPSYTSFTIKKKSGSDRTIYAPVKGLKELQKALNIILQAIHEPHIAATGFVLGKSIVDNAKVHVGQIYVYNLDLKDFFPSVDKARVWGRLLVAPFNLNTSDERKKIANMIAGLSCTPMEVERFIDNNWVKITTAVLPQGAPTSPTLTNTICERMDKQLSGVAKRFGLNYTRYADDITFSSKHNSYEVSPNKFEKIFVSGSTFDKEVRKIIANQNFHVKESKVRLQQEGFRQEVTGLVVNEKVNVTRRYIKQLRLWLYYWETYGYDKSYSFFLQKYCREKGNVKKGQPNMAMVLDGKLLYLKMVKGEKDETYLKMKNRFDVLVLNTTPSKSLVPNKLLEVKDTKENIGKNIVDLILEIGLEGAMKNYKS

SEQ ID NO: 170 - protein, 452 aa, Flavobacterium sp.
  source 1..452: note = Related to JABSNN010000002.1
MKLALEQINNLKTAFEKMDSKEDFLALLNLAKSFLYGENTVVFEMKQLNYYINKDQKTTNKKVNLEGLLNTGDDRFKTAVRKPAYTSFSIKKKSREDRILHAPVKGLKEFQKALNLIFQCVYEPHKAATGFVLGKSIVDNAKLHVNQNYVYNLDLKDFFPSIDQARVWGRIKAAPFNLETTVERQKIANMIAALCCTPMEVERNTNGEWKKITLPVLPQGAPTSPTLTNAICERLDLRLAGVAKRFGLNYSRYADDITFSSKHNSFEKTKNVFENIYLKDSTFDKEVRKIIASQNFHIKESKVRLQKQGYRQEVTGIVVNDKVNINQKYIKQLRQWLFYWETFGYDRAYQYFLQKYVANKGHVKKGQPNMAMVLDGKLLYLKMVKGETDPAYLKLRERFEKLIGSKSNISEILDLWETKGIDEAMKAFYFAKQQDVLPKVSTRLNVEDIFYL

SEQ ID NO: 171 - protein, 426 aa, unidentified
  source 1..426: note = Related to LMQN01000015.1; note = Chryseobacterium sp.
MKFTQEQKSQIRSLFDKMNSKSDFLFLLNKAKMIEYEDKMIDFEEKQLNFYINKDSTNKKDAESLTKNSKNFFYNSFSIKKKSGKERIINAPVTGLKNFQKSLNIILQCVFDCHDAATGFVPGKSIVDNAKIHVGQTYVYNIDLKDFFSSIDKSRIWGRLLFPPFNLNTSSQRKKIANMIAGLACTPMEVERFIDGYWCNIENSVLPQGSPMSPIITNIICERLDRQLTGVSKRFGLNYSRYADDITFSGKHNTYLKGLGVVEKIFEKNSTFDLEVRRIINNEKFHIQEDKVRLQKEGYRQEVTGLVVNNKVNVSKRYIKQLRQWIYYLETYGYDKSYSLFLSNYIDGKKNSSSQTPNMLMVIRGKLLYLKMVKGDKNETYLKLKNRFDSVIMPHSSISFIIDIWKNDGIEKAMEIYYNQKVKNEK

SEQ ID NO: 172 - protein, 442 aa, Flavobacterium sp.
  source 1..442: note = Related to NC_016001.1; note = Flavobacterium branchiophilum
MKTNVDQQTEIKELFQNMKKEADLWHLINVAKKHIHGTKASNFKPKLLQHLILKDAKEFNLENSTSVFYHQFEIKKKSGGIRTIHAPHPKLKEVQEALNYIFQCVYLPHPNATGFVVGKSIVDNAKKHVNQKYVYNLDLKDFFPSIDKSRVWGRLLIAPFNLKNSPKGIKIANMIASICCTKLDVERIKDGVSHTILTSVLPQGAPTSPTLTNAICEKMDIRLAGAAKRFGLQYSRYADDITFSSNHNACEYAKGKFEKIYKKNSVFDKEVRRIITDQNFRINESKVRLQVKNVKQEVTGITVNEKLNVSRDYIKQLRKWLYYWESYGFDKASTFFTQNYMAEKGHLVSKKPNMTHVLEGKLLYLKMVKGAEDSTYIGLKTRFEKLSGRVNKIDQLLDVWEKEGVEAAISFYNFGKKAKKIATIVDFESFLIDNINIDNKIL

SEQ ID NO: 173 - protein, 460 aa, unidentified
  source 1..460: note = Related to NZ_CP060695.1; note = Polaribacter pectinis
MKLAIDQEKKIKQLFAKMNSKEEFLQLLNFSKKIIYKEETIPFTITQLNFYISKDSNKFNSKKKYYHTFEIKKKSGAPRTIHAPCKGLLEFQKSLNIILQALHKPHEAATGFVPNKSIVENAKKHINKNYVYNIDLKDFFPSVDAARVWGRLKVAPFNLGSSDNRKQIANMIKSLCCHKMKVERFVDNNWIKLEKLVLPQGAATSPTLTNAICERMDIKLTGLANRFNLDYTRYADDITFSSNHNTYKISLEKEEAIFEKDTTFDIELRRIIKEQNFHIKETKVRLQKRGYRQEVTGLVVNDKINIKRSYIKSVRHNLYLWERFGYDKAYELFLNNYLKEKGHTKKGNPNMLMVLEGKLLYLKMVKGESDSTYLKLKSRFDKLSITPQPVEKIKKRLTLKEKRLKTDNAKNKSDISSIEFMKLVAKAKAKKEANKKKNINKILDVLFEKGLDEAMKLYDK

SEQ ID NO: 174 - protein, 440 aa, unidentified
  source 1..440: note = Related to NZ_SLUP01000001.1; note = Mariniflexile fucanivorans
MKPTPNQKYTIRQLFAEMKTKEDFLSLLNYSKEVLYREKMIPFSMKQLNFYGSPKFNIHRFDKKFYHEFEIPKKSGLKRLIHAPTKGLKEFQKALNLILHCVYEPHYAATGFVPDKSIVDNSKPHVGKLYVYNIDLKDFFPSIDASRVWGRLLVTPFNLGTTNERRYIANMIKILCCHYLPAERFVDNVWVTEKRHVLPQGAATSPTLTNAICERLDIRLSGVAKRFGLTYTRYADDITFSSMHNSFPNKEGVAETIFKKGSTFDLELRKVIESQNFHIKENKVRLQKKGYKQEVTGLVVNDKINVPRSYIKDLRHWIYFWERYGYDKAYELFLKKYSNNRGHVKKGKPNMGMVIEGKLLYLKMVKGSEDSTYLGLRERFKTICDENSNDNNKTVNTHIEGLLEEFFLKMDKPIENTNTQKILDLIFEEGLDRAMELYKT

SEQ ID NO: 175 - protein, 434 aa, unidentified
  source 1..434: note = Related to NZ_CP019333.1; note = Gilvibacter sp.
MKLNTYQTEYIRDLFANMSSKKDFLFLLNKVKELIYKEKTIAFSEQQLNYYINLNPNVKMEKKYFSFSIEKKSGGTRTIHAPSEGLKEFQKAVSIILSAIHQPHDNATGFIQNRSIVNNARKHIGKNYVYNIDLKDFFPSIDANRVWARLLIEPFNLGTSVERKKIANMIKAICCTNMEVQRLIDDKWESVNLNVLPQGASTSPVLTNIICDRLDKRLTGVAKRFGLNYTRYADDITFSSNHNVYRLDSGDTETIYTANSSFDREVRRIIVGQKFHVKESKVRLQKRGYRQEVTGLTVNEKVNVPKRYIKEIRHWIYFWERYGYDKATELFRVKYRKDKGHIKNDSPNLIMVLEGKLLYLKMVKGEYDPTYVKLRSRFRELLNPDSAITINLSDDNYESIILDTIFSDGLDEAMKEYDPVYIEIMSPEQRNKDV

SEQ ID NO: 176 - protein, 377 aa, unidentified
  source 1..377: note = Proposed Natronogracilivirgula saccharolytica; note = Related to NZ_JAFIDN010000022.1
MEDLLSLIKLVNEMLYGETAKAVKLKSLTYYSNPSLRGDVYEKFKIPKKSGGVRVIHSPVSGLKSIQKAIAHILQSVFEPHPNATGFVTDKSVVDNAKPHTGKNFVFNTDLKDFFPSIDKPRFWKRLQYPPFNLNRNNGRLELANRISAICFTDLEVERKVEGHWKKQVKDVLPQGAPTSPIITNIICYRLDVKLTSLAEQFGCAYTRYADDITFSSNHNIYNKDGEFRASLKKLIKEENFHVKHQKTRLNTKTERQEVTGLTVNEKVNVNRRYIKQLRHWIYFWEQYGKEKAEELILNNYKADKGHVKNGEPDIENVIDGKLRYLKMVKGANDHSYRKLQHRFEVLTGISINFNPDRLFEVWDSDGIVAAMEYYYG

SEQ ID NO: 177 - protein, 454 aa, unidentified
  source 1..454: note = Related to SEFL01001225.1; note = Sphingobacteriales bacterium
MQFSAEHITHIRQEFATMATKEEFVALLNYAKEILIGDKYQPFELKQITYYANAKVSGVRYKKFEIKKKSGGVRVIHSPIKGLSIIQRCLNAILQCVFTPHDAAKGFVLGRSIVDNAKKHVGRNYVYNIDLKDFFPSVDQARVWKCLQLPPFNLVDSEKSQIVTRKTIKSEVLALMKANGLGEDRQTLNRALDKVSPQINKGRIHLAHIIASLSCTEMIVERCIDGEWQEVKKNVLPQGAATSPILTNLVCQRLDYLLTGVAKRFGLRYTRYADDITFSSQHNIFKEDGEFIKELRRIIAEQGFHIKESKVRLQQAAFRQEVTGLIVNKTVNVNQNYIKQLRMWLYNWERYGYDRAYNYFLPSYFASKTTPVKGKPDMANVIGGKLNYLKMVKGENNEMYLKLKERFDFLISNCLPIRSILDIWEHEGIEKAMGSFYNVKADQQVLSIIKGDLL

SEQ ID NO: 178 - protein, 401 aa, unidentified
  source 1..401: note = Related to NZ_BDCW01000118.1; note = Tenacibaculum ovolyticum
MKIEKKHINYIRNAFEKMQSSNDFLKLLNYTKPLVYGENYVPFELKQIVFYSNPKNTSKAYTEFQIKKKSGGIRTINAPDNHLKIIQKVLAFILQCIFQPHEAAKGFVKGKSIIDNAREHTGKNYVYNIDFKDFFSSIDKARIKGSLKNEPFNLNNKQALANIISEICCTEMDVEHKNEKGNWIRIKSNVLPQGAPTSPIFSNIICKEVDVKLTGVAKRFNLKYTRYADDITFSSMHNIYQENGDFLKELNRVIKVESFHIKESKTRLKKTGYRQEVTGLVVNDSVNVRKRYVKQIRMWLYYWEKYGYNKAKTIFLRDYIKDKGLLKSMKPNFKNVLSGKLEYLKMVKGASNSTYISLNLRFEKLSNKNNHIDRVLEEWERNGINKAILEYYRKPQQLFIQ

SEQ ID NO: 179 - protein, 480 aa, unidentified
  source 1..480: note = Related to NZ_JHZZ01000001.1; note = Polaribacter sp.
MKIEKEHIKYIQDEFATMQSREDFLDLLNYAKPLIYGDNYIPFELKQITYYANPKRSRKAYKEFQIKKKSGGVRTIYAPENGLKTIQKTIALILQCVFEPHEAAKGFVMGKSIVDNAKDHVGKNYVYNIDLKDFFPSIDQARVWACLKLAPFNLIDQKTSKEFDFKKLETGIRRFTTEFDEEIFYQLKGGTFLLVNDKKGNYKAYQKRLKKLDKDVFKDAAKYITTDANLKELEKLTVHREKLANMIASLSCTKMQVERKDENGSWVKVIRNVLPQGAPTSPVFSNIICQRLDKKLSGVAKRFHLNYTRYADDITFSSMHNVYQENGKFLKELTKVIKGQNFDIKESKTRLQKTGYRQEVTGLIVNDKVNVRKRYVKQVRMWLYYWEKYGYNKAESIFLKDYFIDKGHVKNAKPNFGNVLSGKLEYLKMVKGFENTTYLSLNKRFEKLLGVIDPIERILNEWENNGIDSAMKIYKTDIHE

SEQ ID NO: 180 - protein, 752 aa, unidentified
  source 1..752: note = Related to NC_015510.1; note = Haliscomenobacter hydrossis
MQLEQEQVEIIRTMFQQIKSKNDLLKLINFAKKLLFGEAAHAVPLKTLTYYGNANLASDAYRTFSIRKKSGGKRPIHAPVKGLKPIQKALNLILQCLFTPHHAANGFVPERSIVDNAKVHQGAHYVYNIDLKDFFPSIDLSRVAACLRLPPFNLIDTAEEPLAFLVANLCCTPILVERQNESGEWINKILNVLPQGAPTSPTITNIVAQRLDKRLTGLARRFGANFSRYADDITFSSMHNIYKQDEAFTIELTRIIESQGFYINPSKTRLQKTGFRQEVTGLVVNEKVNVHRRYVKQIRHWLYLWERYGYAQAEQIFKREYVKDKGYAKKGNPKLENVLEGKLLFMKMVKGGEDGTFLGLWRRFDHLLIELNEVRDNTSIPEEAFTEKEQLTRTIKISLLPIDDGKFIQTLQHDKLIPMGVALPYEETFENNIEETYEKPSLQHNPINTMNFLKNFKYDNASGFKELVHAPFDVDNFDFEKILDTVKNHPNFILTFKNTRAEKFTGELPLGLWKKAKELINHLSTEGLDLFKLTKQHPIESEKFLTEIQDFKKNYRFSSDDTESSILKKLIIHVAKKAEHKNSDKNIVFSFGNTDQSGQFSDDQLVFLPDERIFGLRSGFFTWVPNVRNTLAWIFKGILQHSNVNGSRTFEKKSKKIVVEINRFRDKDIGLTKVQLTISDEFSVLKKSPDQFLEDLLNSEPCKHYLRNIADWAIECDCDNGESYLFQILPKNDYKRLERKVNSFKHIITFYD

SEQ ID NO: 181 - protein, 418 aa, unidentified
  source 1..418: note = Related to JACJYR010000001.1; note = Lewinellaceae bacterium
MQINQEHIDTIKARFQQMKTKEELLELVNFAKTLVYGEKAKPVPLRTLTYYGNIQVAGSAYKEFSIRKKSGGVRKIHSPVKGLKPIQKALNLILQCVFTPHQAATGFVPEKSIVDNARVHRGMNYVYNIDLKDFFPSVDMNRVKACLRLPPFNVIYTDEAPLAFLIANLCCTPIEVERKNDKGEWEKKVMNVLPQGAPTSPTVTNIICQRLDRKLTGLARKYGAQYTRYADDITFSSMHNIYEESSEFIKLNEGYRNFIRDMVKIIEGQRFSINPKKTRLQKSAYRQEVTGLVVNEKVNVRRRYVKQIRRWLYLWERYGYVQAEAIFRNDYRADKGHVKKGEPSLQNVLDGKLLFLKMVKGGGDGTFSKLLERFTKLTDSLEQVRSENVDLDSVLDVLLNKGLDDAMNLFDKFKSLGQ

SEQ ID NO: 182 - protein, 429 aa, unidentified
  source 1..429: note = Related to NZ_JAAORA010000001.1; note = Candidatus Chlorobium masyuteum
MKIEQSHILEVRSVFEKMHSREDFLNLLNQVKPLVYGVKTVPIELKQLTWYANPNLGGKRYSDFSIKKKSGADRLIHAPVSGMKSIQKALSFILQCVFEPHKAATGFVIGRSIVDNARIHQGCNYVFNIDLKDFFPSINQSRVWACLQMEPFNLNEKKSIAPTESADKYFMVRSRTIAGRKQIANMIAAICCTEMTVERQDEKGEWVQVKQNVLPQGAPTSPVITNIVCKKLDHRLTGVANRFGLRYSRYADDITFSSMHNVYQKDGEFLKELHRIITDQGFHINEKKTRLQKTGHRQEVTGLVVNEKVNVQKRYIKQLRMWLYYWERYGYEKAERIFLEQYMDDRGHLLDGGKPNMINVLAGKLDYLRMVKGADNSAYKKMKKHFDNLIIENRSNVITDPLRVKELDDVLNTFFESGFDVAMNKYSMN

SEQ ID NO: 183 - protein, 382 aa, unidentified
  source 1..382: note = Saprospiraceae bacterium; note = Related to JADJUM010000002.1
MTNREDLLTLLNLANKHLHSNKALDFELKQLNWYSNPAINKRRYKTFSIQKKSGAERKIHAPVKTLKYIQQALCFVLECVFEPHKAAYGFVKNKSIVDNAQNHVGQIYVYNIDLKDFFPSIEAGRLFSRLQYPPFSLSDKRDVANVITWLCTEKLEVERFNKENSTWEAKELNVLPQGAPTSPLITNIICYKLDYVLSAVAKRFGLKYSRYADDITFSSMHNVYQKNSEFLTELKRVIQDQNFHIKESKTRLQKDGFRKEVTGLLVHESANVHKRYIKQLRMWLYYWERYGYEKAYGFFLPQYVGDRGNVKKGNPNMENVIGGKLEYLKMVKGVENELYLKLKDRLSILIGYTEPINQILDVWEIEGIEKLWKFIIRINETK

SEQ ID NO: 184 - protein, 716 aa, unidentified
  source 1..716: note = Flavobacteriales bacterium; note = Related to JACJZT010000003.1
MKLEEAHIKSIKSSFEKMKDKEDLLQLLNFVKPLVYGEKTIPFKLKQLTWYANSTLKGRRYKEFNIKKKSGEHRTINSPVSGLKAIQRILNFILQCVYEPHKAAMGFVNGKSIVDNARLHTGNHYVYNIDLKDFFPSIEAGRIWSRFQHPPFNLNDRTNRKELANIITWLCCCEMEVERLDEKNQWHIVKRNVLPQGAPTSPTISNIVCHQLDFYLSAVAKRFGLKYSRYADDITYSSMHNVYQKGSEFLSEVHRIISAQSFHINVNKTRLQKAGYRQEVTGLLVNENVNLQTRYIKQLRMWLYYWERYGYERASGFFLQQYVADKGHVKNGKPDLANVISGKLDYLKMVKGSENDLYLKLKNRFNQLTTKTIDQIDLSKVKKISKPSERESIIEENIDINNNNSYPILHNPQKTITLLKSFSVNEKDLKYSTHSWEEGKYNSYEEYIEKIRIEWNEIKDELKNQSPRLFAKISNFLFNNKLGQKNEEGYYISWGEKRLKFGWSSANLKDHMSDPGNSPFSCPIPDQIRELDKRHDLLYFKDYADVFKNEIEFREDSNNFKKMILELWEKELSYDFNIKGVEQFAGFSFFTDVHLVKESLRTVFRDMYKVKPQFPTIIIEKISSFNERGYHLIKVTQKDSFITRDVNDPKLTSPSGNLFSIIRNLKNLSDYSIVSRFRDGRNYRLNYLTSTKTDFIETLTQDENTLGFSHEFKFYL

SEQ ID NO: 185 - protein, 755 aa, unidentified
  source 1..755: note = Related to SEAO01000392.1; note = Chryseobacterium sp.
MITEKDKEYIDIAFHKMRNREDLLSLLNYAKTILFGQEASQIALHQLSYYANPKAGGKRYHTFRIAKKTGGSRKIHAPVEGLRVIQQCLNLILKCVYKTQQQAHGFAQGKSIKTNAAMHVGSYYVFNIDLKDFFPSIDQARVWKVLQLEPFNLLNREPAEQEGIDNYEIANLTAALCCTSMMVERIDEEGELIKVRRNVLPQGAPTSPLLSNVICQRLDFLLAGVAKRFGLKYSRFADDITFSSLHNVFQSHSPFTKELTRIIYDQGFRINEQKVRLQRSAYRQMVTGIVVNEKTNLTKKYLVSLRKWIYLWETYGFARTLEIYRQEYKLEQIKPLDIDLVAILRGKIAFLKNVLGDTNPRYKQYKYRFDALNAPTLAENMPVQGDAREMAKKLDRIDELLKSNKIPSVDASIEELREFVSLVHLRSEIPLIDNPSKETNLEDDIHDPRFVVSLLSKFTEETNLKYTVHMWDSENRYGSFQDFSSAIFADIRQYKLRSLPRYNSRLYWKIIYPFIIQEHTLKKKSGEPFEYAWGRYNLKLGYHYPSTLAQWMDSNPNKSPFMMPISKDLRPAEPIKGRSISYFEDVVDIFKQAIEFRGNDLYYLFKELTGSLLFDFNIELLNLKGISFFTDTHQVEKALRIIFSSIRKYTESPQIRVSGTYISEAHYFDIEILQLGSFCDKPIDDPKITLKGNKGDFNTIRTLLHSLCNWSVESRFRVGDKYKFYRLNYLNSSASDEIEEMDAAEGFKHRLRFYI

SEQ ID NO: 186 - protein, 739 aa, unidentified
  source 1..739: note = Related to NZ_CAKKMW010000005.1; note = Pedobacter sp.
MKSREDLLDLINYSKKALYGEDVEPITISQLTFYSNPSAGGKRYRQFNIAKSSGQYRAIHAPVQGLLLIQRCLNLILSCIYKPTPQAHGFTPGRSVKTNAFVHVGNYYVFNVDLKDFFPSIDQARIWRMLQLPPFNLVAKNDSRISPKNRYELASMISAICCTSMLVDRIDRKGNLTRVVRNVLPQGAPTSPFFSNMICQRLDQRLMGVAKRFGLKYTRYADDITFSSLHNVFHSHNPFIVEMRRIITEQGFTVNEDKVRLQRTGYRQMVTGLVVNEKVNVTREFIKSLRKSLYLLERYNEEKASQAYIKDNKLDDVSINDIDIQAIVTGKIAYLKDILGKNSPRYLSYKTRIDQLYPGKGTTVPVEKVDAKTLARNIDRVKHNLLNNELPTENASFEELRAFVRLLRDENSVSALLVDKAGQAEEDEIHDPNFVVSVLEKFTSETHLKYATHYWDTQDRYKNYNVFRKSIMEDVRLFKLRLLPRYNSHLYWKVIHPFLIRDKPDEKKSGEKFEYQWGRHKLKVGLQYPGILEEWMQENPGKSPFSMPIPKELRPPFRISGKSLTYFEDFVDEFKNEIEFRRNDLHYLIKDITSSMEFDFDISITNLKGLSFYTDTYQVEQALRIIFNAIRKYPGAPKIIVNGSYDTEAKFIDIDILHIDSFCDRPLNDRKLQLMDKRGDFFTIRKLLNSLCDWSIQSRFRVGNEYTSYTIHYLNSTGAQNPEKSADALGFLHKLRFYL

SEQ ID NO: 187 - protein, 761 aa, unidentified
  source 1..761: note = Related to NZ_JAFVME010000001.1; note = Pedobacter sp.
MKIEKDQKDYVVKAFHSMRDRDDFVKLLNYAKKIIYGEKTVFFDLRQLTYYSNPNVNFKRYKSFEIAKKNGKSRKIHAPVKGLLVIQKCLNLILNCIFQPTVFATGFVMGKSIVDNAAFHAGNYYVYNIDLKDFFHSVDQARVWKCLQLKPINLSLFQNPEDNKYNSSLEIVNIISALTCTELLVTRTDRNGKEIEVNKNVLPQGAPTSPLITNLVCQKLDYLLSATAKRFGLKYSRYADDITFSSLHNVYQQNSDFLIELNRIIKDQGFVINEEKVRLQKDGFKQMVTGLVVNKHPNVSKSFINNIKIDLYYWEHYGYVKATKFFLRRYKHTKESTKKVNVDMSNVICGRLQYLKMIKGANNKTYTSLALKYQKLLAKKQKSELNPEDVHFKSVESSGYDLTENGLINPDLKTFMVSILNSDQIALAEKQEIFANVNLELSRLVNNDNTGKNSLGSSSSINSSSVTTDGWKSEHSPKDVARFMSLFNKRDGLKYLTHDFDEEGKFEISFFLEKWRSIFEQSLRGKNGFEIPSSLYRIVNEFAFSGKPNWTSVNDRLVNEGWSTDKWIKWSSKNMLHPFRNTGLKVIIEDFRRLIRVESPNLEFLVNEAFSDALIDENNKYSLKLDQVSKADFYTHIPSLKRALFAIFSAMGKYGGDRDISVSYQRSTEDDFFVRKLIISQTNSYPTKELEQILIEWNTDKGAMGGIKHNLYGYCDWSIETKIDNTPYRINILKDKKTPKFDVIGMEEIIGFKHILKFYYI

SEQ ID NO: 188 - protein, 765 aa, unidentified
  source 1..765: note = Related to NZ_QEAS01000037.1; note = Pararcticibacter amylolyticus
IQRMKQQASKNIYIMKLTKNQCEYIVKRFREMRTREDFLHLANYAKKIIYGEKAYDFKLNQLTYYSNPRVNPNRYRTFTVKKKSGGVRMIHAPTKGLMEIQKSLNLILNCVFNAHSSAFGFVPGKSIRDNAAVHAGNYYVYNIDLKDFFFSIDQARVWKCFQLAPFLLGKKTDTLNDEKGKNLEVVNMISALCCAEIETGMQQTDGTLNIVKKNVVPQGAPTSPIVTNIVCQRLDFLLAAAAKRFGLKYSRYADDITFSSLHNVYQTDSDFIAEIKRVIKEQGFQINSSKTRLQKMDERQTVTGLVVNKNVNVPRNYIKKMRSWLYLWERYGYEKTYSFFLNDYIRDKGHLKKRTPDMANVLRGKLEFLKIVKGTDDKVYQQLNNRYTVLIARNRKDSLNDRLLNYWELHGLHAAWEHFKAETGIMTIDKFLDKLLKETVTDDERKNKLLKLIQSSLNTSSLLTKSTSKFTIPDNEKLNMPKRVADFMSLFDDPAGLKYLTHDFDESDQIFDIESFLPQTRKVFEDKTKPGNLTIPSSLWKIVYEFAFSETPDWNKGCKDGWSLPDRIKWSIDSKKHLKRNEGFAATIESFRKLTRIEAPELKRLINQIVKEKLGDKYPECTIKLKDCEKADFYTHVAYFSEAIKLLLDGFNKRIGECKEIAITYTRKNDDPYRLRIITLEHVGSFPMKPLDDFFRDLGNGKGELADARNKLTGYCDWAIETIWDSKLVRITLLGAGNEIEYLPNTKEVSNRITGFTHILTFYQK

SEQ ID NO: 189 - protein, 461 aa, unidentified
  source 1..461: note = Related to NZ_CP049834.1; note = Aquirufa sp.
MKPTKEQIDSIKTKFSAMQTTEDLLDLLNFSKSIIYGEKVIPFKLKDITFYCNPKRTIDHKWKFFHQYQEFTIAKKSGGTRTIYAPKKGLKAVQRSIAFVFQCIFEPHKSTMGFTKERSIVHNAQLHINSYYVLNIDLKDFFPSVDQARVWKCLQQAPFNLNQATSKVFETFAIDEFKIKYPEQSKKIHPNKKFVISDIDSNYFKATNRIPKAARLELANMLAAICCTEMEVESILADGSVEKIKKNVLPQGAPTSPILSNVVCQKLDLRLAGVAKRFGLLYSRYADDITFSSLHNVFQVDSEFKKELYRIILDQGFRINEKKTRLQKDGYKKEVTGLLVHGQVNVQKSFIKDLRMWLNLWERYGYEKANNIFLNENGPLLNTTAKIKKAELRNTLEGKLNYLSMVKGLNNITYVKLNNRFRTLKPTIKIHTEDRSAHIEKTLELLLNNGINDAMAFYQPQ

SEQ ID NO: 190 - protein, 402 aa, unidentified
  source 1..402: note = Related to NZ_CP094531.1; note = Chryseobacterium sp.
MDTKEITIEQKKKIVEFFGVVNTSFGFCVLLNYCQRILYPKTVYQISQFELRTLAHPDSKKRYKTFTIRKKNGGTRTIHAPKPELKMVLRCINLILQCVYTVHENANGFVEGKSVVDNAKLHCNNNYIFNIDLKDFFPSIEIGRVLNRLSYPPFNFKKEKGTEEIGNYIAWLACENTLVERELDGNIIKTVKRVLPQGSPTSPILSNIICERLDRRLTGLANRFGLRYSRYADDVTFSSMHNVYQKDGEFRKEMERIISEQYFTINQSKVRLQKSIMRQEVTGITVNKQVNVSQKYIKQLRMWLYYWESYGTVKGLSLFLQSYIKDKSHVKKVVPTPEFMEAVIGGKLNYLSMVKGTENSTYLKLKERFDKLSSNYVDIDNILSVWEENGIDEAINLYSKTV

SEQ ID NO: 191 - protein, 402 aa, unidentified
  source 1..402: note = Related to CP033935.1; note = Chryseobacterium balustinum
MVTKEITIEQKKIISDTFRWVKNVSDFCLVLNYCQSIVYPQTYFDISEYLLKTLAHPNSKNRYKTFKIKKKNGGTRTIHSPKPELKILLRCINLILQCTYTVHQNAYGFVEGKSVVDNAKLHCNNNYVFNIDLKDFFPSIEIGRVLNRLSFPPFNLKKENGNEKIGNYIAWLACENILVERELNGKIIKTVKRVLPQGSPISPILTNIICERLDRRLTGLANRFGVRYSRYADDITFSSMHNVYQKDGEFRKEMERIISEQYFTINQSKVRLQKSTVRQEVTGITVNKQVNVSQKYIKQLRMWLYFCETYGTNKGLSLFLKSYIKDKTHVKKAIPTPEFMEAVIVGKLNYLSMVKGVENSTYLKLKERFDNLSSTYVDVENILAVWEENGIDEAMDLYSKIV

SEQ ID NO: 192 - protein, 417 aa, unidentified
  source 1..417: note = Related to VOXE01000004.1; note = Chryseobacterium sp.
MVKNISIEQAEFIKKFFKSMKDLRDFCMLIDICQDILYPEFKDRTRIDEYVIKTLAHPKSKNRYHSFEIKKKNGGMRTIHAPQPELKVVLQCINLMFQTVFTPHSAAYGFVKDASVVDNANLHCGNNYVFNIDLKDFFPSIEIGRVLNRLSFPPFNFNKENGREELGNYIAWLACENTIVERLVDGKIQKAEKRVLPQGSPLSPILTNIICERLDRRLTGLAKRFGVKYSRYADDITFSSMQNVYQEEGAFRKELGRIVSDQYFIINQDKVRLQKSGTRQEVTGITVNEFSNVTRTYVKRIRLWLSFWEKFGAEKAFNLFLNGYIKDKGHVKNLGKTSFFMENVIEGKLNYLKMVKGENNSTYLGLKERFEKLSLRNKSVDQLLDTWEKNGIDEAMSKFYADPSPRVDKVADQIALL

SEQ ID NO: 193 - protein, 401 aa, unidentified
  source 1..401: note = Related to nan
MEVKDISAEEKSLIARFFRICDSEKMFCHLLTYCQRLLYQQKIVNIIPQTLKALSHPNSSRRFKTFEISKKNGGKRTIHAPKADLKVVLKCLNLIMHSLYEPHNAAYGFVHGKSVVDNAKLHSNSLYVFNLDLKDFFPSIEIGRILNRLNHPPFNLKGEGKDKIALYIAWLSCENMIVEREIEGKLQKTVRRVLPQGSPVSPIFTNIICERLDYLLSAVAKRFGAVYSRYADDITFSSNHNIYQKDGAFRQEVERIIADQHFQINRSKVRLQKSNVRQEVTGITVNKEPNVARRYIKQIRMWLYFWETYGTDKAFSLFLKSYLKGKGHVKVPGNTPLFMEAVIRGKLDYLKMVKGESNSTYSQLLSRFEKVSSTPNHIDHILDVWENDGIETAIIKFETDG

SEQ ID NO: 194 - protein, 367 aa, unidentified
  source 1..367: note = Related to NZ_LR134503.1; note = Kaistella jeonii
MYPFELVKIDEYKVRTLAQQNSVLRYKTFEIKKKNGGVRHIHAPKSELKVLLKCINLIFHCIYTPHDSAYGFVDGRSVVDNARLHCRNNYVFNLDLKDFFPSIEIGRILKRFNFPPFNLNKENGRQEIGNYIAWLCCENMMVERELMGETKKVFKRVLPQGSPVSPILTNIICERLDYKLSAVAKKFGIKYTRYADDITFSSMHNVYHKEGDFRKEVERIIKEQYFVINQSKVRLQKTNVRQEVTGITVNSETNVPRRYVKQIRMWLYYWENYGDSKALSLFLQSYMKDKSHIKKAVPTLGFMTAVIGGKLNYLSMVKSEGNSTYLKLKDRFEIIAEKQIKISGISENTNDEKLKKFVSSSFNYDFL

SEQ ID NO: 195 - protein, 399 aa, unidentified
  source 1..399: note = Related to JAFIBT010000001.1; note = Chryseobacterium sp.
MNKYISSEDKVKIKEKFEKMSDLKEFCNLLNHCYSILFSDESNFIDEEKLKRFANQNSQNRYHYFEIKKKDGSTRIIHAPSSELKVLLKCLNLIFHSIFIPHHASYGFIYGRSILDNAKIHCKNNYVFNLDLQDFFSSIEIGRILKRFNYPPFSLNKDNGREIIGNYIGWIACEEIDLEEEVNGKLLKIKKKVLPQGSPLSPILTNIICERLDYKLTGVAKRFNVTYSRYADDITFSSMHNVYQEKSIFRNEVEKIIGEQYFRIKEKKTRLQKRNVRQKVTGIVVNEKVNVTKNYIKLIRLWLSMWEKYGAEKAYHLFINSYIKEKGFTKYIGSTPVFMENVIDGKLNYLKMIKGESNSTYQSLRERFNRLSIKNAKMNKILDLWEFESIEKAIEYYYR

SEQ ID NO: 196 - protein, 413 aa, unidentified
  source 1..413: note = Saprospiraceae bacterium; note = Related to JADJJD010000012.1
MKIKQSHIEHIRKQFTELQSKDDLVNLLSDAKNILWGEESTPVQLKSLTYYANPALCKKRYRTFTIKKKSGADRIIHAPVKGLKSILRSLNFVFQCMYKPHEAATGFIPEKSIVDNAKKHVGHHYVLNMDLKDFFHTFDLYRVKYGLLTEVWGINSIKKFKEHNEERFLEIDKIAFLIASLCTHPFKIDGEEKTVLPQGSPTSPTLTNILCKKLDSRLTGLAKRFGATYTRYADDITFSSPHNIYNDEAFNQELKRIIEEDQKLVINPKKTRLQKSVYRQEATGLIVNDKVNVRRRYVKQIRMWLYYWEKYGYGKAEEKFKRDYIADKGHVKNINAHLVNVLDGKLEFLKMVKGKEDDTYKKLKKRLDGLTDRESPITKILNIWENEGIEAAMATRDITEDDLSTNGRIIVIF

SEQ ID NO: 197 - protein, 457 aa, unidentified
  source 1..457: note = Related to QKTX01000002.1; note = Algoriphagus aquaeductus
MNLLIKNIQRFISIQIEYQAGVFKVLNIFKMKIEQVHIDQIRKQFAGLQTKEDLAKLLSFADIVLYGEARKPVRLKALTYYANPALCKKRYQTFIIKKKSGADRTIHAPVKGLKSLLQSLNLVLQCIHEPHEAATGFVLEKSIVDNAKKHVGHHYVLNIDLKDFFHSFDLYRVKFGLLNEVWGIKTISKFRKENGASFQKMDELAFLMASLCTHSFEIDGELKTVLPQGSPTSPTMTNILCKKLDRRLTGLANRFGATYTRYADDITFSSPHNIYEEVENPVLNQKGAYDDFLSELKRLIKEEKLTINPKKTRLQKAGYRQEATGLIVNDKVNVRRRYVKQIRMYLNFWEKYGYEKAEQIFKRDYLHDRGNVKLLKEGKLKVNFPKMKDVLGGKLEFLKMVKGVEDNTYLSLKDRLNNLNTTIVQNPIPKSVDLNSVLEVFTRKGLMEAMELFKKCK

SEQ ID NO: 198 - protein, 402 aa, unidentified
  source 1..402: note = Saprospiraceae bacterium; note = Related to JADZFD010000065.1
MKIEQTHIDQIRKQFAELQSKEDLVKLLSGAKNILYGKECKPVQLKSLTYYANPTLCKKRYQTFTIKKKSGADRTIHAPVKGLKSILRSLNYVLQCVNEPHEAATGFVLEKSIVDNAKKHVGHHYVLNMDLKDFFHSFDLYRVKFGLLHEAWSIGNISKYRETNEQQFQQKEELAFLLACLCTHPFKIDGEEKTVLPQGSPTSPTLTNILCKKLDRRLTGLANRFGATYTRYADDITFSSPHNIYTNGEFNKELKRIIEEDQKLVINPKKTRLQKAGYRQEATGLIVNDKVNVHRRYVKQIRMWLYYWEKYGNEKAEQIFKRDYIADKGHVKNINAHLVNVLDGKLEFLKMVKGVNDRTYIKLKNRYDKLTEKDSPINQLLDIWDTDGIDQAMSIYYKDKLE

SEQ ID NO: 199 - protein, 396 aa, unidentified
  source 1..396: note = Related to VGMK01000021.1; note = Bacteroidetes bacterium
MKIEQAHINQIRQQFAELQSKEDLVKLLSEAKNLLYGEKCKPVQLKSLTYYANPELCKKRYQTFTIKKKSGADRTINSPVKGLKSILRSLNFVLQCVYEPHEAATGFVLEKSIVDNAKKHVGHHYVLNMDLKDFFHTFDRNRVKMGFIYEPFNLSGDKEPLAFLLASLCTHPFEIDGKEKTVLPQGSPTSPTLTNILCKKLDRRLTGLANRFGATYTRYADDITFSSQHNIYTDEVFNNELKRIIEEDQKLIINPKKTRLQKAGYRQEATGLIVNDKVNVHRRYVKQIRMWLYYWEKYGYEKAEQIFKRDYLVDKGNVKNLNAKLENVLDGKLEFLKMVKGIEDVTYKGLKERFDLLNGIKVKKENEKIDLENVVNTILNKGLIEGINLYDRYKKS

SEQ ID NO: 200 - protein, 396 aa, Flavobacterium sp.
  source 1..396: note = Related to NZ_NOXV01000174.1; note = Flavobacterium cyanobacteriorum
MKIEQAHIDQIRKQFAELQSKEELVKLLSDAKNMLYGEECKPVQLKSLTYYANPTLCKKRYQTFTIKKKSGADRIIHAPVKGLKSILRSLNFVLQCVYESHEAATGFVLEKSIVDNAKKHVGHHYVLNMDLKDFFHTFDRNRVKMGFIYEPFNLNGDKEPLAFLLASLCTHPFEIDGEVKTVLPQGSPTSPTLTNILCKKLDRRLTGLANRFGATYTRYADDITFSSPHNIYTDEEFNKELKRIIEEDQKLIINPKKTRLQKAGYRQEATGLIVNDKVNVRRRYLKQIRMWLYYWEKYGYEKAEQIFKRDYIADKGHVKNINAHLVNVLDGKLEFLKMVKGTEDGTYKRLKERFDNLTGFKETKDQSKIDLSSVLNTLVNQGLNKAMSLYSRFKNQ

SEQ ID NO: 201 - protein, 403 aa, unidentified
  source 1..403: note = Related to QNTX01000003.1; note = Elizabethkingia miricola
MKIEQIHIKQIRKQFAELKSKEDLVILLSDAKNILHSEECKPFQLKSLTYYANPKLCKKRYQTFTIKKKSGADRTINAPVKGLKSILRSLNFVLQCVYEPHEAATGFVLQKSIVDNAKKHIGHHYVLNMDLKDFFHTFDRNRVKMGFIYAPFNLNGDKEPLAFLLASLCTHSFGIEGEVKTILPQGSPTSPTLTNILCSKLDRRLNGLANRFGATYTRYADDITFSSPHNIYNNEDFNKELKRIIEEDQKLVINPKKTRLQKAGFRQEVTGLIVNDKVNVQRRYVKQIRMWLYLWEKWGYEIAQQKFLNDYIVDKGHVKNINAHLVDVLDGKLEFLKMVKGIEDGTYMGLKQRFDRLVGVTDPINQLLDIWEKAGIESAMNNYYKNETTSLDKGSSNIEDLFK

SEQ ID NO: 202 - protein, 396 aa, unidentified
  source 1..396: note = Related to JAGPCT010000008.1; note = Saprospiraceae bacterium
MKIEQAHIEQIRKQFIELQSKEDLVKLLSDAKNMMYGEVCKPIQLKSLTYYANPSLCKKRCQTFTIKKKSGADRTIHSPVKGLKSILRSLNFVLQCVYEPHEAATGFVLEKSIVDNAKKHVGHHYVLNMDLKDFFHTFDRNRVKMGFMYEPFALNGDKEPLAFLLASLCTHPIEIEGEGKTVLPQGSPTSPTVTNILCKKLDRRLTGLANRFGATYTRYADDITFSSPHNIYTDEDFIKELKRIIEEDQKLVINPKKTRLQKTGHRQEVTGLIVNDKVNVHRSYVKQIRMWLYYWEKYGYEKADQIFKRDYIADKGHVKNKNAHLDNVLDGKLEFLKMVKGIEDRTFKGLKKRFDKLTGMNDPMNQLLDLWENKGIEDAMKNYYKSPPEMTIIFTL

SEQ ID NO: 203 - protein, 718 aa, unidentified
  source 1..718: note = Related to JAAZMS010000454.1; note = Bacteroidales bacterium
MKIEQAHIDQIRKEFAELQSKEDLVKLLSDAKNMLYGKECKPVQLKSLTYYANPTLCKKRYQTFTIKKKSGADRTINAPVKGLKSILRSLNFVLQCVCDPHEAATGFVLGKSIVDNAKKHVEHHYVLNMDLKDFFHTFDRNRVKMGFMYEPFNLNGDKEPLAFLLASLCTHPFEIDGEVKTVLPQGSPTSPTLTNILCKKLDRRLTGLANRFGATYTRYADDITFSSPHNIYTNEAFNKELKRIIEEDQKLVINPEKTRLQKAGYRQEATGLIVNDKVNVRRRYVKQIRMWLYYWEKYGYEKAQQIFILDYTTDKGHVKKGKPNLANVLDGKLEFLKMVKGENDSTYETLKKRFDKLYVIENSFSKVLDIWENEGILKNTDKNTGQKTSEHIIHNPKHITKFLRQFKENTDLKWTTHSWDNIKYASIDDFINALNENKKEFNRLYKHNRDLYNLIQYFIYQPKSNPIENGIPKYGWVNLQAMKFGWQFPDNKFLLWCKENYDNKSYDERKKPFQYLLPKELRPSKTVKGKEIKYFQDVVEIFKTEIQFREEYLYKEIRKRIHRISDFNFSGLDELKKLDFYTYTPGVLSAIDHIFEQIKRNETAIDINISYIIHNQKIILSITQINSFPSKELDINNTKSFLGGHLNAIAESLFSLADFSIESNFKYNGKIIPGELQITYENMIGKRVASNITLTQEPIFIESNNKLPGFTYKLTFYI

SEQ ID NO: 204 - protein, 389 aa, unidentified
  source 1..389: note = Flavobacteriaceae bacterium; note = Related to NZQO01000147.1
MKIDQSHIDHIRKQFADLQSKEELVILLSEAKNLLYGEECKPVQLKSLTYYANPEICKKRYQTFTIKKKSGADRTINAPVKGLKSILRSLNFVLQCIYEPHKAATGFVRDKSIVDNAKKHVGHHYVFNLDLKDFFHSFDRNRVKMGFIYEPFNLGGDKEPLAFLLASLCTHPFEVDGELKTVLPQGSPTSPTLTNILCKKLDRRLNGLANRFGATFTRYADDITFSSPHNIYNDEAFNNELKRIIEEDQELAINPKKTRLQKEGYRQEATGLIVNEKVNVRRKYVKQIRMWLYYWEKYGYEKAEQIFKRDYIADKGHVKNTNAHLMNVLDGKLEFLKMVKGGNDSTYLTLKNRFEKQIGLAAPISSVLNIWQNEGIEKAMKIFNQLQRN

SEQ ID NO: 205 - protein, 717 aa, unidentified
  source 1..717: note = Related to BMWX01000006.1; note = Echinicola pacifica
MKVEQEHIDQIRKQFAELHNKEELINLLSYAKNMFYGEECKPVQLKSLTYYANPEICKKRYQTFTIKKKSGADRTINAPVNGLKSILRSLNFVLQCMYEPHEVATGFVMDKSIVDNAKKHLGHHYVLNLDLKDFFHTFDRNRVKMGFIYEPFNLSGDKEPLAFLLASLCTHPFEIDEELKTVLPQGSPTSPTLTNILCKKLDRRLNGLANRFGATFTRYADDITFSSPHNIYNDEAFNNELKRIIEEDQELAINPKKTRLQKAGYRQEVTGLIVNEKVNVGRRYVKQIRMWLYYWEKYGYEKAEQIFTRDYIADKGHVKKGGANMANVLDGKLEFLKMVKGAADTTYLGLKGRLDKLVINQDTNKTEIAELTNKGLRFSNENEVLHDPDFVVKRLKQFTIDPIMKWTTHFWDIPTETDTDVHSLRDIADHFAAVNSRFDEFVALQKYNNNLWWKVIYPFIFQKKPKKNENKDNPYRWGEYNLHIGWQYPKFVAEWSKDNYDIPPPALKKTPFEMPLPSELITDLANQKYRELFGKEIRYFGDAIQMFKREIEFREDTKDLYYEVKVLARQELTEFSVNGLESLKQLSFFTYTAPVLKAIRRIFRMIQSRTEQREVIIECKKLTDLRLIELRIIHKNSLSHRESTDDKITKPSGDLLEVIKNLISICNFEIESSFNDGIFRITYLRPNTNVIKLNHLRPLKQSLDSLHGFTYVLKFPI

SEQ ID NO: 206 - protein, 735 aa, unidentified
  source 1..735: note = Related to NZ_CP080025.1; note = Echinicola sp.
MKIDQTHINQIQKQFNELESKEDLVKLLSDARNMLYGQECKPFQLKALTYYSNPKVCRKRYKTFNIKKKSGADRTINAPVKGLKAILRSFNFVLQCLYKPHENAIGFVLDKSIVDNAQKHVGHHYVLNLDLKDFFHSFDKKWVKYGLMSPPFNLHGDKEPLAFLLASLVTHPFEVEGEVKNVLPQGSPTSPTLTNILCQKLDRRLNGLANRFGATFTRYADDITFSSPHTIYNDEAFNNELKRIIEEDQKLAINPKKTRLQKADYRQEATGLIVNDKVNVRRRYVKQIRMWLYYWEKYGYEKAEQIFKRDYIADKGHVKNINAHLVNVLDGKLEFLKMVKGIEDGTYKGLKERFDKLTQSYPSPTILKLSDDNQNRMLENETVSISNGTPSELLNNNKINNIELIVRPLGNSTVEELMVDKYLVKGLKLPHIEIFENPDKYKPSLPHNPEQTTILLTEFKNDGSGFKELVHKPFDEITPYKVLEEVKNHPNFSEYFKKGRKSGFKGNINREVQNSVIGLINSFERIGNMHWDQFKEYPFGEHGSSEYTTYAMNFKKNYRFGPRQDGYTSLEELIRFTFLKEITRFDSKLIFLPDDRRFNLRGSFYTWVPSVKKGLEFIAQGINEHSNICGSSSFSTKEIYFELRRDTFLNTISLLITDSDSVAKRPAEDILKDLRLSEVFKKYFRSICDWTIYLKNEDGNFQLRVLKRIQDTGKEDIISIEGTKGFTHKITFYGT

SEQ ID NO: 207 - protein, 389 aa, unidentified
  source 1..389: note = Related to NZ_JACYTQ010000004.1; note = Echinicola sp.
MNIEPFQKEQIRKNFAELQNKEDLVNILSDAQRMLYGENCKDVQLKSLTYYANPEICKMRYQTFTIKKKSGADRTIHAPVKGLKSILRSLNFVFQCISEPHEAATGFVLDKSIVDNAKKHVGNHYVLNMDLKDFFHSFDRNRVKMGLMYEPFSLGGDKEPLAFLLASLCTHPFEIDGEVKTVLPQGSPTSPTITNILCKKLDRRLNGLANRFGATFTRYADDITFSSPHNIYNDETFIKELKRIIEEDQNLVINPKKTRLQKAGYRQEATGLIVNDKVNVRRRYVKQIRMWLYYWEKYGYEKAEQIFKRDYMADKGHVKNVNAHLVNVLDGKLEFLKMVKGSEDGTYQRLKERFDFLVGFTEPINDVLDIWEKYGIDKAMDVYYKNKLG

SEQ ID NO: 208 - protein, 398 aa, unidentified
  source 1..398: note = Flavobacteriales bacterium; note = Related to JADYZM010000024.1
MKIEQAHIDQIRKQFAELQSKDDLVKLLSDAKNMLYSEECKPIQLKSLTYYANPVLCKKRYQTFIIKKKSGADRIIHAPAEGLTSILRALNFVLQCMYVPHKAVTGFVLEKSIVDNAKKHVGHHYVLNIDLKDFFHSFDRNRVKMGFMFEPFNLNGDKEPLAFLLASLCTHPFEIDGEVKTVLPQGSPTSPTITNILCKKLDRRLTGLANRFGVTYTRYADDITFSSPHNIYNDEAFNKELKRIIEEDQKLVVNPKKTRLQKTGYRQEVTGLIVNDKVNVRRRYVKQIRMWLYYWEKYGYAKAEQIFKRDYVADKGHVKNINVHLVNVLDGKLEFLKMVKGTKDETYKKLKERYENLAEEINPISQLLNVWEKEGIEKAMEVYYDKEENSNILIEDLF

SEQ ID NO: 209 - protein, 725 aa, unidentified
  source 1..725: note = Related to NZ_CP041345.1; note = Tenuifilum thalassicum
MKVDKVHIEQLRKQFAEMQSKDDLLKLLNNAKKMLYGENSMPFQKKSLTYYANPDLCKKRYQTFTIKKKSGEDRIIHSPVSGLKSILRVLNFVLQCIYEPHKAATGFVLNKSIVDNAKKHLGQNYVYNIDLKDFFHSFDRNRVKIGFMYEPFNLKGDKESLAFLLACLCTHPLEVDGEIKTVLPQGSPTSPTLTNILCKKLDRRLTGLAKRFGATYTRYADDITFSSLHNIYKDDDFIKELKRIIEEDQKLVINPNKTRLQKAGYRQEATGLIVNEKVNVHRRYIKQIRMWLYYWEKYGYEKAEQIFKRDYIADKGHVKNMNAHLVNVLDGKLEFLKMVKGFKDSTYQGLKKRFDRLTKSENPIENNEIIEQNRTQEHLNVLSEDKKAIFHDPKLVINKLEQFTSDPIMKWLTHFWDTSPDINSESNSSTENYFKAVNSRYEEFVFLQKYNANLWWNVIYPFVFQKKISTNKEGKEIPFKWGKYGIKIGWQYPDSVINWIVENYDNKPHALKKTPFEMSISDDLVSAEANQKYRLMYGKEIRFFGDIINLFKREIAFREETRDFYYEINNLVLQELREFKVSGLETLKYESFTVYTVPVLKAIRRIFRMIQTRTENREVEISCNRLSNQNLILLKIIHIGSHPLKNSEHSKFMKPSGDLEEVIKPLISICDFEVAAHFTDGDFVLKYLYPNVKISHENSQFHIAEIKKEDCIVKGFTYILKFYLP

SEQ ID NO: 210 - protein, 396 aa, unidentified
  source 1..396: note = Bacteroidetes bacterium; note = Related to QMPL01000018.1
MKIEQQHIDHIRQRFAEMQTKEELVSLLSDAKNIMYGKECKPFHLKSLTYYANPKLCKKRYTKFSIKKKSGKERIINAPVGGLKSLLRSLNFVLQCIYEPHHAATGFVLDKSIVDNANLHTGNHNVYNLDLKDFFHSFDRNRVKMGYIYEPFNLGGDREPLAFLLASLCTHPFEIEGEIKTVLPQGSPTSPTITNILCKKLDRRLTGLANRFGAKYSRYADDITFSSPHNIYKDEEFLRELSRIIEDDQKLAINPDKTRLQKAGYRQEVTGLIVNEKANVRKRYVKQIRMWLYYWEKYGYEKAQQIFKRDYLTDKGHVKKGEPNFANVLDGKLEFLKMVKGLEDSTYKTLKKRFDKLTDVKEKTQQEKVDLDAVIDTIINKGLDQGISLYDKYKST

SEQ ID NO: 211 - protein, 409 aa, unidentified
  source 1..409: note = Bacteroidales bacterium; note = Related to JAGPFM010000063.1
MKIEQQHIDQIRQKFASMQNKADLVSLLSEAKNILYGKECKPFELKSLTYYANPDLCKKRYAKFTIKKKSGGERTINAPVSGLKSILRSLNFILQCVYEPHNAATGFVLGKSIVDNAKVHVGNHHVYNLDLKDFFHSFDRNRVKLGFIYEPFNLNGEREPLAFLLASLCTHPFEVNGEIKNVLPQGSPTSPTITNILCKKLDRRLTGLANRFGAKYTRYADDITFSSPHNIYNEEEFQKELERIIADDNLLKINGKQKEIGPQLNINTDKTRLQKSVYRQEVTGLIVNEKVNVRQRYIKQIRMWLYYWEKYGYEKAQQIFTRDYITDKGHVKKGKPNLINVLDGKLEFLKMVKGAEDSTYLTLKNRFDKLPQVKEKIQSEKVDLDAVLNTLINKGLNPAMVLYDRYKNG

SEQ ID NO: 212 - protein, 402 aa, unidentified
  source 1..402: note = Related to NZ_WOFO01000011.1; note = Cyclobacterium sp.
MKIGHEQTERIRKQFKNLQTRQDLVDLLSEAKDMMYEDKTKPFKLKTLTYYANPENCKFRYSTFFVKKKSGGQRTIHAPTKGLRSVLRSLNYVLQCMHVPHQAATGFVRDRSIVDNAQKHVGHHYVLNLDLKDFFHSYDRNKVKLAFMYSPFNLRGCTEKEKLAFFLACLCTHPFEIEGATKTLLPQGSPTSPTITNILCERLDRRLTGLANRFGATYTRYADDITFSSPHNIYQEETNPSLNPKGSYENFRAELERLIEEEKLTINPKKTRLQKSGYRQEATGLIVNEKVNVRRRYVKQIRMWLYYWEKYGYERAEQIFRSDYMIDKGHVKKGKPDLMNVLDGKLEFLKMVKGKEDGTYKGLKERFYELIGHEDPINRVLNVWETEGIDQAINIYYKDKLE

SEQ ID NO: 213 - protein, 409 aa, unidentified
  source 1..409: note = Related to AMZY02000008.1; note = Mariniradius saccharolyticus
MKIDPQHIAQVRKQFENLQSKEDLLQLLNAAKKMMYGEKFKPLELRALTYYADPKLCTRRYSKFSIKKKSGGVRTIHAPTNGLKSILRSLNFVLQCIHEPHRTATGFVLDKSIVDNAKNHVGNHYVLNLDLKDFFHSFDRNKVKLAFMFTPFNLGVSKEKEKIAFLLASLCTHPLEVDGITKLVLPQGSPTSPTITNILCERLDRRLNGLAKRFGANYSRYADDITFSSPHNIYHIEDNPSLNQKGRFDNFRAEFGRLIEEEKLSINPKKTRLQRSGFRQEATGLIINDKVNVRRQYVKELRMWLYYWESYGYEKAEQIFKQDYMADKGHVKNMNAHLVNVIKGKLEFLKMVKGNEDGTYKGLKERFSKLDLAKGKQDFEKIDLETVVTTILNKGLDEGINLYERFKNS

SEQ ID NO: 214 - protein, 718 aa, unidentified
  source 1..718: note = Related to nan
MKIEYKYIKQIKEQFANIQNKQDLANLLSFANKILYGNKSKPIKLNALTYYANPSICKNRYYSFSIKKKSGDKRIIHAPSKGLKTILQTLNFVFQCLYSPPKVATGFVTGKSIVDNARKHEGHRYILNLDLKDFFYSFDRNRVKLAFMYEPFNLIGEKEPLAFLLASLCTHPIEVNGETKVVLPQGSPASPILTNILCKKLDRRLNGLAKRFGASYSRYADDITFSSQYNFYNNKEFVDELNRIIEIDQKLNINSKKIRIQKSTFRQEVTGLIVNEKVNVRRRYIKLIRMWLYYWEKYGYDKAEQIFQKDYIADKGHVKKGNAKLIDVLKGKLAFVKMVKGYEDTTYQKLKKRFDSLIKNKIIQNLNKNKVVGMKLENNKSSNSILSESLLEYLEKHLKEFLNKKTYPIIHTPQKTIEILKLFSSNDKHLKYTTHSWEEEKYETYNNFMGKIKDEWEDIDKNLKGLSNRLHAKISNFLFNKKLGQKKSKGDYISWGDKRLKFGWSSKELMEFMKKNPSSSPFDCPIPENIKNLDNDYGKFFRDYVDVFKNEIEFREDTKYFKNMVISLYEDILRPNGFSIEGLENLDGFSCYTDTQQIKNAIKRIFEMFVNGEYKNYNKIIIERSSNLTGQSFHLIKITQLNSFIKRSGDDPKIKEPTGDLGNIIELLKNLADYSIVSKFNNKDCYRINYLSADQKDQIEKIDCNEINGFTHEIKFYL

SEQ ID NO: 215 - protein, 400 aa, unidentified
  source 1..400: note = Crocinitomicaceae bacterium; note = Related to JADJXZ010000008.1
MTFEKTYIDQIKEDFANMQDVSDLAVVLSKARNILYDKECKPFNSETLYYFAYPQNCKHRFKEFSIKKKSGAIRTIHSPTRELKSILRALNFVFQCIFTPHSAATGFVPKKSIVDNAKKHTGKHYVLNMDMKDFFYSFDRNRVKMGFLAEPFNLKGTKEPIAFLIACLCTHPVEIGSEIIHVLPQGSPCSPIVTNILCARLDRRLKGLANRHGVVYSRYADDITFSSLHNAFNREAEPVIGEKGHYNNFIAEFERLIGQEKLNINHKKTRLQKSGYCQEATGLIVNEKVNVRRRYVKQLRMWLYYWEKYGYEKAEQIFKRDYITDKGHVKNINAHLVNVLDGKLEFLKMVKGAEDGTYKGLKERFDILVGFTDPINQILNAWQTEGIDQAMSIYYKDKLE

SEQ ID NO: 216 - protein, 400 aa, unidentified
  source 1..400: note = Related to JAJTAY010000029.1; note = Bacteroidia bacterium
MKIEQANINQIRKQFSELQTREDLAKLLSDAKNMLYGEKCSPVQLKSLTYYANPLICNDRYTTFSIRKKSGASRTIHAPVKGLKSILRALNFVLQCMTEPHAAATGFVPDKSIVDNAARHVGHRYVYNLDLRDFFHSFDRNRVKLAFMNEPFNLRDGREPLAFLLASLCTHPMEIEGEIKSVLPQGSPTSPTLTNILCKKLDRRLSGLAKRFGATYTRYADDITFSADRNVFNDEEFLNELRRIIEDDQKLAINPQKTRLQKADYRQEATGLVVNEKVNVRRRYVKQIRMWLYYWEKYGYETASRHFGKFYRADKGHLKKSNAQLINVLDGKLEFLKMVKGADDSTYKALKKRLDKLTGIKQKTDAEKVDLDLVVDTILIKGLDAGIELYERFKNTLNDG

SEQ ID NO: 217 - protein, 389 aa, unidentified
  source 1..389: note = Related to DOXR01000029.1; note = Bacteroidales bacterium
MQIEQKHIDTLRAHFAEMQNKEELALLLSAAKNILYGKVCKPISVKSLNYYANPEYCKQRYKTFAIKKKSGGTRTIHAPVEGLKTKLRALNFALQCLYDPHKAATGFVREKSIVDNAKCHVGHNYVFNIDLKDFFHSFDRNRVKIGFMSEPFNLNGEKEPLAFLLASLCTHPFEIDGIQQIVLPQGSPTSPTITNILCRKLDHRLSGLAKRFGATYTRYADDMTFSSDHNIYGNEDFRNELVRIIEEDQKLKINPDKTRLQKTGYRQETTGLVVNDKVNVTRRYVKQIRMYIYYWEKYGYEKAEQVFKKDYTLDKGSTKKKTPSLINVIDGKLNFLKMVKGSEDGTYKGLRGRFDSLAGVFDPINEVLDAWEKNGIDEAVSLYFKLNAD

SEQ ID NO: 218 - protein, 424 aa, unidentified
  source 1..424: note = Weeksellaceae bacterium TAE3-ERU29; note = Related to JAHUUM010000008.1
MKIEQQHIDFVKEEFAKIQTKEDLLCLLNNAKKIIYKGKCTPISLRQLTYFANPNFCKERYRSFTIKKKSGADRLIHAPEKGLKSILRPLNFILQCIDDPHKSATGFVLDKSIVDNAKKHIDKPYVYNIDIKDFFHSFTKSWVKYGFMTAPFNLGKEKEDLAFLLASLCTHPFEIDGKIQNVLPQGSPTSPTITNILCKRLDRRLSGLAKRFGATYTRYADDITFSAMYNIFKEEENPQLNEKGRYDNFIAELERLITQENLIIKEEKVRLQNKDARQEVTGLVVNDKVNVRRRYVKQLRMWLYYWEKYGYNKASEIFSRDYKADKGHVKKGTPNFANVLDGKLQFLKMVKGEQDATYKKLKERFDVLKAEIDPINEVLDIWEEEGIEKAMDFYSKRKKTQPKKKKNPVVRTMTMEKLMALFGK

SEQ ID NO: 219 - protein, 392 aa, unidentified
  source 1..392: note = Related to JACIVM010000140.1; note = Bacteroidales bacterium
MNIEQAKVDEIKKLFAEMQTKEDLVSLLNFANNLLYDNECLLINPKTLSYYANPLISKNRYREFTIKKKSGSNRTIHAPVKELKHILRSLNLVLQCVSDPHPSATGFVLNKSIIDNAKKHVGHRYVYNLDLKDFFYSFDGNSLKLAFMYKPFNLNGEREYLAFLLASLCTHPIEIDGEIKFVLPQGSPTSPTLTNILCRRLDRRLSGLAKRFGAVYTRYADDITFSSYHNIFKKDENPQLNDRGCYDNFIAELERLLQEEGLKINPQKTRLQKSGWHQEATGLVVNEKVNVKRRYVKQLRMWLYYWEKYGYKKAEQIFIQDYISDRGHVKKRKPNLANVIKGKIEFLKMVKGCEDSTYQGLRERFDKLVLNQPPKKTEKKTITTNVFRPSNE

SEQ ID NO: 220 - protein, 399 aa, unidentified
  source 1..399: note = Related to NZ_AJYA01000040.1; note = Nitritalea halalkaliphila
MKPEPHQNQQIREAFAALRTKKDLAELLNLANQFLYGEEAAPLYLKTLTYYADPRKAKDRYQTFTIQKKSGAERLIHAPVKGLKTILRALNFILQCIHSPHQAATGFVTDKSIVDNARQHIGSPYVYNLDLKDFFHSFDRNRVKLGLMYAPFHLNGPREPLAFLLASLCTHPLDCDGEVRTVLPQGSPTSPTLTNILCQKLDHRLNGLAKRFGLVYTRYADDITFSSGYDCFRNPEFQSELRRIIEEDQQLRIHPDKTRLQRLGYRQEATGLIVNEKVNVRRRYVKQLRMWIYFWERYGYAKAQQIFLRDYLRDKGHLKDVSTSSLQQVCSGKLEFLKMVKGPEDSTYQQLASRFHALTTKEKASASGATNLERVVDTILGQGLEQGLRLYDSFKTNKR

SEQ ID NO: 221 - protein, 390 aa, unidentified
  source 1..390: note = Related to NZ_CAKLPZ010000001.1; note = Lewinella maritima
MNITPEQVKQITTQLAAVETKTDLAALLSEAQNILHGKTCKPITATAFAYHMNPYMNKNRYRNFTIKKKSGGARVIYAPTNDLKAILRALNLILQCMYTPARVVTGFVPGRSIVDNAKCHIGHRYVYNIDVKDFFHSFDRNRVKLAFMYAPFNLRDKREPLAFFLASLCTQAFRFPGEVVKAILVQGSPTSPTLTNIICATLDRRLTGLARRFGVTYSRYADDITFSSEHCPYNREDFQRELLRIIEGQGLTLNPDKTRLQNLAHRQEVTGLIVNEKVNVRRRYVKQLRMYLYYLEKYGFYKAEAIFLRDYLADRKHNVKGNPQMLNVLGGKLDFLRMVKGQEDSTYISLLQRFQRFDFRPTKISKTLDAWEMGGIKEGMKIYYGQDKEK

SEQ ID NO: 222 - protein, 443 aa, unidentified
  source 1..443: note = Related to NZ_JAATJH010000004.1; note = Lewinella antarctica
MKATEAQREEIKSLVAELSSKKGLVNLLSKARTMLYGQETKPVKLKLLTYYANPTICPRRYRKSTIPKKSGGVRTIHAPVKGLKAILQPLNFVLQCMHTPHCAATGFVQGRSIVDNARKHVGQNYVLNLDLKDFFHSFNRNRVKLGFMFGPLQLNGSKEPLAFLLASLCTQPLYENGDIKVGHRPPSRFVGESIFMSEDDPNYELIMQILQENEVINSKRRVKLRIARGAVKTVLPQGSPTSPTITNMLCEKLDRRLTGLGNRFGATYSRYADDITFSSLHNIYNQDEFNDELVRIIEEDQGFKINPKKTRLQRRGYCQEVTGLSVSEKVNVRRRYVKQLRMWLYYWEKYGIEKAEDIFARDYVGDKGHVKMHVPEMSRVIGGKLEFLRMVKGETDSTYLGLKDRYEKLMLPLDPLTKILDLWEEKGIDAAMNAYYGEEVTEE

SEQ ID NO: 223 - protein, 396 aa, unidentified
  source 1..396: note = Related to PXTU01000456.1; note = Bacteroidetes bacterium SW_10_40_5
MPINQEDKAYIRDKFAAMQTKEDLVNLLSEAKDMRYRERTKPFKLNYFTYYANPKLCKQRYKTFTISKKSGGQRVIHAPVMGLNFLLQSVNFVLNCMYEPHKAATGFVPEKSIVDNARGHAEKPFVYNIDLQDFFHSFGKPRVKYGFMRSPFNLNGDREYLAFLLASLCTHPFEVNGEVKRVLPMGSPTSPTITNILCHTLDRRLNGLAKRFGATYSRYADDITFSSIHNIYRKKDFQKELYRIVEANQGLKIKPEKTRLQKEGYRKEATGLVVNEKVNVKRRYVKDLRKWLYLWEKYGNEKAQQLFTKDYVADKGHVKKGEPNLENVLDGKLDFMKMVKGVQDGTYLKLRDRFDKLTQQSSTSNSKKVSLDDVLDTILNQGLIQGIDLYQKLRKP

SEQ ID NO: 224 - protein, 391 aa, unidentified
  source 1..391: note = Related to NZ_FNQK01000004.1; note = Bizionia paragorgiae
MKLEKQHTEQLIKQFRSLKTKDDLLVLINKVNLLLYGDDFKSLTLKGLNYYTNPNYSDKRYSSFSIKKKSGGERIINSPVNGLKHILKPLNVILNCIATPHPKATGFVLGKSIVDNAKQHVGNHYVYNIDLKDFFHSFDRNRVKLGFMYPPFNLSGDLEPLAFLLASLCTHPFEVEGKLKTVLPQGAPTSPTITNILCVKLDRRLNGLAKRFKVNYSRYADDITFSSHVNVFKNEVFLKELNRIIVEDQNLILNDKKTRLQQTGTRQEVTGLTVNTKVNVNSKYIKQLRMWLYYWEKYGFNKAESIFLRDYAKDKGHIKTGKPNFQNVLMGKLEYLKMVKGHGDSTYVKLNARFTRLTRTESMLEKTLMAWEENGIEKAMEIYKFNNTTMF

SEQ ID NO: 225 - protein, 389 aa, unidentified
  source 1..389: note = Related to NZ_CP039451.1; note = Psychroserpens sp.
MKLEKQHTEQIIKQFKALRTKDDLVVLINKVNLILYGDKFISLTVKGLNYYANPEYSDKRYSSFSIKKKSGGERIINAPVNGLKHILRPLNIILNSIAMPHAKATGFVLGKSIVDNAQAHVGYNYVYNIDLKDFFHSFDRNRVKLGFICAPFNLNGLLEPIAFLLASLCTHPFEIDGVINTVLPQGAPTSPTITNILCVKLDRRLNGLAKRFKANYTRYADDITFSCNVNIFKNDEFLKELNRIIAEDQNLILNDKKTRLQQTGNRQAVTGLTVNTKVNVNSKYIKQLRMWLYYWEKYGFNKAESIFLRDYAVEKGQLKKGKPNFKSVLGGKLEYLKMVKGFNDSTYLKLNTRFTKLSKTESKLEQTLKAWENNGIEKAMEIYKLAKIN

SEQ ID NO: 226 - protein, 395 aa, unidentified
  source 1..395: note = Related to FTMA01000004.1; note = Maribacter ulvicola
MGFKSFINLIMKTTKEDIALIREKFNSLSTKEDLVNLLNVANVLLYGEDAFTLKESTLAYYANPAFCTERYTSFEINKKSGGTRTINAPVKGLKSILKTLNFVLQCISEPHHKATGFVINKSVVTNAKFHVGNHYVYNIDLKDFFHSFDRNRVKLGFMQKPFNLNKDREPIAFLLSCLCTHPFKVDDNLKIVLPQGAPTSPTISNILCSTLDRRLNGLAKKFKINYSRYADDITFSSQVSVFKRKDFQKELLRIITEDQGLVLNEKKTRLQQSGYRQEVTGLIVNEKVNVSRRYIKNLRMWLYYWEKYGFKRAEIIFKKNYILDRGHIKKSEPNFINVITGKLEYLKMVKGPFDSTFIKLNSRFELLLQNESMLEQILKVWENQGIEKAMELYNK

SEQ ID NO: 227 - protein, 464 aa, unidentified
  source 1..464: note = Related to NZ_WXXU01000001.1; note = Tenacibaculum finnmarkense
MNNDNKDYQVSILKEFIKIDKMEIQQKHIEKMKSLFSKMENKQDLVNLLNGVYNLLYKKNETTDNSYDPFKIVSDTKTVYFNLMFSEEEFNLKSKTKKNTYIQLSSLSYYANYSLCKKRYSQFKIKKKSGAERIINAPVEGLKIILKLLNFVLQHVYKPHKSATGFVLNKSIVDNAKKHIDSNYVYNIDLKDFFHSFDIKRVKLGFMEELFNSKTDREPLAFLLACLCTHPFEVAGEIKNVLPQGSPTSPTITNILCKTLDNRLTGLANRFGLRYTRYADDITFSSQHNVYNKEDFQKELKRIIENNQNLLINHKKTRLQKRGYKQEVTGLVVNDKVNVRKRYVKQVDKYLYLWEKYSFEKAKQIFIREYPQEKAHLRNYKPNLTNVLRGKLDFLKMVKGAEDSTYLKLKKRFDKLTGKQNPINEILDIWEKEGIEQAIKAFEIATEVNQNSIDLSKFFKNERD

SEQ ID NO: 228 - protein, 517 aa, unidentified
  source 1..517: note = Related to JAAGBU010000002.1; note = Tenacibaculum finnmarkense
MKIEQQHIELIRTTFSTLQTKEDLLSLLNLANTLLYPKNSFKFELKQLTYFANPKLVKNRYAEFTIKKKSGANRIINAPTQGLKSILKTLNFVLQCMCEPHKAATGFVRGKSITDNAKKHIDSNYVYNIDLKDFFHSFDLNRVKLGFMQTPFNLRNESFPIAFILACLSTYTFKIDGEIKQVLPQGSPTSPTITNILCRRLDKRLTGLANRFGLRYTRYADDITFSSQHNVYNKEDFQNELHKIIVTDEKFAFNTKKTRLQKHGYQQEVTGLIVNEKVNVRSRYVKQVRMWLYYWEKYGYNKAEQVFRKDYIKDKGHVKKTLPNLDNVLEGKLLFLKMVKGEYDGTYMKLQNRFEKLNRKQNHIDEILALWDSKGIDLAKNKFYNNDDDDENSHNTIVTDTEKLSKINETDKQYDIANFCFRNITGFKKLYLKKVIIDHDILYKYWENSSRTMILVSEEAFKVLSEASNFDSKNIVQSIEKYNISENKKTKKTEKGDYNQRSFFVKKKSIEKYKLMF

SEQ ID NO: 229 - protein, 403 aa, unidentified
  source 1..403: note = Related to NZ_CP042476.1; note = Antarcticibacterium arcticum
MKTNPDQKTYIRKKFAAMTCKRDLLVLLNEAQGMMYGEKGRHFRLKDLTYYANPDLCKKRYSTFIIAKKNGGERTINAPVKGLRIILRSLNFILQAISEPHAAATGFVPDRSIVDNARAHVGKHYVYNLDIKDFFHSFDRNRVKMGFMRKPFNLKANENKEKLAFFLSCLCTHPFEVEGEMKTVLPQGSPTSPTITNILCKNLDRRLNGLAKKYNLSFTRYADDITFSSSHNIFKDEEFQKELQRIIEEDQQLVINPTKTRLQKTCYRQEATGLIVNEKVNVKRDYVKQLRMWLYYWEKYGEVRAEQIFQRNYNLDKGHVKPEHPGMANVIAGKLEFLKMVKGDEDPTYKKLRERFLKLHPGSPFVEKLLQTWETRGIDEAIKIHTLRIKTSKVILNTNMYTL

SEQ ID NO: 230 - protein, 402 aa, unidentified
  source 1..402: note = Related to JAJSON010000015.1; note = Gramella sp.
MKASPDQQTYIRKKFALLESKEDLLVLLNEAKRMMYGDECKVFRLKALNYYANPDFCKKRYTSFDIPKKNGAKRIINAPVKGLRSILRVLNFILQAVYEAHPAATGFVQEKSIVDNAQPHVDKHYVYNLDLQDFFHSFDRNRVKLGFMKKPFNLRKDRNKEQLAFFLSCLCTHPFKIDGNIKTVLPQGSPTSPTISNILCRDLDRRLKGLAKRFNLNFTRYADDITFSSSHNVYNKNEFQSELTRIIEEDQLLKINPSKTRLQKTGFRQEATGLVVNEKINVPKNYTKQLRMWLYYWEKYGTKKAEQIFTQDYLKDKGHVKPDHPEMENVLAGKLEFLKMVKGTDDPTYKKLQGRFLKLSMGSPLVDRVLKVWDEEGLNKAMELYYEKKESSEALTTTILTL

SEQ ID NO: 231 - protein, 669 aa, unidentified
  source 1..669: note = Microscillaceae bacterium; note = Related to DMXI01000354.1
MKIKQTEINLLRAQFAAIQSKEDLVKILTKAKKLLYGEKATKIHLKSLTYYANPAICKSRYTPFHVKKKSGDNRVIHAPVRGLRIVLSSLNFLLQCLHEPHKTATGFVPGKSIVDNARIHTNSNYVYNIDLKDFFHSFNRNKVKMAFMYQPFGLKKSQEPLAFLLASLCTHPIEIDGKTQMILPQGSPTSPTLSNILCIKLDRRLNGLAKRFGAKYTRYADDITFSSSDNIYTQADFQAELQRIIVDDQKLTINAQKTRLQTKYERQQVTGLVVNDKNVNVHRAYVKQIRMWLYYWETYGKIKAERLFQQDYQKSAVNAQKKAPPLQRILEGKLNFLKMVKGKKNNTYRRLKQRFDELASVAGNNDTKPKKPKRKSSKPLPRPQETKGFLSLFNNSKGLKYLTHKFNDITPPDYTEFMALCKEEFDQGQKKYPNVPTALLERIQQYTFASAPEWFTRKGEEKNYHHMGWSEPKFVEWYQKSSLHPASNAKWNQEMILPFKHTIEVRAGYLPAIIDEAITLALGDSRSSFDIQISNDTIKVAEFYTDVDRFQLALYHIFSTIKTHGEANFCYGLTIDFIKEKSGSTHIKKLIITHVDSEATKPANDEGFIKGDLNTIKTLLWGLCNYNIEAKFPDGFQSKTILADKQNLGKSSEEEEKHIKGFTHILKFY

SEQ ID NO: 232 - protein, 426 aa, unidentified
  source 1..426: note = Related to NZ_KB908302.1; note = Empedobacter brevis
MKNKITALQISEIKADFLKIESLDDLCNVLNLINELTQFKNKIEINQLVKLSNPSLAKNRYKEFTIKKKSGTNRTINAPIRELNTILKSLNNLFNLIYNPHTNAFGFVTGKSIVDNAKIHTNKKYVYNIDLKDFFHSFDRNRVKMGIWYQLFGGDKSKEKISFILACLTTHPLMIDGVSGIVLPQGSPTSPFLTNLLCYKLDRQLKGLAKRFRLMYSRYADDITFSSNYDVYSNPTFTLELNRIITTQNLVINPTKTRLQGNGYRKEVTGVIVNEQINVSQNYIKQLRMWIYYIEKYGIEKATEIFKKDYAKEKGHIKSMQASMQNVIEGKLLYLEMVRGKDDKKFLTLKRRFYKSIGKVSKIDKVLIAWDEKGISKAMDIYYNYNRISLAAFLDNDATNVILDELRFEAKDSNNNRKKSNIIFTL

SEQ ID NO: 233 - protein, 425 aa, unidentified
  source 1..425: note = Related to CP053698.1; note = Empedobacter stercoris
MKNSLTVAQITEIKENFLKIESLNDLCIVLNQTNELTQIKHTIEVEQLAKLSNPALAKNRYREFTIKKKSGADRKINAPISELNLILKSLNQLFNFIYTPHTNAFGFVSGKSIVDNAKMHTNKKYVYNIDLKDFFHSFDRNRVKMGIWYQLFEGDKSKEKISFILACLTTHPLMIEGETKIVLPQGSPTSPSLTNLLCYKLDRQLKGLAKRFKLTYSRYADDITFSSNYDVYSNPIFTLELNRIITAQNLMINPAKTRLQGNGYRKEVTGITVNEYANVSQKYVKQLRMWIFFIEKYGIEKATEIFKKDYSKEKGHVKSMNASMLNVIEGKLLYLGMVRGKDDEKFLTLKNRFYKSIGKVSKIDKVLNAWEEAGISKAMDIYFNNKRISLADFLDNDAINSILDIMGFDADDSNNKKNSNIIFTL

SEQ ID NO: 234 - protein, 407 aa, unidentified
  source 1..407: note = Related to NZ_RJUG01000002.1; note = Kaistella daneshvariae
MRTRLTEEQKEVIKDQTALLQSKSDFVALLNDVAVMIYGDDGKKAFHLKHLTYYGNPKISSKRYATFEIKKKSGKTRIIHSPSSGLKSILKCFRYVLESVYEPHPAAMGFAPGRSVVDNAQKHVQMLYVYNIDLQDFFHNFDRNRVKMGLWRNLFNVEKNKEELSFFLAALCTHPIEINGEVKIVLPQGSPVSPVLTNMLCVSLDRRLQGLAKRYRIRYSRYADDITFSSNRNVFVETEFQLELHRIIEEDQKLKINPDKTRLQKRGYRQEVTGVIVNEKLNVHRKYVKQVRMWLYYMEKYGPEKAEQLFRADYIREKSHVKNITNPMLSVLIGKLQYLKMVKGQHDPTYLSLLNRFTKLLDKSNFPLRQKSTDLADKSAMLKNKNIIDLIIELGVEKALQNYVINE

SEQ ID NO: 235 - protein, 423 aa, unidentified
  source 1..423: note = Related to JAAFAH010000017.1; note = unidentified bacterium
MEQQVKQLKEGFLQMQTKQELADVLNLAKKVLYPNDDQKIELKNITYHGNSKFSKNRYKTFVVKKKSGGERIIQAPKKEFKSILKPLNLVFQTVFEPHKNAFGFVPQKSIVDNANRHVSKNFVYNLDLKDFFHSFDRNAVKMGIWFYGFKMDKTKESLAYLLACLCTHETEIGGKSEFVLPQGNPCSPTLTNLLCTKLDRRLNGLARRFGAEYSRYADDITFSANKNAFKNEDFQKELKRIIEDDQQLEIQPKKTRLQGRNYRQDATGLTVNEKVNVQPRYTKQIRHYLYLWKKYGYNKAATIFTAGYSDNRGHVKSPNAKLENVLSGKLEYLKMVKGEDDSTYQTLKKRFDILANRDVEIEKIVAIWEKEGIEAAAKANEKRKQSKTANKLNNKKFSTFTDINELFDFSDDLAAEKVETYGK

SEQ ID NO: 236 - protein, 395 aa, unidentified
  source 1..395: note = Related to CP068107.1; note = Myroides odoratus
MSLDQEQIEELKQEFLAIKSKEDLLIILNKTSALLAKDNPDFNPSPIELKTLTYYANPKLCKQRYSSFKIKKKAGDDRTIYAPCPGLKRILRTLNYLLQITFESHDFAMGFVQGKSIVDNAILHVNKNFVYNVDLEDFFYSFDFYKVKFAFEGAPFNFNKEKEPLAFFLACLCTHPLELEKGTKVTLPQGAPTSPFITNILCYRMDRKLRGLAKRFDLVYSRYADDITFSGRFNFSLSKDFTNELERIITKEKLKLKPSKTRMQSSFYRQSVTGIVVNEKVNNYKSYIKDLRMWIFYLERHGLEKTQTIYRQRVQDDKNKGRDILNVISGKLLYMKMVKGQTNPAYIKLVDRMEAFLIGSGTKKEDSKPKPDKFERVVNSLLKDGDIEKAMKLFR

SEQ ID NO: 237 - protein, 398 aa, unidentified
  source 1..398: note = Related to CP010817.1; note = Myroides profundi
MKLEQEQVIELRRLFLKANTKEDLLKVINKSIKYQNNGTKEFKYISLKTLTYYANANVCKDRYTSFEILKKSGSKRTIHSPHLILNKILKALNLILQCSFEPHQAAMGFVKNRSIVDNAKYHLNHSYVYNIDLKDYFYCFDLKRVKFGFFNVPFDFSKNQESLAFFIACLCTHPLDINGELKTVLPQGAATSPTLTNILSYRLDRKLTGLAKRFNLLYSRYADDITFSGDFDFSKNKDFIAELDRIITKEGFEINKDKTRMQSKAFRQQITGLVVNEKVNVHKGFIKQLRMWIHYIEKYGLEKAQSIFDKSEIKPLNAKYDLANVLKGKIEFLKHVKGQEDPTYIKLNQRLRACLIKAGRIEENLTEKKSSEDIKFEKAISLLIKQGDIESAMNLFFK

SEQ ID NO: 238 - protein, 411 aa, unidentified
  source 1..411: note = Related to UYIV01000001.1; note = Bergeyella zoohelcum
MKKLTKEQKLYIKNSFENLQSLDDLVSIINYTLTEVFSFVGITKKNILFNTNPSNQRYRSFTIKKKTGGERVINAPKLLLVRTQKALSVIFTICMEIHPKAMGFTEGKSVVTNAQLHIGKNYVYNIDLKDFFHSFKKWQIKRIFTQTSFQFSEEIANCLTNLCVYALAIDDKKEFVLPQGAPTSPILTNILCRKMDIALDKLAKKYKATYSRYADDITFSSNKAVFNNPNFLQELEAIIHKNKLQINPKKTRLQKKSERQEVTGITVNEKLNTTRKYVKQIRMWLYLIEKYGVEKAETIFRKDYIKEKGHIKYNQNPMFSVIGGKLLYLKMVKSQEDSTYQKLAQRFDKICGFNVDTILDVWEKEGKEKAMEVFEATKSEKWKKSQNIGVSVFEFSDDDELSEMILDKDIL

SEQ ID NO: 239 - protein, 439 aa, unidentified
  source 1..439: note = Related to BOQK01000032.1; note = Capnocytophaga canis
MKTLTTEEKQELKNRFENILSIDDLVEVINYVYQELLAGNEISKDDVLSNADLSNKRYHTFSIRKKTGGERIINAPESSLEKIQKALNTILNECVTVHPKAMGFAKGKSVVTNARLHLGKNYVYNIDLKDFFHSFKKWQVKRVFAQSPFQFPEEVANCLTNLCVYDLEIDDKKAFVLPQGAPTSPILTNILCRKMDIALDKLAKKYKATYSRYADDISFSSNVSVFNNSVFLEELEAIISRNKLEINPKKTRLQKKNTRQEVTGITVNEKLNTTRKYVKQIRMWLYLIEKYGAKKAETIFRKDYAKEKGHTKPEKNPMLSVIGGKLLYLKMVKGAEDSTYLKLAQRFDKVCGFDADKILDTWQQKGEKEAQKLFEETKNNKWKNLAAGRPKPKRQKLGKHLMEKSRSMEEQAEYVAQIRKNIAERQAKRKAAMKKIRGE

SEQ ID NO: 240 - protein, 393 aa, unidentified
  source 1..393: note = Related to NZ_CDOI01000090.1; note = Capnocytophaga canis
MKTLTTEEKQELKNRFENILSIDDLVEVINYVYQELLAGNEISKDDVLSNADLSNKRYHTFSIRKKTGGERVINRPMGALGMMQKALSVIFTICMKIHPKAMGFTEGKSVVTNAQLHIGKNYVYNIDLKDFFHSFKKWQIKRIFTQTPFQLPEEIANYLASLCVHTIDIDGKKEQVLPQGAPTSPILTNILCKKMDIALDKLAKKYKATYSRYADDITFSSNKSVFNNPIFLQELEAIIHKNKLQINPKKTRLQKKTNRQEVTGITVNEKLNTTRKYVKQIRMWLYLIEKYGAKKAETIFRKDYIKEKGHIKYNQNPMFSVIGGKLLYLKMVKSQEDSTYQKLAQRFDKICGFNVDAILDVWEKEGKEKAMEVFEATKSEKWKKIQNIRSFYF

SEQ ID NO: 241 - protein, 433 aa, unidentified
  source 1..433: note = Related to NZ_JAGDYP010000005.1; note = Capnocytophaga sp.
MTTFTNEELKDIAEKGDELIIEKFASLNSYKDILEMFNIAQVILYGEKATLFKLEDLIFYASLNFSEKDRYFTFTIKKKSGGERIINAPCEELKGLLQCFNYILQVLFTPHIKAMGFVRERSVVSNAQLHTNKNYVYNIDLKDFFHSFGRQWVKWVLMQEPFNLSGEREPLAFWLASLCTHSLEIEGSTKIVLPQGAPTSPTLTNILCYPLDKKLNGLAKRFGATYSRYADDITFSSNKSIFKNEVFLKELERIVKSQKLTINEKKTRLQKKEYRQEVTGLIVNEKVNTYRHYVKQLRMWLYYIEKYGMEKAEAFFRRDYIKEKGHIKWKENPMKNVLQGKLLYLKMVKGAEDATYLNLVQRFDRAFGFDVEAILKIWEEKGIAAAEGLYYNSKPNRLIKYKKADFHYILSEEEIAELRTNYPELFMEEGFLQ

SEQ ID NO: 242 - protein, 457 aa, unidentified
  source 1..457: note = Related to ALNN01000005.1; note = Capnocytophaga sp.
MKTLTTEQISYIQTTFASLKRKESFLDLLNEVKKFMEGENATPFSLSFFTQYANPKFCEYDRYYIFKIKKKSGGERTIMAPYDTFGELLRYFNVVLQTLFTPHTNAMGFVPGKSIATGAQMHIGKNYVYNIDLKDFFHSFERKRVKWMFTQAPFNLSGEREPLAFFLASLCTHPIEIEGQTRIILPQGAPTSPTLTNILCYGLDKKLSGLAKRFGATYSRYADDITFSSNKSIFKKEAFLSELQRIITSQGLTINEKKTRLQQKEYRQEVTGLIVNEKVNTYRRYVKQLRMWLHYIETYGYKKAEILFKKDYVKDKGHIKEASSMKLVLEGKLLYLKMVKGEQDSTYLKLQDRFNKAFGLDIEKLLQVWETYGIEKAEQVYREMGIENFKICSGATEKEAASFITLLEENGMKNSLLNIRISRNRIGKLLSPSEMIEIFDKEDPKEIMESMKGRIIK

SEQ ID NO: 243 - protein, 409 aa, unidentified
  source 1..409: note = Related to NZ_RJJL01000016.1; note = Ornithobacterium rhinotracheale
MEIIQQHKDYIKEKFKLIKSGSDLVQILIFVSKEVLKSKQDLNLDLFKKCLDTEAKDRYQTFKIKKKSGGFRTINAPNIHLKHILSCVNIVIQCVDEPHRAATGFVRGKSVIENAKMHIGKNYVLNIDLKDFFHSFDKEKVKECFMRKPFNFNGEKEILAIFLAELCTHPFEIDCVKKAVLPQGAPSSPTITNVICKSMDWDLTELANRYGATYTRYADDMTFSSNHDLYSDAFYEELFQIINSHELTVNSKKTRLQKKGYKQEVTGLVVNEKVNVPRRYVKQLRMWIYLWEKYGYEKAESLFAKDYRKDKGHVKKDKNTMLSVIKGKLNYLKMVKGETDPTYKKLYLRYFHLTNYLFIDEILGVWETEGLNAAISVYEKHKRKEMNYPEPIDVNKLLELFAKAGIKFE

SEQ ID NO: 244 - protein, 398 aa, unidentified
  source 1..398: note = Related to BMFD01000020.1; note = Belliella aquatica
MDKFREEFNPEIHPIQKIKGKSDFVRLINYLRLTNISGNIKPIPLKHFTFYANHLLSPNRFESFEIVKKNGGNRTIHAPKRGLKSILTGLNLFFKQHYKTHPNVTGFAEGKSIVDNAKPHIGKKYVLNIDLKDFFHAFERKHVKWAMMNAPFFIKEEKEPLAFFIASLCTHPIEINGETKFILPQGSPCSPILTNLLCRRLDKQLKNLAQEYQAKYTRYADDITFSSNHHKISEKDFYNKLEYVISNHNHQINTKKVRLQKEGYKQEVTGIIVNEKPNLPKRYIKQLRMWLAYWEKYGYLKADKLFKNDYLKERGHRIEGTPHLLSVMDGKLQFLKMVKGDKDPTYKKLESRFHKLNGDKKLTQAHLELMKINPFKPSLKNQQSLEEVLIKLARKKIL

SEQ ID NO: 245 - protein, 415 aa, unidentified
  source 1..415: note = Bacteroidales bacterium; note = Related to JAFYGY010000028.1
MKDNVDIQAIIRDEFPKMETQEDLLVLMNKVKRYLEKGSKEEFIPLIMQSLNYYKNIKVSGERRYKTFSIKKKSGAFRTINAPCTGLKVFQYCLNYMLQTLYQSNPNACGFVPGRSIADGAKKHVGKNFVLNIDLKDFFDTIELHRVKAIFTLPPFNLKDDKENSNSLPYILANLCCHPKEVTRIDKDGNPYQCVRNVTPQGAPTSPIITNLICRQLDRRLLGLAKRFRVSYSRYADDITFSSNNKDVFEEGSAFRVELKRIIEEDQKFRINEEKTRVQSRAYRQEVTGLVVNNKVNVTKRYVKQIRMWLYLWERYGYNKASEHFQKDYNRYKGQAEHGTRMENVIGGKLNYMKMIVGADNAAYRKLAERFEKLVLDIIGENKTLNTDVKIETSICKEDLNAILNELKELDKLLK

SEQ ID NO: 246 - protein, 412 aa, unidentified
  source 1..412: note = Related to JAFXYI010000020.1; note = Bacteroidales bacterium
MDNNADIKTTILDEFPKMKTQEDLLALLNKVKRVIDSNHQRDFTPINEKSFNYYKNIKASKNKRYKTFSIKKKSGKLRTINAPCAGLKIIQTCLNYILQVFYQPNNYACGFVPGRSIADGAKKHVHKQYVLNIDLKDFFDTIEHHRVKSLFTLPPFNLKDDKENPNSVPYILANLCCHPKDVTRFDKDGNTFVCKRNVTPQGAPTSPIITNLICAQLDRRLAGLAKRFKLSYSRYADDITFSSNYKNIFKEGSAFRLELTRIIESDQKFRINEEKTRIQSNAFRQEVTGLIVNEKVNVTHRYVKQIRMWLYLWEHYGYDKAFKCFSKDYSLSKGSAAHGTNMDNVIAGKLNYMKMIVGAENPTYKNLSKRFKKLINIQENGINVTAILDVWENEGIESALETYKRFKDYNNK

SEQ ID NO: 247 - protein, 419 aa, unidentified
  source 1..419: note = Bacteroidaceae bacterium; note = Related to JAFWPN010000020.1
MNNSAEDIHRLILDEFPRVRTQEDLLALLNKIKQLLVGCADEETCKSLTMSSLNYYKNVKVSLRHRYHLFNIKKKSGKLRQICAPVEGLKILQSCLREIFNAFYEPTPNVCGFVNARSIADGAKRHIGKNYVLNIDLKDFFDSIEYHRVKAMLCCAPFNLRDNRDSTQSLPFVIANLCCTPKEVIRFDKDGKEYRCRRSVLPQGAPTSPILTNLICRQMDRKLYLLAKKYHCAYSRYADDITFSANKNIFKVDSDFYSELRHIIEVECKLKINEEKTRIQSRKYRQEVTGLVVNKKVNVAKRYIKQIRMWLYLWETYGYKKAQNLFIHDYLHDKGHVKPETVHLENVLRGKLDYLKMIVGEENHTYSSLCERYEKLIECENKPNPSVVKQEKTGKKNNLQELTEDCSIVELLEMLIDKI

SEQ ID NO: 248 - protein, 448 aa, unidentified
  source 1..448: note = Related to JAGCWE010000009.1; note = Paludibacteraceae bacterium
MNQQKANIQQIIRKEFPKITTEADLLQLLNRINSELHKEFFAAKDKKVPPIKLATLKYYKNYKVSGAKRYKTFTIKKKSGKDRFINAPAKGLKLIQQCLNEILQTYYQINDNACGFIPDRSIVYGAKLHTDKPYVLNIDLKDFFDTITFPRVKKVLALPPFNLTGSKEPVAYIITSLCCHPKAVAKVDENGEKITEIKQVLPQGAPTSPILTNIVCRNLDRHLAGLAKRFKANYSRYADDITFSAHKNIFQQDSVFMLELKRIIEDEQGLTINPEKTRVQSKRQRQEVTGLVVNKKVNVPQRYVKQLRLWIHYWEKFDIEKAQHFFLQQYITQRGNVKSHKSHIENVIGGKLDYMRMVVGESNPAYKKLRRRLDNLIQIEEHKKSTSAPQQTSSYKQKQCAKTNKEYIADGNGIQSLSSEQLPFTHKDDLEVLLDGLINDLSKENQSL

SEQ ID NO: 249 - protein, 474 aa, unidentified
  source 1..474: note = Related to JAACZX010000460.1; note = Chitinophagaceae bacterium
MILTVEHIKAIRDQFQLLRTKEDLLALLNFIAYPQLYATGYVPDDIDFSKIELPDDATTAEKLGLVFNSSSKKRRKQITAKQLTYFSTSFSDAEKKRKRYYRFHILKKSGKKREIHAPVSKLKQIQSCIYHMLQSVYETQPQAYGFVAGKSIADNASLHTGKAFVLNVDLKDFFPSVHFRRVKAMLEKPPFYLSGEKEPLAYLISNLCTENGVLPQGAPTSPFFTNVICQRLDQKLERLAKKFQTTYSRYADDLTFSANAYVFSKRFMLELEQIVKGERFQINEEKTRVQGSAYRQEVTGLTVNEKVNVNKHYLRSYRTLLHLYKTKGPLVAYEYHYKRMPESVRVIKQQRTVTSATSHIQNVIWGKYLFLKMIKGDSVPMPPFTRNKYAKMVIEKSISLIKPEPENITGDDDTKTETKKYHQPVVQTILLEASVPNEPVEPNTKKETVVEQLLTAWEKEGLEKAIELLKTKTT

SEQ ID NO: 250 - protein, 671 aa, unidentified
  source 1..671: note = Related to CP014773.1; note = Mucilaginibacter sp.
MNNPFNDLKPEQVEGINERFHGLNSSKDFYLLLVDLLDILNVKDEEKEIFKAWITQFIRLRFPRRYTYFTIRKASGKDRIIHSPNDILKFIQRLFNLVLNTVFVPHPNSFGFSKSQSIRDNAAVHVNYNYVFNIDLIDFFTTIDAERIKSAFKESPFNLSGEKRELINHLVYLTCIPIKLGQDKENDTSIGTLKVLPQGAPTSPIISNIVCYAMDHQLAELADKFKINYTRYADDITFSSNRNLYQEGSKFRHMLESIVISQGFALNGNKTRLQKKHSRQVVTGLVVNERTNVNRDYIRSLRMYLHYWEKYGYQKAEQLYNKDVDTELFFGEPKSLFDLLKGRIDFLKMVKGADDNVYKNLKKRWLRLTNPDSRTIEFRDEYFNTHKPKDVANFLRLFQDSAGLKYLTHDFDTPGAKFSYEKIMDTANTEFSTGFTKYAITRALYARIKQFAFTERPSWWRWVNGEKSTYNLGWKSTKLKNWINENPGVHPIRFKIFRDELITPFKDSIQIRAPKFKELIENSIKEKFQDYKSEFNISFKYLETAEFYTDVDIIMGGIRHLFDGIIERLSLSNEIIISFKRTEINGRLIKVVEITHVNSSCFKEAKINDLLSGNFIEAKRAFQGLCNWSITASFADGNYKLNMLNDSDPYIEREPIASDEILGFTHSLYFY

SEQ ID NO: 251 - protein, 671 aa, unidentified
  source 1..671: note = Related to JACWMW010000002.1; note = Mucilaginibacter rigui
MNSPFSDLKPEIITDIRGRFEALRTKDDLYDLFQSVIRELPAGETKREHFEQEIAWLYKNGYPRDYHFFKIKKTSGKDRQIASPQGPLKTVQRIIAVILSSVFQPHPHSFGFRKGSSVVDNARMHVGFHYVFNIDLADFFTSISLKRVKRSLEGSPFGLDLSREPIAAQLARICCIELIVPGANSRRAFLPQGAPSSPVLSNIVCQKMDERLNGLAKRFHLNFSRYADDITFSANHNVFREGSEFRLELADIVTASGFQINPIKTRLQRQKNRQEVTGLTVNQKVNICRKYVKELRRYLYYWERYGLTKAYELYLKDQHEFLLSGSGVPMAAIIKGKLDFLHMVKGDTGDYLKLLARFHKMDKGGPRKVVKGENATHHQEAEQFQQHQPHNVAIFLRLFQDSAGLKYLTHEFDIGDEVFNLEQTVELAGREFQAAYQKHPITRALYARIKQFAFEKNPKWWRWQDGKMREINLGWSAPSVRTWAQKFPGTHPMLLLPYREEMILPFKESIRIRAPKLKELINANIKAKFREAAADWDVELNDLERADIYTDVDMLLGGIRHLLDGILERGEVSRKLLITYRKTVVSGREMKMIEIIHTASICYKDAAISELLNGNFLEAKNAFYGLCNWSVTAIFNDGAYRLNILKDDVDMPEREAVMVKVLGFTHHLYFY

SEQ ID NO: 252 - protein, 669 aa, unidentified
  source 1..669: note = Related to NZ_WNXD01000002.1; note = Pedobacter planticolens
MAEEHRSELKAKFQEVATKKDFFDLLMRAIECLPISNSETHRFKERLKNFHITDSRENYHSFTVRKSSGKDRLINAPVAPLKFFQRLVNVVLSCVFEAHPNAFGFRKNGSIVQNASLHVNQHYVFNIDLKDFFTSIDDVMLISALENAPFGFKGKKSLLGQEIVRLCTMKMDLAMPGQGTQSSKEVRVLPQGAPTSPLLSNVVCLNLDIKLTGLAKRFGITYSRYADDITFSSNRMVFGQSSSFLQELKKIIIEQKFSINESKTRLQHMSQRQEVTGLVVNKKINVEQKFIKAVRMYLYYWEKYGYPNAQGKYYADQGIDYYYPESKSLLDTLDGRLNFLKMVKGEDDSTYVKLAQRFKKLSGSLSTRKHANLNPTSSEVFEEHRPVDVATFLRLFQHGEGLKYLTHDYDLPGREFQYDKIMDLAGREFNGAFRSYSITRSLYARAKHFCFERRPKWWRWENGKKIDINVGWGSPELKEWIADNPGVHPIRMKVFRDQFIRPFKESIQFRAPMLHQAVVQTLEEKFGEEFQNFEIELINLESAEFFTDVDIFLGGVRHILDGILERVDVSKRIRIEFKRQIFGNHNMKILEITHIRSKCHRDANIVDLMNGNFREVARAFKGLCNWSITSSFSDGNYTLKVLDDNPGSPSKMSVDEDAVYGFTHTLSFY

SEQ ID NO: 253 - protein, 688 aa, unidentified
  source 1..688: note = Related to SNYC01000005.1; note = Pedobacter metabolipauper
MTYYIEFASPHPFTNLKDPLKQITQEQRQEVASKFHACASQQEFYQILVHLVSLLDINDLGQTYCCQILSQFEIGEDSPTYSNFSIKKRSGRYRHISAPSEELMLIHRLINFLLSCVFQGHQCSHGFKKGSSVVSNAVVHVGKKYVFNIDLKDFFPSIDSEMVKEALMRPPFNLSGERKSIAEHLSGLCTMRAPLKKGIRNSSRKFILPQGAPTSPLLSNAVCQNLDNLLESLAKANQLVYTRYADDITFSGNNNVFEEGSAFLIELVRIISEQGFQINESKTRLLGKSARQEVTGIVVNEKTNVKREYLKPLRMYIYYWEKYGYHEAEIKFFNDRSLISDKEMESTLHSTLDGRLNYMKMVTGENHPTYLKLSKRFKKLANKRFAEKKQKSSSTHKGDFSEHRPKDLARFLRFFQDSDGLKYLTHDFDMVDAVFDYDRIMMYAVRDFFRGVKENYITKQLYARVYQFAFEEEPNWWKYEDGKRIEINIGWSSKQIKEWVRLNPGTHPIRSKLIRDNLIRPFKESIQFRPPALRNRIESTVREKFGEDYDELQIDYSNLEAAEFYTDVELVLSGVRHLLDGILERIGISKTIHIAFSKQEVNGSLMKVLEITHVGSRCYKNALPKELLNGNFSDALKLFHGLCNWAVRASFADGDFEVDMLSDKEKLSQKRPVNKELISGFTHLLRFY

SEQ ID NO: 254 - protein, 426 aa, unidentified
  source 1..426: note = Related to JAFDXN010000025.1; note = Bacteroidetes bacterium
MAKKIENTDLIIQRFAAMQSITDLLELLNLVKKELYGEKANPFSLRQLNYYSLSKLQAQHYRQWSIPKKNGGERTIHAPVNGLKHVQACLNAILQVLFEPHYAAMGFLPGKSIVDNAKKHASKGFVYNLDLKDFFPSIPRERVWACLLLPPFNLGSSTERRQLANRISFLCTASIEITDAERGKILNTFLPQGAPTSPTITNIIARKLDRRLQGVANKYHLTYSRYADDITFSGNSNVFKKSGEVVLEIRRIIEDQKFQVNDKKVRLQQQGYRQEVTGLIVNEKVNVPRRYYRQLRNWLYLWETYGKEKASKLFLKDYRADKGYKRDGLPDMDCVIGGKLDYLKMVKGQDDPLFAKLNARYLRLSNIESQQGESRSYIKTSQESSKKEKKKNVEEGKEPRKLIETVLEMINRDSFEKAMEYFLSKK

SEQ ID NO: 255 - protein, 423 aa, unidentified
  source 1..423: note = Related to JACJYQ010000002.1; note = Lewinellaceae bacterium
MKADPEKIPEIRASFARMETKDDLVKALNLAKEILYGKGVNEFSLKNITYYADTRFQRKRYSEFQIPKKQGGTRTIHAPVPGLKAILRCLNLLLLSVYEDGYENEAMGFIPGKSIKNNAEWHTGKSFVFNIDLKDFFPSIDLYRVKTIFQLPPFNLKGEKEPLAYLMARLCCEKMEVVRKDNLGAEIKKVATVLPQGAPTSPAITNFIARKMDRRLKGVAKRFGVAYTRYADDITFSSNHNVYKKGGDFLLEVEKIISEQGFCINESKVRLQQREYRQEVTGLIVNEHPNVPRKFVKQMRQWIYLWEHYGYEKANLFFRRDYSQKAGRVLAFIPPLDLVLDGKLKYMKMVVGPEHTTWMKLNSRYSLLTQDRVISDPDLLDINKALESLFVEMRKNIDEFIAEVNYHQETNQAINIDDNEATD

SEQ ID NO: 256 - protein, 404 aa, unidentified
  source 1..404: note = Bacteroidales bacterium; note = Related to JAGOPY010000019.1
MKADQKQIQEIRDRFAKMQNKTDLLDLLNFAKGILFLQKSNSKSLRLSTLNWYADPRLSAGKRYIEFSIPKKNGGQRKIHSPARSLKTIQRCLNLILQCIYDPHPAAMGFRPGFSVVDNATKHTGKNFVYNLDLKEFFPSIELHRVKACFKNPPFNLTGDREPLAFFLANLCCHEQEVEREGKPLVLSVLPQGAPTSPTITNIVANKLDRKLSGLANRFGACYSRYADDITFSSIHYIYGRNGDFINELKKIIANQKFKINSLKTRLQTKSKRQEVTGLIVNEHVNVNNIYLKNIRQTLHIWKKFGIDNAWKYYTENEDTRTTNKENSSLLVQIMNGKLQYALTVRGKEDFLINKYFTILKDLMADKRSIPDQNLELILQVLLTEGLDEAMEKYTNNISQGNGK

SEQ ID NO: 257 - protein, 401 aa, unidentified
  source 1..401: note = Related to JAFGOZ010000659.1; note = Bacteroidales bacterium
MKLTKENIEEIGKDFFEMKSREDLLNLLNKTKFYLFGDKSKPIQLKILTYYANPNIAGKRYVEFTIPKKSGSIRRINAPVKSLKYIQMCLNVILNIVFKPSPFAMGFVPGRSIVTNAMIHQNCRYVYNIDLSDFFHSIELHRVKAVLKLKPFNLCSEREPLAFLIANLCCTELDVNRLENGNQIAVVRSVLPQGAPTSPVLTNIVAQRLDRRLYGLAKRFNINYSRYADDITFSASMNIFKQKGEFNHELTRIIANEGFSINKDKIRLQDRCFRQEVTGLIVNEKVNIRRRYIKNIRLWLYYWERYGYEKAAQYYEQYYRKDKMYIKIVPSLEKSILGKLTFIKMVKGDKDPVFRGLWTRFETLVKRFKESKSAMLDYNIILEILFNQGITAAMEAYSKVK

SEQ ID NO: 258 - protein, 741 aa, unidentified
  source 1..741: note = Related to JAFTKP010000042.1; note = Bacteroides sp.
MTTYEEQHIRKQVALSFSEMESTNDLVRLINKVWSFFSGENYQPIPAKVIYHFSNHQHSQDAYRSFEIPKKNGKMRTIQSPCHALKRIQFCLNFILSSVYDDPHPAAKGFVRGRSILDAARPHVKMPYIYHVDLKDFFPSISFFRIKACLEIPPFNLSGSKKNIAFCIANLCCLYDGEQSRLPQGAPTSPILSNIVCQRLDKKLTGLAKRFNARYTRYADDLTFSSYINLAGEKDFQEELARIIDGQQFCVQEDKTHQENRQYRQRVLGLTVNEKLNISKEYVKSIKMYLYLWESYGYGRACRLFEADWDKSAKNTRSIPSLRNYLSGKLEYMRLVKGSDDPTFQSLYQRFTDVCMENDIPDWKQFKKEMELFCQKAYNPTYDAKELLRWYQERLVDIDVRLLKESNLYFSITKAFTYLSKKLYANQPLMTKVAVHDARRLPFFLYTHFSKQEPLKFLTHTWDQYAESTSFTDYEDFIQKTNEAFKRITPEFKELDRQLYACFYAFLNNDGNGRGWGQYHLKTSWKSDWIKAWCNKHTDSSPWDCPIPEAYKQINDNLRVNYFSDIIELFKEEFQIRTENQQLKRMVRRLVNKHLNPGFNVRINVPPTKLYTNVSLLSHALDTLLYNLSQRKEFTDIEITTIDQSDYIDLSVCQIGSIYYADREQLLQETESGDFEEIRKKLTNRCDWMVQTTCKDGGNYQIAYLNSLAPNGSTKELDKVKGFTHILRFYKPQAYEKNTDY

SEQ ID NO: 259 - protein, 691 aa, unidentified
  source 1..691: note = Related to NZ_VJZV01000025.1; note = Bacteroides koreensis
MTYFSNYKLAKDAYYKFLIPKKNGKTREIQAPVKDLKRLQICLNFILSSLYHPHPAAKGFILGQNISDAAKPHVRMPYVFHLDLKDFFTSISLYRVKACLSLPPFNLNGDKERIAYCIANICCTNDGSRTFLPQGAPTSPILSNIVSLRLDRKLTGLAKRFSARYTRYADDITFSSYQDIASDTEFQQELARIISGQNFQIQPSKTRAEGRGYRQTVCGLTINEKVNVSKSYVKEIRLYLYLWERYGYERAQMYLDSDIKKTKENHSDIPQLSHYLNGKIQYMRMIKGNSDDTYKTLRNKFIYLYIPQWKEWEKNILDFCDAVQNSKLSIEELNKWYKTISTNINIHLLKDTPLYTSLTKALSCLTLKASDIPTQTVFKEPIHNATLLPSFLYENFSKNDPLKFITHIWDGNADNCKFEGYEDFIRKEQMAFKEITGRFKTIDKNLFYCFYGFLHNPLNNRGWGQYKIKSGWSSSWLKAWCSEHPERSPFDCPIPENKREIANNVKLNYFSDIVELFKSEFQLRPETRQLKKLLRELVRQYLNFDFHVTFELTDVKLYTNVYMIRNILSDILHDMAQRKQFPDILVRVEDLGSDYVDIILCQKDSDYYATHLQLIQETESGDFCELKRKMANLCDWYVETQCKDGAFRINYLDSIQPDRTIAEPLLSDGVKGFTHRIRIYKHYAYENPNYR

SEQ ID NO: 260 - protein, 394 aa, unidentified
  source 1..394: note = Related to JACMPG010000245.1; note = Spirosoma sp.
MLVDQPQIDHLRQQFASLQSKADLLALLNEAKAMLFEKGDQYPLQLTSLTWYANTSLGVKRYTAFEIPKKRGGHRLIFAPKDPLKVIQRCLNLVLQCVFSPHKAATGFVPGKSITDNARPHVGKHYVYNLDLKDFFTSVDLHRVKACLKLPPFNLTGDREPLAFLIANLCCIRQVGEPSRAFLPQGAPTSPLLTNVVCQQLDRRLTGLAKRFGATYTRYADDMTFSSFVNIYQPDSAFCVELNRIITDQRFVINPAKTRLQRPGYRQEVTGLVVNERVNVPRRFWREIRALLHNWETLDYDEANTRFQKLYALNKARPSQKAPALANVLSGKLLFMKMVRGANDELYQHYARQLDALTNQTTDEISVDVERILDIWEKQGLEKAMTAFEQYKDL

SEQ ID NO: 261 - protein, 394 aa, unidentified
  source 1..394: note = Related to NZ_JACXAA010000017.1; note = Spirosoma sp.
MSLDQQQIDSIRQQFASMQNKEELLVLLNLAKSLLFEKGTEKSIKLHSLTWYSNTSLNAVRYQSFTIRKKSGGERTIHAPVGPLKTIQQCLNFVLQCVFVPHPAATGFVIAKSIADNARPHVGHPYVYNLDLKDFFPSVNFQRVKACLKLPPFNLNETREPLAFLIANLCCVRNPIDPKQAFLPQGAPTSPVLTNIVCQQLDRRLTGLAKRFGASYTRYADDMTFSSFTNVYQPGSEFCQELNRIISGQRFVINPSKTRLQRTGYRQEVTGLVVNNKVNVNRRYLRTLRAMLHNWETLGYDEADRRFKQAYALDRAYTGKKAPALLNVLMGKLEFTKMVRGQEDVLYSHYKQVFETLLAETTDQKPVELEQILDIWEEQGIEKAMILFERYKAL

SEQ ID NO: 262 - protein, 395 aa, unidentified
  source 1..395: note = Related to NZ_QGGO01000004.1; note = Arcicella aurantiaca
MQLTEEQKETIKICFSTMESIDDLVVLLNFVNPLLYPENYEGKINAIQKKSVTFYANPKLSGDKRYAEFSIRKKSGGDRKIAAPHKSLKLIQSALNFIFSVIYEPKEYVTGFVPEKSIVDNAKVHVGRNYVYNIDLENFFPSIELNRVKAVLKLPPFSLEGTEREKIAYLIACLACKDGRLPQGSPTSPVLSNIVCQKMDRRLRGFAKAFHCRFTRYADDITFSANKDVFNQTFKTELKRIIEDQNFTINEKKVRLQGRGYKQEVTGLIVNEKLNVSKKYVREVRAMLNNWDKLGYEKASEKFKKHYYEDKGHVKKGEASMQNVVWGKLQFLKMVKGEEDAVVLKYEAQYKKLNPQPLQVNLDNPTLSDILAIWENDINGKGIEDAMELYYSKFK

SEQ ID NO: 263 - protein, 381 aa, unidentified
  source 1..381: note = Related to DMIU01000281.1; note = Runella sp.
MIRLKFNTLNSIEDIATLINEVYALLFPNAKPLPKTKKPFHISLTSLNYLAYSEHFRQKRYKTFRIPKKKKGEFREISAPTYTLKAVQRCLNAVFFCLFEPYKANELPENQQHLTGKKIFPHKAAKGFLPNRSIVDNAKLHVGKRFVYNIDLEGFFPNTSFARVRQVLKLAPFNLKNERDDLGKLITALCCQDDCLPQGAPTSPTLTNMVCQRLDRKLYKLAKENHANYTRYADDITFSSDKTIFNEHLKEAIEKTINEEGYKINKAKERLQGKGIHQEVTGIVVNKKLNVTRRYIRDLYFWFSHWEKDGYASTKAYFDLKYVNQKGYLRYKGKIPPMENVLWGKIQFLGMVRGKNDELYQKFLEKWKVCSQSKDVPIIEN

SEQ ID NO: 264 - protein, 396 aa, unidentified
  source 1..396: note = Related to NZ_CP068224.1; note = Sphingobacterium multivorum
MSNDNLFQENIKSIFYSIDSIEDFCNLLNQIYQHIFPSRDTKLNVVISVKDLNYYAFDRSRNKYKTFAIRKKDGGSRIIKAPNYKLKTILKCLNWLFNTLFIPHNNAYGFVRNKNVANNAVPHVGKLFVYNIDLLNFFPSTSFRRVKSVFELPPFYLNGDKSKLANREKLGFLIANLCCDAGFLPQGAPTSPVLTNIVCRRMDKKLYKFSKQNNCTYTRYADDITFSSYKQVFDESFKKGIKSIIENEENYKINDKKERLQSYGERQIVTGLVVNQKLNVTRDYNKDIRFWLWSWKKWGYEQTQLRFAEEFVYKKSYQKYNGKAPSFVNYLSGKIRYLSMIRGRDDERVKRYIDNFNKMVSDTVKTFTTVDLLQIFRKIDTHGKDSIDYSFKKNIA

SEQ ID NO: 265 - protein, 425 aa, unidentified
  source 1..425: note = Related to JADJRO010000003.1; note = Saprospiraceae bacterium
MRLTPENIEEIKVRFAKTETVEELAQLLSWVYALKFPKRSEKTTIIIEAKHLNYYAFKPVNRYKQFTIKKKSGGERTISAPRYKLKTIQKCIHEILNAVFTPHFTATGFVPRKSIVDNAKVHIGKQFVFNTDLKDFFPSTEFRRIKAVLGLAPFNLTDANEINSNKDKKKTSDEKGKGYLGYLIANLCCDNGCLPQGAPTSPTLTNLICQRLDKKLYKYAKSINATYSRYADDITFSANKPVFDETFKKILIDLIEVQEKFKINFEKERLQGGGERQSVTGIIVNRKSNVDRKYLKDVRFWLMCWKKFGTNATQQKFLVQFPEKKGFLRYNGTTPQFYNYLNGKILFLGMVRGAKDEIFLKQKMNFDELYSEVTGKNNKTEIGTVIQRDSNYESSDLSKGILEILNELDRNGYTNANNKLKTIFK

SEQ ID NO: 266 - protein, 315 aa, unidentified
  source 1..315: note = Related to JADKCE010000010.1; note = Bacteroidetes bacterium
MKLSETIQQEINQKFQTIKSVEDLVILMTFVYGHLYPNIQTKIEINKRKLHFIAFSKKERYKSFTIPKKSGGERKIFAPIYTLKVYQKILNEILQIVFTPHKSSHGFLPGKSIVSNANLHYGKQHVYNIDLKDFFPSTSFRRVKTVLQLSPFNLNQDRESLGFLIANLCCNDNGLPQGAPTSPILTNIVCQRLDRKLLRFAAQYKSSYTRYADDITYSSNQNKFSAEFESKLQEIIHEEGFEINSNKTRLQDFKRRQEVTGLIVNRKVNLNIEFIKQVRFWLYVWEKFGYASFHERLSSDYIKSGNTSKRKGGIH

SEQ ID NO: 267 - protein, 590 aa, unidentified
  source 1..590: note = Related to NZ_JQNQ01000001.1; note = Salegentibacter sp.
MSGVFLDKLLIENTKKRFDQMTNLTDFVSLLNYIEQRVFKNKKKPLTVPHLYYLSKTKNTRYEEFEIPKKNGKPRKIKSPENRLKRVQSLINILLQIIFEDHSHYSANGFLFGKDIRRNALPHINKNYLLNIDIKNFFPSIPFRRVKVVLEFAPFNLIDDRERIGFLIANLGTFKNALPQGAPTSPILSNIVTQNLDRNILKYCLNKKIKYTRYADDLSFSSNWNIFDQQVIKEIEAIIIAENFILNPKKTRVRNFMQRQEVTGLIVNTKLNVKREYLQKVRAMINNWEKGGLSFAISQFRKHQPPEKVNYNFKEVLLGHISFLKLIKGDTNSVVQNLQIRYNFLVNLLDYSFIEEDNVRLKLEEDDQKMEKIAFENDQTKKETFISFCTSAFHQIENLLNYYFWKKFPEIDDLKDYMWHNNPLFQDRWKKLKKLDKKERLNRLNNFKTVRDFDINTLVYLFEKEFYFDQHLSYGKKLTHLREIRNDESHRCTVLDTNEQVIINQFEEIKKERKAKKEKGKQFILSPKQKKEEMNYLTLKYIEEKNYKNVRNILREVKNNIKNTLPNIEPLQITGKVEQKEILETSEVFN

SEQ ID NO: 268 - protein, 543 aa, unidentified
  source 1..543: note = Related to CP015125.1; note = Dokdonia donghaensis
MKNLTDFVALLNYLEFRIYKTNLKPLNIKYLYYLSKTKDDRYVVFEIPKKNGKTRKIKSPDKLIKRAQSLINLLLQIIFENHSHYSTNGFLLGKDIRRNAVPHINKNYLLNIDIKNYFPSINFRRVKVVLELAPFNLRNERETIGFLIANLCTHGNSLPQGAPTSPILSNIVTQNLDRKLSKFSNENRIKYTRYADDLSFSSNWNIFKPTFIKEIEKIVNSENFSLNSKKTRVRSFMQRQEVTGLIVNTKLNVKREYLQKVRAMLNNWEKGGLYFATSRFKAHQTKSKKNLDFKEVLLGHLSFLKLIKGEDNQLIKRLLEKYNNLYNQIEYGYIDIENVEKKLIEDNLKMEKIFLDQELPDKDKFISFCTIAFHQIENLLNYYYYRKFENFEDLLNELIINNPKFKKRYRTTEKANQSFKKISDLNINVLVFIYEKEFFFDKKISYDKHITMLREIRNDDSHRCSVIDFDKEEIIKEYQKIEKERKGKESRGKNFEYSNQQARIKLNYDTLKFLDRKNYKSVRYNLKNISSNIRNTLHKKELS

SEQ ID NO: 269 - protein, 566 aa, unidentified
  source 1..566: note = Related to JAAZUI010000052.1; note = Lutibacter sp.
MSSIFLDKKIKDNIKQKFYKVKDLEEFATLLNFVERQFFKNFKAEKLIDVDYLYYLSKTKSSRYTQFEIPKKNGSVRVINSPDTTLKRIQKLINIILQIIFEDYSHYNSNGFILGKDIRRNAIPHINKNYVLNIDIKNFFPSINFRRIKVVLELSPFKLNNNREKISFLIANLATTDGTLPQGSPISPIISNIVTQKLDRKLSKFCLKSKIKYSRYADDLTFSSNKKVFNSEFIEKIEGILNQENFLINNQKTRIKSSMERQEVTGLVVNKKLNIKREFLQKTRAMLNNWEKGGLNYAKKEFKKHQPESKKNYEFKDVLLGQISFIRLVKGIESPIVNKISLKFNYLNNLIDYTFISNENVKKKLINDNIKMEKLLFDKNESEEDIFIPFCTSAFHQIENLLNYYYWRKFPVFLDLLKTLLENNPNFKRRYRNLKNANNHFKKISDLNINVLVYLYEKEFFFDKNRYYDKRITHLREVRNDDSHRCQIIDIDKDSLKKDYELLQDKIKIQDKKGKQFDYKKEDKKLIRSYETLKFIEKKDFKKVRNSLRIMSYQIKNTLPNNVHKK

SEQ ID NO: 270 - protein, 562 aa, Flavobacterium sp.
  source 1..562: note = Related to NZ_QGGJ01000001.1; note = Flavobacterium araucananum
MAGVFLNDLFKSEIKVRFERIRNVREFVSLLNYIESQISTSTEEIFELTFSHLYYLSKSKDSRYTEFAILKKSGKLRQINSPDKLLKRVQSLINILLQIIFESQSHYCSNGFLLGRDIKRNAIPHTNKKFVLNVDIEDFFPSINFRRVKVVLGLSPFNLIDEREKIAFIIANLGTYKNYLPQGSPLSPLLSNIVTQKLDRKISKFCLTHRIKYSRYADDLSFSTNRNILDESFVKSIKNIVEDENFRINDEKTRLRTSRESQEVTGLVVNEKVNIKREYLQKVRAMLNNWEKGGLRSAEETFKKHQPPNKLNYDFRSVLLGHLSFLKLIRGDDDQTVKRLRLKFSFLNNLIDYSFIDNEKVKVRLEKDNKTMEKIFFDIDMSEDKFISFCTSAFHQIENLMNYFYWKKFEHDELLNELLINNARFKKRYKTLEKAQEEIKTIRNLDINVLVYLYEKEFFFDKKVYYNKHITMLREIRNDGSHRCSIFGLDVQKLKDDYVLIENERNDKKKRGKNFELSLDQAKKELNFLTYSFLERQNYKEVRENLRNITKTINGALKLKIK

SEQ ID NO: 271 - protein, 565 aa, unidentified
  source 1..565: note = Related to NZ_RCCS01000004.1; note = Tenacibaculum discolor
MPGIFLDDVSREKVIQKFNKISSINEFASLLNFIEKNNTHLLDKKKFTPINSKYLYHLSITKDKRYKEFSISKKSGNLRKIETPDELLKRVQKLINFLLQVIFEPYSHYSSNGFLFGKGILRNAKPHVNKNYVLNLDIKDFFPSINFRRVKVVLELNPFNLKDERERISFLIANICTYKNHLPQGVPTSPILSNIVTQRLDRKLTKECLDLNIKYTRYADDLTFSSNQNILNPNFVKKVEQIIQSENFELNNNKTRLQTSMQRQQVTGLIVNEKLNIKREYLQKVRAMLNNWEKGGLDYAEQIFRNHQPIEKKEYPFKNVLLGYISFIKQIKGSDNGISLKLVEKYTLLNNLIDYSFIKNSAVKEKLISDNYKMEQIPLFNNQPENDKFISFCTSAFHQIENLLNYYYWSKFSDFINLLEHLLLHNPSFKKRYKNLDKAKSHFKKISDLNINLIVYLYEKEFFFDKKIYYKQEITKLREIRNDDSHRCSVIGVNKDEINNEYAKLEAKKNDFKKRGKNLIYSNKEKKFILKYETFLFLEDKNYKEVRRILKHITLNIKNTLPKTS

SEQ ID NO: 272 - protein, 421 aa, unidentified
  source 1..421: note = Related to NZ_MDJD01000054.1; note = Algibacter aquaticus
MSGIFLDENSREKVIKKFNKINSVNEFVSLLNFIEKNNDNLKDKNAFKPINSKQLYHISKTKDKRYLEFSIPKKNGGKRKIKTPDEILKRVQKLINYLLQLVFEPYAHYSSNGFLFGKGIIRNATPHIGKEYVLNLDIKDFFPSINFRRVKVVLELNPFNLKNEREPISFIIANLCTHKDQLPQGAPTSPILSNIVTQKLDRKLTKISLSKNIKYTRYADDVTFSKKNILKHIFINKVSKIIQEENFIVNEDKTRLQKSTERQQVTGLIVNKKLNVKREYLQKVRAMLNNWEKGGLEYAINVFKKHQPTEKVDYPFKEVLLGHISFIRQIKGIDNNVSIKLTEKFSLLNNLIDYNFIKNDIVKKRLIDDNHKMERFLLVENLTDNDKFISFCTSAFHQIENLVNYYYWSKFDNIELLLNYL

SEQ ID NO: 273 - protein, 561 aa, unidentified
  source 1..561: note = Bacteroidales bacterium; note = Related to JAEINU010000004.1
MTHEEITIEFEKLKTTSQLATLLNKVEKNRALQTEKLQKLKAKDLNFLAISKDSRYREFKIFKKSGKERIIDAPDNYLKRVQTLINDLLQIIFEPKVHNATNGFLLNRDIVRNARVHVNKRYLLNLDIEDFFPTISFRRVKSVLELAPFNLNTEKENLAFIIANICSLKGKLPQGAPTSPILSNIVTQQLDRRITKYCLKKNVKYSRYADDLSFSSNLDVFDKAFIKGLTIIVKKEGFKINKEKTRMNSNMERQQVTGIIVNEKLNVKRDYIQKVRAMLNNWEKGGLDYAKAQFIKHYGKSKYKPDFRKALKGHINFIGLVRGKEDPLFSRLLLKYNYLNYQIDCNYISNKVVQEVLERDNKEMESIPLRSVRINEDNFIAFCTSAFHQIENLLNYFYWRKFPEIEDLLQYIMDYNEAFHWKSIEKCKKRFPKISKIQIWAKVYIFEKEFYFDKKIPYNKDITILREIRNDDSHRCAVISYNRDGIKMDYKELKIKCMQYKEEHKKNMEKSSGENILEQKYKVIKFLEERNYNSVRRILKGVSDNIKNYPFVKPVELEESN

SEQ ID NO: 274 - protein, 845 aa, unidentified
  source 1..845: note = Related to REAZ01000005.1; note = Cytophagales bacterium
MKIEFKKVILIKQYFDTTENIDGLADLLNFVGNTLYEKTFSKKQLSKKLLTFFAFKKEDKYQRFTIKKKSGENRFILAPHRYLKLIQKCLNVVLNVVFEPHWASHGFVLDKNIVTNARKHIGKNYVLNVDLEDFFPSISFRRVKTVLQLPPFNLNDELAFLIANLCCYENSLPQGAPTSPTLSNIVCQKLDRKLARFAKENRVSYSRYADDITFSARTDLFDEDFLNRLKEIILSENFKVNENKTRIQSFAQRQIVTGLTVNQKVNVSQQYIKEIRAILNNWEKKGFEQAQYVFIKNYIKDNPNIKNPSMIEVLRGKLNFLGMVRKKDNLYQKYFNQFNKLLDSYNQKEEGDIIYIKNVLSKYKTETNTSKTNRDVRKSCKHNPIRVTEFLRVFSEDRNFGLNMLVHEAEDIDLEEKLKEINLEFAKYGKQFEEEKYQIPIWLYTHIKKDLIDLYNGKGLSIYRELGKHPFQNDREFTKTIFDFKKTYRFGQDKGEETSLRDTIIRCLSKVRYGDRDILSKFQIAVFEPINQLDFDLIAAIKTDVIRVELAIRIILSSYLKHSNGSGRLKFELQEIQNQIILNIIDLDSICTKNYENLQGGDFNEIIQKLWSLCDVNVISKFKDGKTRIVPILPENKDSKLYDKEVEGFTFQLVFYNLPRVLLLDNKGRVKEVNNEYKPYIAIESDISENDLLRYNALIIHKSIPNYVNLFKRAIKENIPVVSSGGGSGGEEGIVENVGNISIAFDLMQKNLPLFLKKIKEDYVVDINIFLFANKINYKKAVKIKEEIINIIENHNLLFPELSLEVINKIKVLAKSNDIPSFENKKSLSKFLQEKLKLIEYETAN

SEQ ID NO: 275 - protein, 551 aa, unidentified
  source 1..551: note = Related to NZ_VIKU02000001.1; note = Pelagihabitans pacificus
MEPIDIKSENILKQFNSISGIHDFVEVLNEIYKLYFPEGEKKLFRVGSINYYAFHAQKRYYTFDIPKKNGSTRRINAPVYQLKLLQQCINQLLHLIFKPHHTAHGFLLGRNVVTNAGIHAGKQEVLNVDLQDFFSSIKFRRVKAVLELPPFNLTGKKEKVAFLISNLCCNNGVLPQGAPTSPLLTNIVCQRLDRKLFQLAKTSKARYSRYADDITFSSNNAIFNDEFIKELNYQIENEGFLLNEAKTRIQDRRQRQEVTGLVVNKKVNINRDFIRKIRAIFHNYQKGGQKFAQKQFAKHWSKPITPPDFRSSLKGQIEYLGMVRGKSDSIYLKYKQTYLRLFSSNFIDYSFISHKGVRAQLELDYKRMEAARIRLTMSDEERFTEYCLTAAFQLEELVNYYLAQKMDFDKLVNELVTHTWATTSGLNGKNNVSEIPAVYKYFLFEKYFYYKPGVFYDSVITKLRNIRNQKLHRATVVQRSEEQILMEYKALMAKASNHKINSDGRVYQMSKSEARLNNEAKAVYFFREKNYKAVFEAVKDVSDKIRMDLAN

SEQ ID NO: 276 - protein, 377 aa, unidentified
  source 1..377: note = Related to NZ_FYEW01000004.1; note = Hymenobacter gelipurpurascens
MSIPPSSSNTNGNEQPASVPATKVDLTASFQKVTDVHQLARVLNVALTLELAENPEHKDKPISAKLLNYYAYHKKETRYRTFRIPKRTRGEVRIIKAPDRGLLRLQRLLLSCLTATFTTSHPASHGFVLGRSVLTNAQPHAGHRFVLNLDLRDFFPSTSIGRVVAVLQLPPFSLSKEGAYLIANLCCDQGCLPQGAPTSPLLTNAVCQRLDRRLQQLATHHRCTYTRYADDLTFSCNRPVFRDRFHQELNTIITAEGYQQNEQKQRLQTPEIRQEVTGIVVNERPNVPREYVRQIRAMLHNWETRGYEAATSTLQQHYATSKAHARHRGNVPKLERVLAGKIAYWGMVRGWEDVNYISSLLKLRKLTDKQKRHERYT

SEQ ID NO: 277 - protein, 372 aa, unidentified
  source 1..372: note = Related to NZ_JNLX01000031.1; note = Hymenobacter sp.
MFVHVPSSTNNGAVQPASGPVTEAVLATNFRLITDVHQLAQVLNSALLLDLAENPTHQDKPISAKLLNYYAYHKKETRYRTFQIPKRTRGEVRTIKAPDRGLLRLQRLLLSCLTAAFTGNHPASHGFVPGRSILTNAQPHAGHRFVLNLDLRDFFPSTSIGRVIAVLQLPPFGLVKEVAYLIANLCCDQGCLPQGAPTSPLLTNVVCQRLDRRLQQLAIRHRCTYTRYADDLTFSSNRPVFRDRFHQELNTIIAEEGYQQNQQKQRLQTPEFRQEVTGVVINERPNVPREYVRQIRAMLHNWETKGYETAAATLREKYTISKAKARHKGQVPKIERVLAGKIAYLGMIRGKNDALFLELSMKLMQVMKKQKL

SEQ ID NO: 278 - protein, 333 aa, unidentified
  source 1..333: note = Related to NZ_CP094534.1; note = Hymenobacter monticola
MAFALNAALQQDLDENPQHKPKLITPKLLNYYAYHKKETRYRTFQIAKRTRGEFRTIKAPDHGLLRLQRLLLRCLTAAFTTSHPASHGFVPGRSVLTNALPHVGHRFVLNLDLRNFFPSTSVGRVMAVLQLPPFSLAKESAYLVANLCCDQGSLPQGAPTSPLLTNAVCQRLDRRLQQLATRHRCTYTRYADDLTFSCNRPVFRAAFHQELNATLAAEGYQQNEQKQRLQTPETRQEVTGIVVNDRPNVPREYVRQIRAMLHNWETKGYEAASATLRQHYPTSKAHARHNGKVPKLERVLAGKIAYLGMVRGQNDSAFLNLIKSFLRIKDAGQ

SEQ ID NO: 279 - protein, 458 aa, unidentified
  source 1..458: note = Related to NZ_JAHLZY020000001.1; note = Hymenobacter sp.
MSEQDPPEQPTDEPGPGQEEFEGAFEESQREHSEEEAELLAEIKAELQAELYADLEADLRSEMQNELASESLFGTYSANKSLSDDVIEEIKRWGAFMAVLTAATTLNDLAEPFRRATNAKYLAAVLNAVLRLNLLENPSRKAKPVSFKLLNYYAFHKGERRYRTFLISKRTPGEQREIKAPDYGLMRLQRLLLGCLTAAFSTCDDAAHGFVSGRSVLTNALPHAGRRYVLNLDLENFFPNTPVQRVVKVLQLQPFGLVKPVAHLIASLCCDQGSLPQGAPTSPLLTNAVCQRLDRRLRQLAFRHRCTYTRYADDLTFSSNRPAFQELFHKELNAILTLEGYKQNPNKQRLQTPNQRQEVTGVVVNQRPNVTREYARQIRAMLHNWETKGYAVASTTLRQFYPQTKAHARHEGKVPKLEKVLAGKIAYLGMLRGKADVMFLDFKSKLSTLSAAALPHDN

SEQ ID NO: 280 - protein, 426 aa, unidentified
  source 1..426: note = Related to JAFLQZ010000025.1; note = Hymenobacter sp.
MAETPDQLPTPPHDNEPAAGGPADHPGNPLAGFVIKNGWLQQVKPGYQPALPAAEELAELAEHFRAVTDAISLARVLNAALELHRKQHPKGSPKTVSPGLLLYYAHHKKERYQTFQVPKRTRGQFRDIKAPEHGLRRIQRLLLLCLTAAFTTCDEAAHGFVPGRSVLTNAQTHAGRRFVLNLDLKDFFPSTRVGRVLKVLQLEPFDLPKEAAHLIANLCCDQGSLPQGAPTSPLLTNVVCVWLDRKLRALAKRHRCHYTRYADDITFSSQRPAFTAAFQAELNAVLVDEGYEQNPAKQRLQTPETRQEVTGVVVNERPNVPREFVQDIRFLLHVWQKHGYAAASKAMGQNYGGSKAHARYRGNIPKLEKVLAGKIAYLGMVRGKKGIVYASLYEQLQDLNGVTALHILEELTIIGLQVEFDKNQNL

SEQ ID NO: 281 - protein, 411 aa, unidentified
  source 1..411: note = Related to JAIZZH010000003.1; note = Hymenobacter sp.
MAETPDQLPPTPNENEPAAGAPADQPGEPLAGFIVTDDKLQPALPAATELAELAEHFRAVTDATSLALVLNSALELHRKRHPKGRTKTVAPGLLLYYAHHKKERYRTFQVPKRTRGQFRDIKAPEHGLLRIQRLLLLCLTATFTTCDEAAHGFVPGRNVLTNAQPHAGRRFVLNLDLKDFFSSTRVGRVLKVLQLAPFNLPKEAAHLIANLCCDQGSLPQGAPTSPLLTNVVCVWLDRKLRALAKKHRCRYTRYADDITFSSQRPAFTPAFHAELNAVLADEGYEQNPAKQRLQTPETRQEVTGVVVNERPNVPREFVQDIRFLLHVWQKHGYVEASKAMTRKYGSSKAHARYKGSTPKLEKVLAGKIAYLGMVRGKEDVAFEQFAHSLVTLSSPEYREIEMLISILSRIG

SEQ ID NO: 282 - protein, 432 aa, unidentified
  source 1..432: note = Related to MVBC01000032.1; note = Hymenobacter sp.
MPQPPDDLFPPSPDAAAGREEDAAGIPNQGSSMPDEPASIPQPDRIRDAADLLAMLDALDDIQPDPLTDNLAAQPFPLPVPTKLADLAEPFRAVTSAVSLARVLNAALHLHRLRYPRSQAKPVSAKLLRYYAHHKQARYHTFQIPKRTRGQFRDIKAPDHGLRRVQRLLLLCLTAAFTTCDEAAHGFVPGRSVLTNAQPHTKRRFLLNLDLKNFFPSTSVGRVLAVLQLAPFNLNKEAAHLVANLCCDAGVLPQGAPTSPLLTNAVCQRLDKKLRRLAARHHCRYTRYADDLTFSSQRPAFTPTFHAELNAVLTEEGYEQNPAKQRLQTPATRQEVTGVVVNERPNVPREYVRDIRFLLHVWQKHGYAVATQAMRAKYGSSKAHARYQQKIPKLEKLLAGKITYLGMVRGKEEVVYRTLLRKLEIVKKKQKL

SEQ ID NO: 283 - protein, 445 aa, unidentified
  source 1..445: note = Related to NZ_SRLD01000019.1; note = Hymenobacter elongatus
MPEDLPPDAISATPDQPDAGTEEAAGQALEAVQHAELLRVLSPEYQAGFWAMLNAQKGRQPRPAPLLEIIDTAGLAVPFREVMDADTLARVLNAALALDVAENPQHKPKPLIGKVLNYYAFHKKTTRYSTFEIPKRTRGEMRVIKAPDHGLRRIQRLLLLCLTAAFTTCDKAAHGFVPGRSVLTNAQPHAGRRFVLNLDLKDFFTNTHYGRVERVLQLPPFSLLPAVARLVANLCCDQGSLPQGAPTSPLLTNAVCQRLDRRLRQLAKCHRATYTRYADDLTFSSQRPAFREPFYAELKVILDAEGYQENAQKRRLQLPNARQEVTGIVVNDQPNVPREYVRQIRAMLHNWETKGYEAASTTLRAHYRESKAGARHKGTAPKLEQVLAGKIAYLGMVRGSDSVEYTVFSQKLKSLGFDKENLAIMGILKVIKEKGVKEAIASKQV

SEQ ID NO: 284 - protein, 432 aa, unidentified
  source 1..432: note = Related to NZ_QYCN01000007.1; note = Hymenobacter rubripertinctus
MPEDLPPDAASATPDQPDAGIGEAAEQAPEVAQHAELLRILSPEYQAGFWAMVNAQKDQQQRPLPLPEIIDTAGLAVPLGEVKDADTLAQVLNAALKLDVVENPLHKPKPLTGKVLNYYAFHKKATRYSTFQIPKRTRGEMRVIKAPDHGLRRIQRLLLLCLTAAFTTCDEAAHGFVPGRSVLTNAQPHAGRRFVLNLDLKDFFTNTHYGRVESVLRIAPFGLQPAVARLVANLCCDQGSLPQGAPTSPLLTNAVCQRLDRRLRQLATRHRATYTRYADDLTFSSQRPAFREQFHSELKEILDAEGYQENALKRRLQLPNTRQEVTGIVVNEQPNVPREYVRQIRAMLHNWETKGYEVASATLRSHYRESKAGARHKGTVPNLERVLAGKIAYLGMVRGIENPEFINFTRVLQELTITQKFRFSLDLVMPKL

SEQ ID NO: 285 - protein, 354 aa, unidentified
  source 1..354: note = Related to NZ_AUIF01000011.1; note = Runella zeae
MEFTSDEIQTIKTALQSGKNLADLTDLLNLVSDWIAQKLVLEYKPFSIKQVYHYYYNLESKYKEHRISKKSGGERVIHAPEETLKRIQRRLNVILSHLYKPTEAAHGFVMNRSIVSNAQPHLGKKNVFNLDLQDFFPTIHFGRIKAVLQLPEYGLTSEFAHIVANFCCFQGKLPQGSPVSPILTNIVCRRMDYRISGLAAKHGFTYTRYADDITLSFDELSKEAKQKMGLGLGKILKEEGFKVNSKKTRLLKPNQRQEVTGVVVNEKLNVNREYVRTIRAILHNWQKHGLEVTQAKFLNHYPEEKGFKRNKTIPDLRKVLLGKIQFLRMVRGGSDEAFKEYLIIFDKLAKNNLK

SEQ ID NO: 286 - protein, 354 aa, unidentified
  source 1..354: note = Related to NZ_SWJG01000001.1; note = Spirosoma lacussanchae
MEFTPDELQTITNTLRSGRNLADLTTLLNLTGELIAKKLELEHKSFSVRQVYHYYYNLESKYKEHRMPKKSGGERIIHAPEERLKQIQRLLNVVFSHLYQPSEAAHGFVRNRSIVTNARPHVGKQHVFNIDLKDFFPTIHFGRVKAVLQLPDYGLTPELAHIVANFCCLQGRLPQGSPASPIITNLVCKRLDYRISGLAAKHGLTYTRYADDISLSFDQLSHESRKSFSYGLGKILDEEGFMVNGKKTRLLRPNQRQEVTGVVINEKINVNRDYIRNLRAILHNWQKQGEETTQVRFEQLYPKTAVFQRKRKIPKLQNVLYGKIQFLKMVRGGEDKDIQNFLIQINLLSNNVRK

SEQ ID NO: 287 - protein, 348 aa, unidentified
  source 1..348: note = Related to NZ_BJYS01000005.1; note = Adhaeribacter aerolatus
MELSQYYIDEIKARVANGTTLEDVTSLINFIINIQNETLGTTYRFISTKRLAYYFVHRDERYLSFEIPKKSGGVRQITAPDPFLKKVQRRLNFILEVLFRPKAAAHGFVTGRSIVTNAKVHVGKNYVYNVDLKDFFPTIHYGRIKAVLQLNSFRMKPDFAHIIAHLCCYKGILPQGAPTSPIITNITCQQLDKNLVDYAKLNSCYYTRYADDITFSADKNVFKDKFHENLKLHLEAAGFKLNDKKTRKQKRTQRQEVTGIIVNEKLNLQRTYIKKIRAMLYNWERDGLPACQREFNKYYPLEKGFVKSRILPPFENVLMGKILFLGMVRGKEDKYFMEFTSKYQSLKS

SEQ ID NO: 288 - protein, 348 aa, unidentified
  source 1..348: note = Related to NZ_JAFFJV010000014.1; note = Rufibacter sp.
MELSHKQTEYIKYFVSNGETLEDLKSLINYIIKLQNDTLGTTYKPVSIKQLTFYFANRDKQYFNFEIPKKTGGVRKITAPDLFLKKIQRRINFALDLLFKPKAAAHGFVTGRSIVSNAKVHVGKKYVYNVDLKDFFPTIHFGRIKAVLQLHPFKMKPKFAQLIAHICCFEGILPQGAPTSPIITNIICQQLDKNLVSFAKFYKCYYTRYADDLTFSSDKNSFKEKFYEDLVLHLTNAGFALNEKKTRKQTRTQRQEVTGIIVNEKLNLQRSYIKKIRAMLYNWEKDGLHACQKNFNQYYPLEKGFFKNKSVPPFENVVMGKILFLGMVRGKDDKYFLEFFSKYQNLSK

SEQ ID NO: 289 - protein, 354 aa, unidentified
  source 1..354: note = Related to NYVE01000064.1; note = Flavobacteriaceae bacterium
MDLTNKHIEYIKLLLHKGSTRDDLVSLINFVIELQNEQLQTNYKTISNNQLGYYLAKRDEKYIHFEIPKKSGGVRRISSPSKVLKKIQRRIAFVLEVLFTPRLSTNGFVKQRSIVTNAKGHIGRKYIYNIDIKDFFPSTHYGRVKAVLQIFPFKASEEMAHLIAHLSCYKGILPQGSPLSPILTNIVCQSLDYHLVKLAQDHKCFYSRYADDITFSSNKNIYLNEKFLIKLKKVVNDQGFNINEKKTRLRSNAQRQEVTGVIVNTKPNLKRTYIKKLRAMLYNWENKGLKYCQNKLTIHYPYEKGFIRNKVVPDFENVLQGKIQFLGMIRGKDDHYYKTFNRKFNELKKVKNGY

SEQ ID NO: 290 - protein, 353 aa, unidentified
  source 1..353: note = Bacteroidetes bacterium; note = Related to JADKEM010000006.1
MDFTQTEISEILTQLQQGQKIEDLVELLNHVIKLQNEKDKTTYKPLTNKRVKFYYANINKRYVNFEIPKKTGGKRTITAPDKYLKKVQRRIDLILRLLFVPKPAAHGFLANRSIVSNAKIHVGKKYVLNIDLKDFFPSVHFGRIRAVLQLYPFRLKPEYAHVVANFCCFESKLPQGAPTSPIITNIVCQKLDYKLVQLAKEHHCYFTRYADDITFSCDKARFDDEFLKKLDEIVKAEGFVINEKKTRIQKRAFRQEVTGVTVNEKLNLQPDYIRNVRAMLHNWEKYGYEIANAKFAKFYPKEKGFLRNKIIPPLESVVSGKIMFLGMVRGKEDALYLRYSNQLKTLTDLKNTK

SEQ ID NO: 291 - protein, 330 aa, unidentified
  source 1..330: note = Bacteroidetes bacterium 37-13; note = Related to MKTC01000008.1
MYKKISAKRLKHYYANINKKYINFEIPKKTGGKRTITAPDKFLKAIQRRINLLLTLFFEPKPAAHGFLENRSIVTNAKIHVGKKYVLNIDLKDFFPSIHFGRIKAVLQLPVFGIKANQFKQGDSISFELLAKFGLKPEFAQIIANFCCFESKLPQGAPTSPIVTNIVSQRLDYKLVKLAKEYHCFYTRYADDITFSCDKNRFKEEFMIKLDEIIKSEGFVMNDKKTRTQKKAVRQEVTGITVNEKLNLQRTYVKKVRAALSNWEKYGYEKANAKFASSYPQEKGFLRNKTIPPMEAVLSGKVMFLGMVRGQDDTLYLKYKNKLSELLITK

SEQ ID NO: 292 - protein, 359 aa, unidentified
  source 1..359: note = Bacteroidia bacterium; note = Related to JADHMR010000076.1
MKERKEMIMQLVKNCDNLKDFCELINSSNLLVSKIQSQKPLYTSGKQFGYLLANKEHLYKQFDIPKKSGGRRKINAPLDNLKVVQYMIKNLLQLFYNTPFEWQEKLEEISKNNATVLPCVHGFVNGRGIVSNAYLHLKQDFVLNFDLKDFFPSIGNGKIIETLCLAPFNFSRFTSKIIANLCTLENHLPQGACTSPLLSNIVSQRMDNRFMSLANKYPTMQFSRYADDITFSCMYHVFDDSFMEIIEDIVRAESYVINPKKTRLQRQSQRQEVTGLIVNERLNIPRKKIRMLRAVLHNWKVNGYESAQAKFKDAFGMKKDLKLSIGGFLNFLKMVRGDQDALYQKYYEEFKILTNEITN

SEQ ID NO: 293 - protein, 328 aa, unidentified
  source 1..328: note = Cryomorphaceae bacterium; note = Related to JAJTDX010000012.1
MEITKEKIKELLEKGKTMEDFLEAYNCFLLYLNSRDGKDRKLWEKNSFLYLYRSVNRQYIEFSIPKKSGEERKICAPKKQLKLVQKKITQILELYYKPNANCHGFVKQRSIVTNAEIHTNKTFVLNLDLEDFFPSIKTNRIIDSLIIEPFNFSTEMAKIISRIACKEGGLPQGSPMSPMISNVCCEKMDLDLKDFSKKYKLNYSRYADDLTFSGYRKIFNNTFFSELGRIIGKKHHFRIKKSKTRIQNRNNRQEVTGVVVNDKLNVNRKYIRELRALIHYHKLGKAEENALYVISGKLEFLKMIKGKDRVYRNLLIQFKSQKNGQRNN

SEQ ID NO: 294 - protein, 356 aa, unidentified
  source 1..356: note = Muribaculaceae bacterium; note = Related to JAGAYZ010000097.1
MEKYRTARWRLTMYSERHIITILNRIRRRRDILNCKGYFKLSTLQKYASGNYYKFFSIPKKNGGKRIISAPERELAFIQLCIAVLFNSIYKPNKCVFGFVDKRSIVQNAQQHINKEILFNIDLKDYFSSISYNDIIEKLIRQPYYFSYPAAKFLTDILVVETQDGKRVLPQGAPSSPIVTNMIADHLDVRLSKFAEKHDLTYTRYADDITFSFSRSKLRGWRSHGLTKGIRDIIFDIIETEGFLINKRKTRISFINQRHEVTGLVVNKKVNVKREYIKRLRTEIHNWERDGYVIASYKFLKHYEKTHLGKLKSMENVIEGKLSFIKMVKGENDTTFMKLYNRFMLLMQRDKVFINS

SEQ ID NO: 295 - protein, 580 aa, unidentified
  source 1..580: note = Related to NZ_JACSIT010000096.1; note = Lewinella lacunae
MPRPALLSSSFGLLSVQDLCQYLNSIPVSEPLLKQAYTPLSLQALSEVASSCYKELHLPKKNGSLRIIHGPNPHLKAVQKGLCTLLNEYQKELKSPSAYGFVPGRNIVDNAARHTGKNVVINLDLLNFFPTINSSMVAEALAKPPASIPLVSQLNQVMTNLMCREDRLPQGAPSSPAMANLVCHSLDLNLRALAQKHRFTYTRYADDLTFSSNYPKVAEEVFINIIYQRCEKLGFKVNKEKTRIQRSSGRQSVTGLVVNSKVSVKKKYCRITRAMLHNWKKLGYEEAEALFKANYPKGPLYNLSNVLLGRIEFIGMVDNHKLPLRQRKNQLLSDTRYMKLLAEYWELMNGQNYSFIQNQKIFQRLVRFNRLAENVAMIKNNQFSSRDRFIRYCTYTFVQLEELYKVYFLIKFQEDYSKIGRHFFDNNDAFKRMLLGKKKEDHSPEDVERARKEAENKTSFADYKTYMLESQFLNDCYYAKGRNPPKLPRLLRQLRNFYVHGSEFTKRDEASLKQTLEGIPAKNAAYKKKHQKDRVMPKDEVKAQEEYLVFKWIDGGDYDSVRAFLGDIVALVRYEFEDRN

SEQ ID NO: 296 - protein, 679 aa, unidentified
  source 1..679: note = Related to JAFMYU010000013.1; note = Fibrella aquatilis
MISTQYDTNVLISLLREGESLDDLLTLLNGVVEWQNFVHQSKRRLFTRKQLSFFYKNVDKKYHSFQVPKKSGALRTINAPDGTLKAIQRCITDLLQIIYQPPFSVNGYVKGRSVVSNALMHTNKNFVLNIDLQDFFPNIKFGRVSAVLKLKPIAVKPKFAYLLTKYCCYNGALPQGAPTSPVLSNLICQRLDFRLTELTRSEHLSYSRYADDLTFSSDQPFQNGFLTRLEEIIQEEGFLINPGKVRLLGRDVRQEVTGVTVNDKTNVSRKYIRKIRAMLYNWTNLGYEKAQDRFLSSYKPPANVVKNKKSDPQLSNVVGGKIDYLKMVRGADDSIYRQCKEAFEQLLKGELIFQISEKILRTQTVEHQPRQVVSFLRNFKVINQTGFRELLHDPDVSDFDFKTNLAKVNEQMPALSAVLPASLYTKLESFVAVYNTDGQAYHEKYGLLPLKGQKKTNPNNLIDILSRKKKNKVVEDMVLTTRVQAEDILPDNKVTQAAKDFRTQIRIGNDYFHDWILINSLKPIVNELNSRELVSISYEPSEEEFSLNCEFFTDTKEVWKAIRSLLKDLAENPYYDVKDERIILLRSATIKRNLNGESFFATIIYLNLQNAFIVNELKAFQQSRLTKNQQRLHKLADWSTVYQDESGQLSEHLFLASPETRSDNQLTEGITHKLTFYHS

SEQ ID NO: 297 - protein, 665 aa, unidentified
  source 1..665: note = Related to CP002859.1; note = Runella slithyformis
MAPIQSDIVTLQNSLQKAEDFHDFLSVLNDALEFPFSQKKLYFHLKNVDKLYHSFQVPKKSGGLRTINAPNKSLKFIQHCLAFILQGAYQPTYSVNGYVTGRSVVSNAHVHANKKFVLNLDLENFFPSITFGRVHAVLQLKPILAKPNVAQMIAKLCCYEGVLPQGAPTSPVLSNMICQRLDRRIESLVSGYQITYTRYADDLTFSSDKPFENGFLSRLDEIIKAEGFTINLEKVRLQLKNSRQEVTGLTVNEKVNVTQRFIREIRAMLHNWGTLGYDSAQAKFLTHYSPKVSKKKKSEPQLRNVVAGKINYLKMVRGNEDTVYQQFKAELTRLEKGEEIPQKKPKLPVWQPSIDHNPRRVVQFLRNFRVVNDTGFRELLHDPDVSDFDFMANLAKVNTQMDGLKSVLTPKLHQKLSVFVNAYNTAGVTYFQEHGLLPLKGRPKQTVSLLARLLLKKAKMPVLEQQTTEQVAVAPDRAVSKAAKVFREQIRVGSDYFQDLILVNALKPIVETLNASDSVNVSFQPGENEFGINCSFFTDTWESVKTLRSVLKDLAQNTDYQTPTNQRNIWLRSAVIQREAEKEAFFATVIYIHLEGGKIESENAFKHIRLLKTQQRLCSLADWSVLYQDANSQTQEFFFLNSDANRSHQAPNYEGITHKLTFYHS

SEQ ID NO: 298 - protein, 498 aa, unidentified
  source 1..498: note = Related to NZ_WBWZ01000001.1; note = Brucella anthropi
MSEAEMKKIWWFRNRMYNQFVVTSKHGKARRINAPDLRLKMLQRSIAKLLDQLYAPRNPVHGFVNDRSVITNASSHLRSKFIVNLDIENFFPSISENRVEGLLRAIGIDDNVSSIIARICTRQGVLPQGAPTSPVLSNMICFRLDRELLALSKASRCIYTRYADDITFSSYQKPELLFGAGVPPTGRFSPELLATNLSAAFTDNGFTLNADKSQYGDKHSRRIVTGLKINSGLNVDRRFVRNIRAALYSVEARGLAAAQKKFKDRHNGTTDLELHLKGKISWLGSVKGQFDPVFRAIASRFNAAFPAHMIKINPSPEDIRSRAVWVLEHFHGDFAQGTAFFLKGVGLVTAAHCVSDALGEEIDVHHHSKPSNTFKVKVKQHHVIRDLAILEHTIPSNEYYELELTKQALNIGDSVRAIGYPGYAPGDGLNIRPGQISSFSVKSTVPLVEVTQKLTQGMSGGPIIDDQNGVIGIIHKGGPHEGRDFAVNVEALVAWLDE

SEQ ID NO: 299 - protein, 530 aa, unidentified
  source 1..530: note = Related to NZ_LT599047.1; note = Brucella sp.
MPKPFIMFGSLNLRTSIPPELADYSTFLGYLCLSQAELKKIWWFRKKMYKDFKITSKYGKTRRINAPDRRLKMLQRNISPLLDKLYSPRNPVHGFIHERSVMTNASSHLSNKFVVKLDIENFFPSISENRVAGLLHALGVDESVSAIIARLCTNRGVLPQGAPTSPVLSNMICFRLDKELLKLAKTARCIYTRYADDVTFSSYQKPELLFEVGAPQPGRFSPELLASNISAAFTNNGFKLNANKSQYADKNSRRVVTGLKINSGLNVDRRFVRNIRSALYSVETLGLSAAQKKFADQYGGKCDLTQHLKGKISWLGSVKGHSDPVFRATVLRFNSSFPSQPIKMNPSSDEIRNRGVWVLEHFHGDFAQGTAFFMKGVGLVTAAHCVADAIGEEIDVHHHTKPSNSFKVKVKRHHFIKDLAILEHAIPSNEYYELELTDQDLQVGDTVTAVGYPAFAPGDGLNVRSGQISSFSVKSTVPLVEVTQKLTQGMSGGPILDEKNRVIGIIHKGGPNEGRDFAVHVKALMEWLQE

SEQ ID NO: 300 - protein, 458 aa, unidentified
  source 1..458: note = Related to NZ_JACIEE010000022.1; note = Rhizobium azooxidifex
MLQRALVPLLGEIYSPRKPVHGFVRDRSVITNAASHLKSKFVINLDIERFFPSISENRVIGLLKALGVDEDVSSIIARLCSNQGTLPQGAPTSPVLSNMICFRLDKEMQVIAKAAHCIYTRYADDITFSSYQPLSALFAAGVPSTGNFAPDLLAPQLLAAFINNGFKVHPDKTHYGDRHSRRIVTGLKVNSGLNVDRRFVRNVRSTLFSIETTGLAAAQKKFDDHYGGRRDIARFLRGRISWIGNVKGQSDPVYRSIATRFNASFPMQPIMVLPTRTEIRRRAVWILEHAHGEWAQGSAFFLKDVGLVTAAHCVQDAIGKEIDVYHPTKPANIFKVKVKKHHKIRDLALLEHSIPSNEFYELEMTNTTYVIGDVLTAAGYPGFAPGDGLNERLGHISSFSVKSGVPLIEVTQKLTQGMSGGPVFDDNDLVAGVIHKGGPDEGRDFAVHIDALTAWLDE

SEQ ID NO: 301 - protein, 531 aa, unidentified
  source 1..531: note = Related to NZ_CP083370.1; note = Ensifer sp.
MPHPLRVFGGVSFRVRIPSEMTDLTTFLDHLCLSEAELRKIWWFRGRMYKDFPLLSKSGKPRIISAPDRRLKMLQRTIAPLLDQIYSPRNPVHGFVPDRSVRTNATSHLKSKFVVNLDVERFFPSISENRVAGLLKAVGIDESVAVVVARLCTNQGVLPQGAPTSPVLSNMVCFKLDKELQAIAKAAHCIYTRYADDVTFSSYQPPGGLFAEGVPPTGNFVPDLLSPRLIGAFTNNGFKLNPSKSHYGDKHSRRIVTGLKINSGLNVDRRFVRNIRSTLYSIETLGADTAQKKFEVEYGGKCRLSQHLKGEISWLGSVKGQSDPIFRAIAARFNSSFPTQPIKVSPTRAQIRSRAVWVIEHFEGKFAQGSAFFLKDVGLVTAAHCIEEALGQEIDVYHPSKPSNVFKARVKQHHTVRDLAILDHEIPAHEFFELEMATRAPSLGDALTAVGYPGYGPGDSLNVRSGHISSFAVKSAVPLIEVTQKLTQGMSGGPVLDDEDRVAGVIHKGGPEEGRDFAVHIDALTAWLDGR

SEQ ID NO: 302 - protein, 540 aa, unidentified
  source 1..540: note = Related to MEDN01000012.1; note = Agrobacterium sp.
MPTPRSMFGGNLTRSRVPLELTSIDELLRHLCVSEAELQKIWWYRSRMYSEFNISKKAGKSRLISAPDRRLKMIQRALAQLLDGMYQRRNAVHGFVADRSVMTNARSHMRSKFVLNLDIENFFPTISENRVVGVLKALGVIEDVARIVARLCCNNGVLPQGAPTSPVLSNMICFRLDKDLHGVAKASHCIYTRYADDITLSSYQPPVALFAGGVPPTGNFSTELLAPVLVEAFAHNGFKLNAHKAHYGDRNSRRIVTGLKINEGLNVDRRFIRNVRSALYSIETLGIETAQAKFKSEYGGKCGVANHLRGKISWIKSVKGQSDPVFRGIAARFNKLFPAEPIKVQPTRTEMRDRAVWVLEHTHGDWAQGSAFFLEGVGLVTAAHCIQDAVGQEIDLYHPSRPSNIFKVKVRAHHAVRDLALLDHSIPSTEYFELQLSARTHAVGDYLIAVGYPGFAAGDNINVRSGQISSFSVKSTVPLIEVTQKLTQGMSGGPVLDIDGRVAGVIHKGGPDEGRDFAVNTDALMAWLSELVTAVGAPVS

SEQ ID NO: 303 - protein, 485 aa, unidentified
  source 1..485: note = Related to SGOC01000001.1; note = Agrobacterium rhizogenes
MYSDFEIAKPSGKSRVINAPDDRLKMLQRYIANLLDQIYKPRNPVHGFVLDRSVRTNASSHLRSKFVVNLDIENFFGSISENRVIGLLKALGVDEGAAEIVARICCNKGHLPQGAPSSPVLSNMICFRLDKDLQQIAKKVYCIYTRYADDITFSSYQPLSSLFEAAVPPAGNFDFDMLVPELKQSFLNNGFKVNASKVHYADRNSRRIVTGLKINEGLNVDRRFIRDIRSALFSVEKDGLVVAQQKYAEKYGGTCSIDLYLKGKISWIGSVKGRSDPVFRGLASRFNLSFSFNRVKLLATQAEIRERAVWVLEHWEGNCAQGSAFFLEDVGLVTAWHCVAEAANKGEIDVYHPTKRSNIFKVKVASHCAVRDLAILEHSIPDNEFYELQASTHVVGIGDSVTAIGYPSYGPGDGINVRSGQVSALPVKSAVQLVEVTQKLSQGMSGGPVLDDEDKVAGVIHKGGPHEARDFAVSIKALIDLAAGK

SEQ ID NO: 304 - protein, 488 aa, unidentified
  source 1..488: note = Related to WIEG01000017.1; note = Rhizobium leguminosarum
MYNDFEVAKPSGKKRVINAPDERLKMLQRYIAELLDHIYRPRDPVHGFVFDRSVRTNASSHLRSKFSLNLDIENFFGSISENRIIGLLKALGIEDDAAEIVARICCNKGQLPQGAPSSPVLSNMICFRLDKELQRIAKKTHCIYTRYADDITFSSYQPLSGLFDGVPPPAGNFDVELLTAELKQSFANNGFKVNAAKVHYADRNSRRIVTGLKINEGLNLDRRFIRDVRSALYSVEKDGLAAAQKKFEDAYGGKCPIDFYLKGKIAWIGSVKGRSDPVFRGLASRFNASFLKNRIKLQATPSEIRERAVWVLEYWEDNGDGAQGTAFFLKDVGLVTAWHCVAKAETVGLDIDVYHPTKRSNVFKVKVVKHCAVRDLAILEHSIPDNEFYELEPSTRNSVIGDGVTAIGYPSFGPGDGINIRSGQISALTMKSAVPYIEVTQKLAQGMSGGPVTDIDHKVVGVIHKGGPQEARDFAVDVKALMNLAVGK

SEQ ID NO: 305 - protein, 512 aa, unidentified
  source 1..512: note = Related to SIJW01000001.1; note = Rhizobium leguminosarum
MTSEAALLDYLGVTSAELKKIWWFRGRMYQTFEIAKAVGKSRIISAPDRRLKMLQRNIATLLDAIYKPRHPVHGFVPDRSVLTNASSHLRSKFVVNLDIEGFFSAISENRVAGLLKALGVQSRAADIVARICCNRGCLPQGAPSSPVISNMICFGMDKELQRFAKTAHCIYTRYADDISFSSYQPLTALFDGAVPSSGNFDHDTLAPRLRAAFVNNGFTINKAKAHYADKHSRRIVTGLKINEGLNVDRRFIRDVRSTLYSIDSLGLADAQKKFEDKYGGTCDLSSFLKGKISWIGSVKGRSDPVFRSLAGHFNVKFPTRAFKLQPTRDEVRKRAVWVIEHFEGEFAQGSAFFLKGVGLVTASHCVAEAAAAGAEIDVYHPTKPSNIFKATVKQHCEIRDLAILDHNIPENEFYELEVSGEKFAVGDPLTALGYPKFAPGDGMNIRSGNISAFSVKSSVPLIEVTQMLTQGMSGGPVIDRHDKLAGIIHKGGPEEGRDFAVHVKALMDWLTS

SEQ ID NO: 306 - protein, 498 aa, unidentified
  source 1..498: note = Proteobacteria bacterium; note = Related to JAIUOD010000004.1
MSKSELKKIWFYRERMYHNFNVSGAKETKRLISAPDHRLKMLQRKIAASLDTLYCPRKSVHGFVRHRSVKTNAASHLSAKYLLNLDLSDFFGSISENRVNGLFVSLGIDKEVALILARLSCYKNHLPQGAPTSPVISNMICFRLDKELLSIAKQNRCIYTRYADDITFSSYKPLTVLFDGVTPNTGKCDIKLLGGRLLTTFQNNGLIINPEKMYYADKSARQTVTGLRVNELVNVDRKYVRNVRSALHVVEKSGVLEAQRVLKDKYLRNSTIEAHLQGKIAWLGHVKGRSDPVFRKLAAKYNNLFPKKAIKLEPTKEEVRNRAVWIVEYSDHENYSQGSAFFLKGVGLVTAWHCVNGHESYDLYHPSKPSNKFTVTVSRSCKSRDLALLNHNIPFTEFYELSLPDRTFHVGESLYAAGYPGFGPGDKLNVRLGAISSFPIKFGIQMVEVTQKLPSGMSGGPLVDSANRVAGIIHKGGEDEPRDFAVHIDVLKAWVSLP

SEQ ID NO: 307 - protein, 496 aa, unidentified
  source 1..496: note = Related to WBWG01000001.1; note = Brucella intermedia
MSPDELNKIRWFRGRMYRKFDISKGKSKKRTINSPNYRLKMLQKKISIQLAKIYKPRNSVHGFVSHRSVKTNAQSHIKQKYILNIDIKDFFPSITESRVRGLLEAIGLDENVSAAITWICCNDGCLPQGAPSSPLISNMICFRLDKNLQAFAKRTRCIYTRYADDITFSSHQPLSLLFAESVPRAGHFPVIQLSEGLRNLFTSNGFTLNDNKAHYADKHSRRTVTGIRVNEVLNIDRKFIRNVRAALYKIETIGLKDAQKELMSRFSSNASIEDYLRGKIAWLGHIKGVSDPIFRGLAARFNRSFAKSAIKIQPTQAEMRDRAVWVIEHFDGEMCQGSAFFLESVGLVTAAHCVEGSTEIELYHPSKPSNKFSGKIKSICSHRDLAIIEHNIPSVEYFELRRSLKDAQIGEELIAAGYPGFGPGDKLNIRPGTVSSRPVKSAVNYIEVTQKLAQGMSGGPLLDTDNNVSGVIHKGGALENRDFAVHIGELYLWLGI

SEQ ID NO: 308 - protein, 532 aa, unidentified
  source 1..532: note = Related to VKHP01000048.1; note = Bradyrhizobium sp.
MPSFASFFVTPVRVSVPNELTSEAELLKFLALSTAELKKIWWFRGRMYQKFEISKGEGKKRVISAPDHRLKMLQTKIASSLTPICRPRNPVHGFVDGRSVKTNATAHRRSKFVMNLDIEGFFSAITEGRVSGLMSALGIDSRVAEILARICCNEGVLPQGAPSSPIISNMICFRMDKELQTIAKESRCIYTRYADDITFSSYQPLTLLFEGPTPPAGKFSPELLKDRLRGAFRSNGFAINPQKVHYADKYSRRTVTGLKINELVNVDRKFVRNIRAALFVTEKQGATSAQKILKDKYGREAALASHLRGRISWVGHIKGPSDPIFRGLALRYNKLFPSEKLEILPTIFEIRERAVWVVEHWGDTTTEGSVQGTAFFLKSVGLVTASHCVEGATEIEIYHPSKPSNKFKVTVAKNDTHRDLAVLTHEIPATEYYEFDISKRTLKVGDITTALGFPSFGAGDKINVRSGPITSLPTKSAVPMIEVTQKLSQGMSGGPLLDEDGAVAGINHKGGPGEARDFAVHVKALTDWLSGA

SEQ ID NO: 309 - protein, 531 aa, unidentified
  source 1..531: note = Related to NZ_LUFV01000044.1; note = Ensifer sp.
MTNPFAFLDIAYRIDLPDELKDEERLLLHLGVSQAELKKIWWYRSRMYHHFDVAKGKRKKRIISAPDPRLKMLQRTIAASLNVVYKPRRPVHGFVIDRSVKSNALSHLNSKFVLNLDLKDFFPSITENRVSGLLNALGIDARVSEIIARICCDKSQLPQGAPSSPVISNMICFKLDKELQVIAKAARCIYTRYADDITFSSYQPLTLLFEGVAPPAGNISPELLSKQLREAFQNNGFTINSEKAHYADRHSRRTVTGLKVNEILNVDRKYVRNVRAALYTVEKAGVEAAQKRLEEKYNKRSSIASHLRGRIAWIGNIKGWNDPTFRSIALRFNNCFPKDQLKIEPDREEIINRSVWLVEHSLGSVKKMAQGTAFFLKGVGLVTAAHCVQNGKGIVVYHPSKPSNKFPVNVANSCKYRDLAILSHSISDQEFYELNASERSFKAKDNLTAYGYPGFGPGDKLNVRPGYVNSLPVKSSIQLIEVSQKLAQGMSGGPILDDDGHVAGVIHKGGPEEARDFGVHIEVLMKWLKEL

SEQ ID NO: 310 - protein, 537 aa, unidentified
  source 1..537: note = Related to NZ_FOWZ01000002.1; note = Qipengyuania nanhaisediminis
MTNGWLGFGIPTSIHLPIPPELSSKTALLSYLGVSPAEMKKIWYHREKMYHCFDVAKKSGKPRLINAPDRRLKFLQRRIANLLDQLYRVRNPVHGYVQGKSVKSNATSHLKQRFILNLDIRDFFGSISERRVFGVLHAIGVPRDAAETVARICCYSGHLPQGGPASPVLSNMVCFRLDRALLKLAKDSKCIYTRYADDISLSSLRPLTALFDGTLPTTGRVDPELLSAALQAAFTSNGFALNPEKIHYADRHSRRVVTGLKVNEGLNVDRRFVRNIRAALYEVEKDAVAAQARYAADFGGKADISSHLKGKIAWLGNVKGLADPVYRALALRFNTAFPKRAIKVQPTRHERLDRSVWVIEHHLNDIEKYAQGSVFFLAGVGLVTAAHCVAGVKDAIVHHPSRPSNKFKVSVAHYSKHRDLAILTHSIPATDFYELSKSAAAAVTGDPIVAIGYPDFSPADKVNFREGTVSSTTVKSLINLLEVNFKFIQGMSGGPVINSNDEVVGIVHKGGPKEKRDFAIVIEEFDSWNAAGLPSDY

SEQ ID NO: 311 - protein, 395 aa, unidentified
  source 1..395: note = Related to SLXW01000017.1; note = Sphingomonas sp.
MPNGWQRFGIPAPVHVPIPPELVSKAALLVHLSVSPAELKKIWYHREKMYENFDVAKKSGKPRPINAPDRRLKFLQRQIAELLDTLYPVRKPVHGYVSGKSVKSNATSHLKQRFILNLDIKDFFGSITERRVSGILNAIGVPSDVAETVARICCYGGHLPQGGPASPVLSNMVCFRLDRALLKLAKDAKCIYTRYADDISLSSLRPLAPLFDGALPPTGQVAPELLSDALQAVFANNGFTLNPDKIHYADKHSRRVVTGLKVNEGLNVDRRFVRNVRAALYAVEKDVAAAQTRYAADFGGKADVGTHLKGKIAWLGNVKGLADPVYRALALRFNTAFPKQSIKVQPTRHERLNRSVWVDLLPINHAIGKLARQMETSDAARPIYRGSDHWRAARA

SEQ ID NO: 312 - protein, 535 aa, unidentified
  source 1..535: note = Related to NZ_CP039250.1; note = Sphingopyxis sp.
MPSVWSMFGTAVQIPLPPEFGDEGTLLAYLGLSQAELKKIWYHREKMYKNFNVAKKSGKPRPINSPDRRLKFLQRQIATKLDMIYPRRNPVHGYVKERSVKSNAAAHQNQRFVLNLDIKDFFLTITEGRIVGVLTAIGVPDRVSAIIARICCYGGRLPQGGPASPVLSNMICFRLDRALLKVAKEGRCIYTRYADDISLSGLRPLSPLFENGLPPSGPISPELLSSALQSAFANNGFVLNPEKIHYADKFSRRVVTGVKVNEGLNVDRRFVRNIRAALFEVEKDHLAAQARYLSKFGGSTTISAHLKGKIAWLGFIKGSADPVYRSLALRFNKSFQSQAITVQATREEQIDRSVWVIEHGSVLDDTYRQGSVFFLDGVGLVTAAHCVAGVKEATVHHPSRPSNKFKVQVLHYSKHRDLAILSHAIPPTDFFQFAKSLIPAAAGDAVTAFGYPDFNPADKINIRSGTVSSTTVKSLIPLVEVNFKLSQGMSGGPLINSSDAVVGIIHKGGPEMPRDFAIVISELDKWIAAGCPDDF

SEQ ID NO: 313 - protein, 528 aa, unidentified
  source 1..528: note = Related to MIAM01000006.1; note = Sphingopyxis sp.
MPSPAMMFGPPPRVTIPPALETEAALLAHLGLSSAELKRIWWFRHRMYRDFNIAKGAGKLRIITAPQDRLKHLQRRIADLLTPMYRVRHPVHGFVADKSVKTNARSHVKSKFVLNLDIRDFFGAITENRVEGLFRSLGIDRRVAEILARLCCNQNRLPQGAPSSPVISNMVCFRLDKELLAVAKATRCIYTRYADDISFSSYRPLSGLFEAALPPTGNVSPDLLSTDLRSAFETNGFAINPEKAHYADRHSRRIITGVRINEGLNLDRRFIRNLRSGLYSIEKLGETAAEAKYHAKHGGTASLESHLRGKLSWLSDIKGASDPVFRNLAKRFNLLFPKAPIGIEPTPAEVRDRAVWVIEHSGPKGRQGTAFFLKDYGLVTAAHCVSEASEPIIVYHPSRLSNKIPVTVAKTCPHRDLAIIAHAVPPNEYYELEVTEKPPAVEDHVTSVGYPQFGFGDRLNVRKGTVSSLPVKHAVQQIDVGIRITEGMSGGPLLAEDGKVIGINHKGGIDEDRDLAIHIQQLVKFASE

SEQ ID NO: 314 - protein, 434 aa, unidentified
  source 1..434: note = Related to NZ_LHZT01000034.1; note = Acetobacter tropicalis
MHIVIARIICLTWRDWKGDPVPRSASIFGRAIRVKLPPELLTEVNLLTHLGMSRGELNVINWYARRMYHSFDIKKKSGKPRVINAPERRLKLLQRKIADLLMPLYRRRNPVHGFVADRSVKTNAQSHLNSKFVVNLDLKDFFPSISQKRIVGVLRSLGIDRGVADAISTICCLNGCLPQGAPSSPVLSNMICFRLDKELLEFAKQAKCIYTRYADDLSFSSYQPLGSLFQTSPPSPGHFSPDLLGEKLRHIFTANGFILNPDKAHYADRHSRRTVTGIRINELLNVDRRFVRNLRAALYSVEAQGIATAEAKFHASYNGKSDIGKHLQGKIAWLGYIKGASDPVFRGIASRFNKAFPSLKLEIQPTPQEIRERAVWLIEHWERTGDQGTAFFLEGVGLVTAEHCVSPSGIVELYHPSKPSTRKSHRRVVHRVRL

SEQ ID NO: 315 - protein, 513 aa, unidentified
  source 1..513: note = Related to NZ_JH992904.1; note = Sphingobium yanoikuyae
MKLPPELMSEASLLAHLGVGRAELNVISWYAGRMYHKFDIKKKSGKARVINAPDRRLKMLQRKIADLLTPLYRRRNPVHGFVIGRSVKTNAQSHLGSKFIVNLDLKDFFPSISYGRVTGVLRSLGMKREVAEAIATICCLNGTLPQGAPSSPILSNMVCFRLDRRLRELAKDARCIYTRYADDLSFSSYQPLMGLFETTPPASGHFSPDLLSEKLKQIFSGNGFVLNPDKAHYADKHSRRTVTGIRINEALNVDRRFVRNLRAALYSVETLGLAAAQAKFKSLHGGKADVGQHLQGKVSWLGYIKGASDPVFRSVASRFNAAFPPLALDILPSPQEIRERSVWLIEHWETGGDQGTAFFMKGVGLVTAEHCISPSGIVELYHPTKPSNKFAASVKHRCPDRDLAVLDHAIPNNEFYELETAGKAAATGDATTAIGYPGYGPGDRLNIRPGAVTSLPTKSAVKMVEVQQMLTPGMSGGPLLDVDDRVVGVVHKGGHDHGRQLAIAISELHAWLP

SEQ ID NO: 316 - protein, 526 aa, unidentified
  source 1..526: note = Related to JAAVJH010000001.1; note = Sphingomonas corticis
MPRPARAFGPPIRVKLPVEVASEGAILAHLAVSPAEAKKIRYYRARMYRTFSIQKKSGKARIITAPDRRLKMLQRRICDLLTPVYRRRNPVHGFVADRSVRTNAEAHLGSKYVVNIDLKDFFPSISERRVTGVLMSLGIGRDVAEILSSICCVNGCLPQGAPSSPLLSNMICFRLDKELMAFAKRTRCIYTRYADDITFSSYQPLAGLFEAVPPSPGRFAPDLLSAEVAAIFAANGFVINPEKAHYADRHSRRTVTGLRVNEAINVDRRFVRNLRAALFSVEKLGAAAAQAKFHATHGGRVALGNHLQGKLSWLGYVKGQSDPVFRSMASRFNRSFPDRALTIQPTRDEIRDRAVWLVEHWENGGDQGTAFFLRGVGLVTASHCVSPSGAVEVYHPSKPSNKFTANVKHRCEHRDLAVLDHAIAATEFFELEAAATAVVTGDATVAVGYPGFGPGDKLNVRTGNVTSLPIKSGVQMVEVQQMLTQGMSGGPLTDPDDGVIGIIHKGGPEHGRQLSVAIEVLRDWLA

SEQ ID NO: 317 - protein, 500 aa, unidentified
  source 1..500: note = Related to NZ_JACYUG010000002.1; note = Sphingomonas sp.
MKHLGLGAAEAKKIRYYRSKMYRTFDIRKKSGKARVINAPDRRLKILQRKICDLITPLYRRRNPVHGFVADRSVKTNAQSHLGGKFIVNLDLKDFFPSISERRIVGVLMALGLKRDVAERLSSICCVDNGLPQGAPSSPILSNMICFRMDKQLMAFAKSARCIYTRYADDITFSSYRPLTGLFESVPPPSGSFPPELLSSELLGIFGSNGFTIHPDKAHYADRNSRRTVTGLRVNENLNVDRRFVRNLRAALYSVEKLGEKPAETKFHADHGGRAPIGRHLQGKLAWLGHIKGPADPVFRSIASRFNAAFPSLALKILPTQLEIRERTVWLIEHWEGTGAQGTAFFLTGVGLVTADHCVSPSGAVEMYHPSKPSNRFAAMAKHRSSDRDLAVLDHAIPPNEFYELDASNVGSVTGDATVAIGYPGFGPGDKVNVRSGNVTSLPTKSGIQKIEVQQTLTPGMSGGPLLNSIGQVIGVIHKGGAEEERQLAIDISVLQKWVP

SEQ ID NO: 318 - protein, 526 aa, unidentified
  source 1..526: note = Related to NZ_NSBT01000026.1; note = Actibacterium ureilyticum
MPSAFYLFGGTSRTIIPAELSTKSELLKHLGVSPAELKKIWWFRGRMYSHFNISKRSGKVRLISAPDYRLKMLQQKIARSLSGLYNPRNPVHGFVPDRSVRSNAEAHLRRRFILNVDIKNFFPAITEARVQGLLESIGVDTDVAETITRICTNNGCLPQGAPSSPVISNMICFRLDKSLMNFSKEHRLLYTRYADDITLSSFQPPTALFEGDRPDSGRLPPEKLSGELLSILGNNGFELNPEKIHYADKNSRRMVTGIKINEGLNVDRRYVRKIRSALFKVESASVAAAEAELKTRFGKSCKIQAHLQGKISWVGFVKGQSDPVFRGLAERYNACFPASPIKVHPTQAELLDRSVWVLETEKNTGTAFFLRGVGLVTAAHCVNGASSIEVFHPGKPANTFMVGVQHICTHRDLALLSHSIPSTDYFELEEFGGFPATGANTIAAGFPSYGPGDRLNIRPGTISSLTIKHAVNLIEVTQKLSQGMSGGPLMTQDHAVMGVIHKGGPDEPRDFAVTLSEMKSWIATLP

SEQ ID NO: 319 - protein, 547 aa, unidentified
  source 1..547: note = Related to QFVT01000013.1; note = Litorivita pollutaquae
MCTWGDWRGNLVPSPFNLFGGASRTKIPPELTSKDELLKHLGVSPAELKKIWWFRGRMYSHFNISKRSGKTRLISAPDYRLKMLQQKIARSLAKLYNPRKPVHGFVPDRSVRSNAESHLRRRFILNVDLKNFFPTITEPRVQGLLESIGINKDVAETVARICANNDCLPQGAPSSPVISNMICFRLDKALMKFSKEHRLLYTRYADDITLSSFQPPTALFEGDRPDPGKVAEEKLSDELRSIIRNNGFELNPEKIHYADKNSRRIVTGIKINEGMNVDRRYVRNVRTALFKVEKHGPAAAQAELEARFGKTCKIQAHLQGKISWVGFVKGQSDPVFRGLAKRYNACFPACPIKVHPTQAEIVDRAIWVVETEDDTGTAFFLKGVGLVTAAHCVNSASEIEVFHPLKTANRFKVTIKHICAHRDLAILEHSISSTEYFELESFTGSPVVGTNTLAAGFPTYGPGDQLNIRQGSISSLTTKSAVPLIEVSQMLGQGMSGGPLMNKNNEILGIIHKGGPVAYVAKDGSVSPQRQLAVAISELKAWVSALP

SEQ ID NO: 320 - protein, 367 aa, unidentified
  source 1..367: note = Related to CH959310.1; note = Sulfitobacter sp.
MICFRLDKTLINFSKEHRLLYTRYADDITLSSFQPPTALFEGDRPDPGRLALEKLSDDLRMIFKNNGFELNPEKVHYADKNSRRMVTGIKINEGLNVDRRYVRNVRSALFRVETTGLAAAQAELKTRFGKSCKVQAHLQGKISWIGFVKGQSDPVFRGLAKRYNASFPASPIKVHPTKDEIFDRAVWVVETDDDTGTAFFLDGVGLVTAAHCVNGASEIEVFHPLRTSNKFKVTIKHICAHRDLAILEHLIPSTEFFGLEAFEGSVTVGTNTLAAGFPTYGPGDRLNVRQGSISSLTTKSAVPLIEVSQMLGQGMSGGPLMDEDHAVFGIIHKGGPVAYVTKDGSVSPQRQLAVAISELKAWVATFP

SEQ ID NO: 321 - protein, 533 aa, unidentified
  source 1..533: note = Related to NZ_JAKFZM010000082.1; note = Leisingera sp.
MFYLFGGTSRAKIPGELSSRSELLKYLGVSPEELKKIWWFRGRMYSHFDISKRSGKSRTISAPDYRLKMLQQKLARSLSGLYSPRNPVHGFVPDRSVRTNAETHLRRRFILNIDIQNFFPSITEARVQGLLTSIGVDTNVAEIVARICSNNGCLPQGAPSSPVLSNMICFRLDKSLMRFSKEHRLLYTRYADDITLSSFQPPTSLFEGERPAPGRLSPEKLHAELRMIFQNNGFELNPEKIHFADRNSRRIVTGIKVNEGLNVDRRYVRNVRSALFKVERSGLAAAQTELKSRFGKSCKIQSHLQGKISWVGFVKGQSDPVFRGMAKRYNACFPANPIKVHPTRAEIVDRAIWVVETEFDNGTAFFLDGVGLVTAAHCVDGASKIDIFHPLRTSNRFKVTIKNICTHRDLAILEHSVASTEYFELGSFTGSPTIGANTRAAGFPTYGPGDQLNVRQGSISSLTTKSAVPLIEVSQMLGQGMSGGPLMTEDDSVLGIIHKGGPVAYVAKDGSVSPQRQLAVAISELSAWVATLP

SEQ ID NO: 322 - protein, 546 aa, unidentified
  source 1..546: note = Rhodospirillales bacterium; note = Related to JACZKS010000020.1
MPEDVRQSWRDWKEGLVSYRGALFGKPIRITIPAELADEAALLAYLGLGAAELKKIWHFRGRMYQHFSIAKGPNKVRLISAPDQRLKFLQRRLADKFTELYRPRHPVHGFVVGRSVKTNALAHLHRRFVVNIDLKDFFPTIAQNRVEGMLFSLGIDARVAEIIARICCNRGHLPQGAPSSPVLSNMICFRLDKQLLDVAKETRCIYTRYADDITFSGHRPPTALFDAALPPAGRFSPDLLAPKLLDIFQQNGFSINPDKAHYADRHSRRTVTGLKVNQLLNVDRRYVRNIRAALHSIATLGLKEAEKKFHEKHGGNSGLAAHLRGKISFLSHIKGQSDSVVRSLTLRFNKCFPAQPIKVMPTSTEIRDRAVWVVEHNLDRDHGKQGTAFFLKGVGLVTAAHCVEGVSEIEVFHPSKHANAFKATVRKRDEHRDLAILDHSIPATEYFELDPVSHAIVTGDSMTAVGYPAWAPGDPLNIRPGFVSTLTVRSAVQYIEVTQKLTPGMSGGPLLDANDAVAGIIHKGGPEEGRDFAVHIEVLEAWLKEG

SEQ ID NO: 323 - protein, 527 aa, unidentified
  source 1..527: note = Related to JADGCC010000015.1; note = Alphaproteobacteria bacterium
MTYWGALFGKPIRITIPPEFANEAALLAYLGLGPNELKKIWYFRARMYRHFSIAKAQNKVRLISAPDERLKFLQHKIAEKLTDLYRPRKQVHGFVAGKSVKTNALAHLGRRFVVNIDLKDFFPTITQKRVAGLLLSLGLDNQVTTLIAHICCNDGNLPQGAPSSPVISNMICFRLDKKLLGIAKEARCVYTRYADDITFSSHQPPTALFEVALPPAGRFSPDLFTPKLLEVFQQNGVAINPNKTHYADRNSRRIVTGLKINELVNVDRRFVRNIRAALHAVEAQGIVEAQKTFQEKYGGSSLVAHLQGKISFLSHIRGQSDPVVRSVTLRFNKCFPKHLIKVTPTPSEIRDRSAWVIEDKNGDVVQGTAFFLKDIGLVTAAHCVEPNTEFQIYHPSKPANKFAVRVKKKCTHRDLALLEHEIPATEFFELARSLNAASQGDQLTAVGYPCFGPGDGVNTRLGTVSSLPVKRDVKLIEVTQTLTQGMSGGPLLDANNGVVGVIHKGGPEEGRNFAIAIEVLSEWIESS

SEQ ID NO: 324 - protein, 525 aa, unidentified
  source 1..525: note = Related to WHTM01000007.1; note = Hyphomicrobiales bacterium
MPRWGALFGQPARVAIPAELADEAALLAYLGLGAGELKKIWYYRGRMYQHFSIAKGPNKVRTISAPDGRLKFLQRKLADKLTELYRPRNPVHGFVAERSVKTNALAHMHRRFVVNIDLKDFFPTISQNRIEGMLASLGIDARVAEILARICCNNGHLPQGAPSSPVLSNMICFRLDKKLMGIAKEARCIYTRYADDITLSSHQPPTALFEATIPQAGRFSPDLLAPELRNAVHQNGFAINPNKAHYADRHSRRTVTGLKINELLNVDRRYVRNIRAALHSIETLGIKDAEKKFHEKHSGRASLAAHLHGKISFLTHIKGHSDPVVRSVTLRFNKCFPTRTIMVAPTPSEMRDRAVWVVEHSENHGTAFFLKGVGLVTAAHCVEGVDEVEIFHPSKHANKFKATVRKSDEHRDLAILDHQIPATEYFELDSISRTIAISDPMTALGYPSWGPGDRLNIRPGVVSTVTVKSAVQLIEVTQKLTQGMSGGPLLDGNGAVAGIIHKGGPNEGRDFAVHIEMLQDWLREG

SEQ ID NO: 325 - protein, 426 aa, unidentified
  source 1..426: note = Beijerinckiaceae bacterium; note = Related to JAIEST010000134.1
MGAIFGQPIRIIVPAELANEAALLAYLGVSADELRKIWYYRKRMYRHFSISKKPNKNRLISAPNDRLKFLQRALAVKLNELYSRRNPVHGFVPDRSIRTNALAHLRRRFIVNLDLKDFFPTIGQKRIEGVLVSLNIDARVAEIISCICCVNGHLPQGAPTSPVLSNMICFRLDKKLMDFAKEARCIYTRYADDITFSSHQPPTALFETTIPAAGRVAPDRLAPRLRDLFQQNGFVINPTKVHYADSHSRRIVTGIKVNEMLNVDRRFVRNIRAALHSIETLGIEAAEEKFHDKHGGRSNLVAHLRGKISFLNYIKGQSDPVVRSIALRFNSRFPAIPIKTAPTPSEIRDRAIWIVEQSKSQGTAFFLNGVGLVTAAHCVEGFAEVDVFHPSKLANKFKARVGKLDRHRDLAILDHGIPATEYFELQ

SEQ ID NO: 326 - protein, 426 aa, unidentified
  source 1..426: note = Related to NZ_NRRL01000154.1; note = Rhodovibrio sodomensis
MFGKTVHISIPPELADEASLLTYLGLGADELKKIRYYRASMYHNFPIGTDGRKRRIINAPDARLKFLQRRISDKLADIYRRRNPVHGFVAERSVKTNALAHMRRKYVVNIDLANFFPTISQNRVEGMLLSLNLDASVAQIIGIICCNKGILPQGAPSSPLLSNMICFKLDKGLMNFSKEARCIYTRYADDLTFSSFHPPAALFETAPPPAGRLSSEQLASQLRRLIIQNGFSINERKLHYADRDSRRLVTGLKINQILNVDRRYVRNIRAALFSVERNGIKGAEKTYHKEHGGRGSLAEHLRGKISFLSHIKGQHDPVVRGLAIRFNQCFPHWPITVTPTKNEVRDRAVWVVENETSSQGTAFFLRGVGLVTAAHCVEGVNEVDIFHPSKPSNKFKAKIFKREPHLDLAVLSHAIPENEYFELSKS

SEQ ID NO: 327 - protein, 527 aa, unidentified
  source 1..527: note = Related to NZ_LMUJ01000012.1; note = Acidisphaera sp.
MPLFGAFFGAPVRVTIPEALADETSLLTYLNLSGPELKKIWFYRARMYRHFSIAKSSTKVRLISAPDQRLKFLQRQLADKLDELYRPRNPVHGFVADRSVKTNALSHLHRRFLLNIDLAEFFPTITENRVQGLLISLGIDSRVADIIARICCNDGQLPQGAPSSPVLSNMICFRLDKQLMTIAKDTRCIYTRYADDITFSSYQPPVGLFEATLPPSGRFLPDLLTPALRGVIQQNGFVINPEKAHYADRHSRRIVTGLKVNELLNVDRRYVRNIRATLYSVEKLGAKEAEQKFHDSHGGRSSLAAHLQGKIAFLTHIKGRWDPVVRGITLRFNKCFPERALKVRPTPQEIRGRSVWVVENDPAQQQGSAFFLKDVGLVTAAHCVENTDEVEVYHPTKPANKFVARVSKKCEHRDLALLEHSISSTEFLELIRSERAVSQGDPLTAVGYPRFHVGDRLNARPGNVISLVARSGVEMIEVNQTLTQGMSGGPVLNGDDGVVGIIHKGGPGEGRDFAVSIAMLNKWLEEK

SEQ ID NO: 328 - protein, 526 aa, unidentified
  source 1..526: note = Related to SUEQ01000018.1; note = Mesorhizobium sp.
MPSAARIFGKHFPIPIPPQLADEATLLAHLGLSTKELKKIWWYRGRMYHQFSIAKGAGKVRLITAPDRRLKILQSKLAPLLDQLYSVRHPVHGFVPARSVKTNAEAHGRRRFVVNLDLQDFFPTITENRVRGLLTSLNVDARVTEIIARLCCFNNHLPQGAPTSPVISNMICYRLDTELLRIGKGARAIYTRYADDITFSSYQPPALLFEGALPPVGRFSRDLLALPLRGTFQSNGFTINPDKSHYADRNSRRIVTGVKINAGLNVDRRYVRHIRALLHSIETLGLADANAKFVAAGGKGSIAAHLRGKISYIAHLKGRTDPVVRTLALRYNTSFSHQPIKLVPTVEERRDRSVWIVEHSANGGEQGTAFFLKDVGLVTAAHCVEGVSDFIVYHPTKPSNQASVTVLKRCEHRDLAILGHAIHDTEYFELGAASRAIAVDDVVKAYGYPGYGPGDKINVRSGAVSSLPIKSAVQMIEVTQELAQGMSGGPILDAHGEVIGVIHKGGPNEGRQLAIHIGVLQKWAQE

SEQ ID NO: 329 - protein, 526 aa, unidentified
  source 1..526: note = Rhodospirillales bacterium; note = Related to REES01000140.1
MPSVMRIFGNLIPIAIPPELAAEPPLLTHLGLSAKELKKIWWYRGRMYKQFSIAKNSGKVRLITAPDRRLKILQRKLAPLLDQLYLVRNPVHGFVPARSVKTNAEAHGRRRYVVNLDLQDFFATITENRIRGLLISLDIDTRVADIVARLSCVHGHLPQGAPTSPVLSNMICYRLDTELLRVAKGARAIYTRYADDITFSSYQPPAPLFEGALPAVGRFSPEVLAPRVRQTFDTNGFTINPDKAHYADRNSRRIVTGVKINAGLNVDRRYVRHIRALLHSIETMGLADAQAKYTATGGKGSLAAHLRGKISYITHLKGLTDPVVRALALRYNRSLGHRPIKLAPTIEERRERSIWIVENSAKAGKQGTAFFLKDVGLVTAAHCVEGDSDITVYHPTKPTNHAKVTVLKRCKHRDLAILGHTIHETDYFELEPTDHVVVVGDFVIAYGYPGYGPGDKINVRGGSVTSLPMKSAVHIIEVDQELAPGMSGGPILDARGDVIGIVHKGGPDEGRQLAVHLDELQTWVQE

SEQ ID NO: 330 - protein, 507 aa, unidentified
  source 1..507: note = Related to RCVT01000005.1; note = Sphingomonas sp.
MADEASLLRHLGLSPRELKKIWWYRGRMYQQFSIAKGGGKVRLIMAPDRRLKILQSKLAPLLDQLYRVRNPVHGFVQLRSVKTNAEAHGRRRFVINLDLQDFFPTITENRVKGLLKSILIDPRVAEIVARLCCVESHLPQGASTSPVLSNMICFRLDTQLLQIAKSARAIYTRYADDITFSSYQPPAPLFEGALPAVGRFSPDMLAAPLRGAFESNGFIINPVKAHYADRNSRRIVTGVKINGGLNVDRRYVRRIRALLHSIELLGLDDAQQKYGSGGGKGAIADHLRGTISYITHLKGSVDPVVRSLATRYNRSFPARPIMLAPTVEERRDRAVWIVEHSADGGQQGTAFFLKNVGLVTASHCVEGDSDFVVYHPSKPSNRSKVTVLKRCAHRDLALLGHAAHSTDYFDLDVAARSAAVGDDVVAFGYPGFGPGDKINVRGGSVTSLPIKSGVPMIEVSQELAQGMSGGPILDAHGAVVGIVHKGGPEEARQLAIEIGVLLKWLAE

SEQ ID NO: 331 - protein, 524 aa, unidentified
  source 1..524: note = Related to NZ_SSTI01000022.1; note = Sphingomonas olei
MSSAARIFGKRIPIPIPPEFADESTLLAFLGLSPRELKRIWWFRGRMYHQFEIAKGGGKSRLITAPDQRLSILQSKLRPLLNTLYRVRNPVHGFVPARSVKSNAEAHGRRRFIVNLDLQHFFPTITENRVRGVLEALGVDQRVAEIIARLCCFESHLPQGASTSPVLSNMICYRLDTDLLRLAKTGRAIYTRYADDITFSSNQPPAPLFDGALPTVGRFSPELLASALRDAFQTNGFILHPDKAHYADRNSRRMVTGVKINDGLNVDRRYIRRIRALLHSIETLGLADAQSKFAGLGGRGALAAHLRGKIAYISHLKGATDPVVRALAQRYNKSFGATPITLVPTPQERRDRSVWVVDHIDQYGSAFFLKGVGLVTAAHCVKGLSEVEILHPSKHTTTFSAKVLKRHDHRDLALLDTSTIPATEYFELDLATTPPLVGDPVTAVGYPNWAPGDRLNHRPGVVSLITPQAGVRKIEVSQMLTQGMSGGPILDANAGVVGIIHKGGPGEGRQLAIHLSVLQEWLKE

SEQ ID NO: 332 - protein, 536 aa, unidentified
  source 1..536: note = Related to JAGMXV010000066.1; note = Rhizorhabdus sp.
MGDWRDWKGDLVSVARIFGKHFPLQIPQELADEASLLAHLGLGPKELKKIWWYRGRMYERFDIAKGGGKIRQITAPDKRLKILQSKLTPLLDQLYRVRNPVHGFVPERSVKTNAEAHGRRRFVVNLDLKDFFPTITESRVKGLLGALAVDDRVAEIIARLCCVNDHLPQGAPTSPVLSNMICFRLDTELLRVAKAARSIYTRYADDITFSSYQPPAPLFEGALPAVGRFSPDTLAPTLRNVFAGNGFVVNPDKAHYADRNSRRIVTGVKINASLNVDRRYVRHIRALLHSVETLGLGDAQQKYTDAGGKGVIAEHLRGKIAYVTHLKGLTDPVVRSLAMRFNKSFTARPIRLAPTVEEQRDRAVWIVEHSANGGKQGTAFFLKDIGLVTASHCVEGESDFTVYHPSKPSNQFKVSVAKRCEHRDLALLGHAIPTTDYFELVVATHPVAVGAVVTAFGYPGFGPGDKLNVRGGSVTSLPIKGGVQRVEVSQELAQGMSGGPVVDAQDCVVGIVHKGGPEEARQLAVAISALQDLAAE

SEQ ID NO: 333 - protein, 526 aa, unidentified
  source 1..526: note = Related to NZ_CP093335.1; note = Sphingopyxis granuli
MPSAARIFGKHFPLPIPPELADESSLLAHLGLSPQELKKIWWYRGRMYAQFSIAKGGGKVRQITAPDKRLKILQNKLAPLLNQLYRVRNPVHGFVPARSVKTNAEAHGQRRFVVNLDLKDFFPTITENRITGLLRSLGVDDRVAEIIARLCCFNSHLPQGAPTSPVLSNMICFRLDTELLRAAKGARSIYTRYADDITFSSYQPPAPLFEGALPAVGRFSPDTLAPSLRDTFTRNGFAVNPDKAHYADRNSRRVVTGVKINAGLNVDRRYVRRIRALLHSVEKLGLRDAQQKYADAGGKGVIAEHLRGKISYITHLKGATDPVVRSLAIRFNKNFRARPIKLAPTIEEQRDRAVWLVEHSANCGQQGTAFFLKDIGLVTASHCVEGVSDFTVYHPSKPSNRFEVTVAKRCPHRDLAVLDHAIPASDYFELEAAAQSVAVGDAVTAFGYPGFGPGDKMNVRGGSVTSLPVKSGVHLVEVSQELAQGMSGGPIVDGHDGVVGIVHKGGPEEARQLAIAIGVLQKWVAE

SEQ ID NO: 334 - protein, 501 aa, unidentified
  source 1..501: note = Related to CP038440.1; note = Brevundimonas sp.
MTSARRMFGKQIRIPLPPELANPDALLAYLEVSPAELKKIWWFRGRMYSEFNIAKRSGKVRTITAPDRRLKIIQSKLAPLLDQLYRPRHPVHGFVPNRSVKTNAEAHGRRRFVVNLDLKDFFPTITEKRVVGLLRALGVEKGVAEIVARLCCHMGQLPQGAPTSPVLSNMICYRLDTDLQQVAKSARAIYTRYADDITFSSYQPPTTLFETAVAGAGRFSPEVLAPQLRGAIASNGFLINPDKAHYADRNSRRMVTGVKINAGLNVDRRYIRRIRAMMHSFERVGLAEAQAKYASGGGKGSLAAHLRGKIAYVAHLKGQTDPVVRSLAQRYNKSLPAKPIRLTPTVEERRDRAVWVIEVPLKHNGTAFFLAGVGLVTAAHCVEGLSEVEVLHPSRHTTTFTVKVRHYDKHRDVAVLDHGTIPATEFYELEPATKPAAVGDAVVALGYPLWGLGEGLNIRPGEVSSLTVRSTSAGFSARRPSKRSERGPSLSGVDCASASRS

SEQ ID NO: 335 - protein, 360 aa, unidentified
  source 1..360: note = Related to NZ_VLKT01000135.1; note = Mesorhizobium tianshanense
MSNMICYRLDTELLRVAKSARAIYTRYADDITFSGYQPPAPLFEAGPPPVGRFSSDLLSTALRVAIEGNGFTINPQKAHYADRNSRRIVTGVKINSGLNVDRRYVRDIRAKLNSVEKHGLKASQARHSAKNGKGDICSHIRGKIAYVVHLKGLADPVVRSLALRYNRSFADQPMKVTPTDSERRDRSVWIVEHSGNEGEQGTAFFLSGVGLVTAAHCVENPEDLLLYHPSTPSNQTRVSVRKRCEHHDLAILDHAIHPNEFFEMEAATVAAAVGDDVTACGYPGYGPGDRLNIRNGTVTSLPRKSAIDRVEVSQELSQGMSGGPVLDAGGRVVGIIHKGGPNEGRQIATAIHELKKWAAS

SEQ ID NO: 336 - protein, 526 aa, unidentified
  source 1..526: note = Related to NZ_CP018171.1; note = Aquibium oceanicum
MPSAARVFGKLYPINIPAALGDEATLLAHLGMSPPELKKIWWYRGKMYRRFSITKGSGKTRTICAPDSRLKILQRKLAPLLGQIYRVRNPVHGFVLDRSVKTNAEAHGARRFVVNLDLQDFFPTITENRIVGLLTSVGLERRVAEIVARVACYDGHLPQGAPTSPVLSNMICYRLDKALLRIAKSARTIYTRYADDITFSGYQPPVALFEAGPPSVGNFSPELLSAALRTAVQGNGFIINPHKLHYADRNSRRIVTGVKINSGLNVDRRYVRDIRAKLSSIERHGLKASQATYFSKGGKGDIGTHIRGKIAYVGHLKGLADPVVRSLALRYNRSFADHPVKITPTESERRDRSVWIVEHSGNGGEQGTAFFLSGVGLVTAAHCVEDPEDLLVYHPSTPSNQANVSVRRRCQHRDLAILDHAISSNEFFEMEAATTAVAVGDDVIAYGYPGYGPGDRLNIRSGKVTSLPRKHAIDRVEVSQELSQGMSGGPVLDASGKVVGVIYKGGPNEGRQIATAIHELKKWTAV

SEQ ID NO: 337 - protein, 524 aa, unidentified
  source 1..524: note = Related to NZ_QAYG01000015.1; note = Breoghania corrubedonensis
MPRNPFGPPIRAAVPAELASEAALLAHLGMTVGELNKIRWYRDQMYQTFEIAKSGGKSRLISAPNKRLKHIQRQLLPLLYQLYQTRSPVHGFVFNRSVKTNAQSHLRRRFVLNLDLQDFFPTITENRVVGMLKAIGIGATVAVAIGYLCCIHGHLPQGAPTSPVLSNMICFRLDRELLAFAKASRCIYTRYADDITLSSHQPMSALFEGSPPPAGNFANDLLVSALTAIVVGNGFTINPMKAHYANRHSRRMVTGLKINDLLNVDRRYIRNIRAVLHSVETLGFVGAQTKYATSGGTGSLAAHLRGKIAWISHIKGPSDPVVRSIALRFNTCFADRKIMVTPTPIERRERSVWIVEHDDGQGTGFFLSGVGLVTAAHCVTGKREVEVFHPSKHANTFKATVLQRDDHLDLAILGHEIPATEYYELNRAALPVVTGDPMTAVGYPKWAPGDPLNVRPGVVSTVTIKSAVRLIEVTQKLTQGMSGGPLLDANGDVAGVVHKGGPEEGRDFAIHVEVLNSWLAHLAS

SEQ ID NO: 338 - protein, 495 aa, unidentified
  source 1..495: note = Related to JAIETD010000062.1; note = Methylobacterium sp.
MTAKELNKIRWHRGGMYQSFEIAKNKDKGRLISAPDDRLKHLQRQLLRLLDPLYTVRNPVHGFVLQRSVKTNALSHLRRSFVLNLDLQDFFPTITENRIVGMLEALGIGSSVAAAIGYLCCINGHLPQGAPTSPLLSNMICFRLDRELLNFAKVTRCIYTRYADDITFSSHRPMTALFEGPLPLAGHFAPNLLVPSLVALFAGNGFTINPSKAHYADRHSRRMVTGLKVNELLNVDRRYIRNIRAALHSVETLGTVGAQAKYEASGGSASLASHLLGKIAWISYIKGSSDPVVRSIALRFNWCFPDCKIEVLPTPIERRDRAVWVVEHDDGQGTGFFLNGVGFITAAHCVAGKKEVEIFHPSKHSNSFKAIVLKSDDDMDLAVLSHEIPATEYYKLDQAALPIATGALMIAVGYPKWAPGDPLNVRPGVVSTITVKSAVRLIEVTQKLTQGMSGGPLLDADGAVAGVIHKGGPEEGRDFAIHIDVLNSWLAAAAP

SEQ ID NO: 339 - protein, 560 aa, unidentified
  source 1..560: note = Xanthobacteraceae bacterium; note = Related to JAFBAI010000383.1
MSREDVRAIRLLREWRDWRGDLVPQNPFGPPVRIDIPAELASEAALLSHLGLSVMELKKIRWCRGRMYQSFDIAKVKNKIREINAPDSRLKHLQRQLLPLLDQLYRVRKPVHGFVADRSVKTNALAHLRKHFVLNLDLKDFFPSITENRVVGVLKALGIDGSVAAVIGYLCCVNGQLPQGAPTSPVLSNIICFRLDRKLLAFAKDARCIYTRYADDITFSSYQPMTTLFEGPLPPAGHFVPDLLAAAFASIFVVNGFAINPAKAHYADRHSRRMVTGLKINELLNVDRNYVRNIRAALHSIETIGGIAAQRKFEARGGTGSLAAHLLGKLSWLRHIRGQTDPVFRSVAVRFNNAFPTHKIDVTPTPAEVRDRAVWVIEHYEGDIDQWYQGSAFFLRGVGLVTAAHCVTGASEAEVYHPGKPANKFKVTVLKIDDHRDLAILAHMIPETEYLELERSTQVITVGMLLTAVGYPSFGSGDRLNVRDGNVSSLPVKHGVQYIEVQQKLSPGMSGGPLLDAYNAVTGVVHKGGPSEPRDFAIHIDVLNAWLASASASFGPNGSA

SEQ ID NO: 340 - protein, 419 aa, unidentified
  source 1..419: note = Related to NZ_CP021912.1; note = Erythrobacter sp.
MVAYLSLTEAELKKIRWFRRGMYHYFELAKGNGKRRRIMAPDARLKHLQRALLPLMENLYRVRNPVHGFVRDKSVKTNAAAHLRRRNLLNIDLKDFFGAITENRVVGVLEAIGVPGDVAAAIGYLCCCEGSLPQGAPSSPLLSNMVCFRLDRELMRYAKEHRCIYTRYADDITLSSHQPMASAFDGPIPPAGTVQSELLDPELRGIIGSNGFELNPDKIHYADRNSRRMVTGLKVNELLNVDRRFVRNLRAMLHSIEIKGHADAKARFASLGHSGSMSAHIRGKIEWLASIKGTSDPVVRGIILRYNACFPGKAIAVSPTDEERQDRATWITENKNGQGSLFFLKGVGLVTAAHCVADLLNLEIFHPSKHANRFGATVTKYDKDRRRLRLGLKRVLDPIEAEMCACLTAPLFGTGPRIL

SEQ ID NO: 341 - protein, 545 aa, unidentified
  source 1..545: note = Related to JAGOQV010000032.1; note = Alphaproteobacteria bacterium
MHNPFGPSTPPRISIPQELENKESILAYLDVNPEELKKIWWFREKMYQAFEIQKRGGKARVISAPDDRLKYLQHKILLLLNRLYRVRNPVHGFVPQKSVKTNATAHLRKRFILNIDLKDFFPSITENRIIGVLKSIGIDDQVAQIISRICCSNGCLPQGAPTSPVLSNIICFRLDKNLMSLAKDTRCIYTRYADDLTFSSHQPMIKLFEGVITPAGHVSPELLSLHLRNIFLANGFIINPDKVHYADRNSRRMVTGLKVNEFVNLDRRYIRNIRAILHSIKVSDVKAVETKYKQDYGGKVDLGKYLRGKITWLGFIRGQSDPIFRAIAIRFNEEFPDLKIETTPTFIEIRDRAVWVIEYCVDTLAGLKAFQGSCFFLKDVGLVTAAHCVLDENEPMKELELELHHPSKPANKFKAKICMFDKHRDLAILSHKIPATEYYELELSTKTISVDDELTAVGYPSFGPGDQTNIKKGTVSSLPKKSDVQLIEVTQKLAQGMSGGPLHDSNFAVVGVIHKGGPSEGRDFAVHFDELNKWLSTPPISKILG

SEQ ID NO: 342 - protein, 500 aa, unidentified
  source 1..500: note = Related to SUEX01000026.1; note = Mesorhizobium sp.
MSGKELKKIWWFRGRMYHQFEIAKREGKTRIINAPDKRLKHLQRQIAPLLDQLYSVRNPVHGFVTGKSVKTNALAHLRNRFVLNIDLKDFFPSITENRINGVLESLGVDSGVSRIIARLCCHNAQLPQGAPTSPVLSNMICFRLDKELLAFAKSMRCIYTRYADDITFSSHQPMVALFEGSAQPSGAFALDLLSSTLRNIVNGNGFAINPEKAHYADRHSRRTVTGIKINEFLNVDRRYVRNIRAALHSVEQVGKKAAQEKFEKDHKGKCDLGAHLGGKLSWLRYIRGQSDPVFRAIAIRFNANFPDRKIDVTPTSHEVRDRAVWVVEYCEGEGENLKMLQGTCFFLKDVGLVTAAHCVEGVEEVEVYHPSKRSNVFTATVVKRDKDRDLAILEHSIPTTEYFEIERSAQAVAMGDELTAVGYPSFGPGDGLNVRDGKVSSLPVKSSLKLIEVTQKLSQGMSGGPLLNGDNTVVGVIHKGGPGEARDFAIHIEMLNAWLS

SEQ ID NO: 343 - protein, 542 aa, unidentified
  source 1..542: note = Related to CP019966.1; note = Rhodopseudomonas palustris
MRAWRDWKGDLVTLPLFNSSIRTSIPAELADETAFFLYLQMSPREMIKIWWFRRRMYHQFEIAKGKGKTRIIEAPDDRLKHLQRKLLPLLDQLYCVRHPVHGFVAGKSVKTNAQAHLRKRFVLNIDLKDFFPSITENRVAGVLEALNIDGRVSRLIARLCCHNGHLPQGAPTSPILSNMICFRLDKELLVFAKSMRCIYTRYADDITFSSHQPMAAMFEGAAAPLGRFNSDLLIQPFRNIIASNGFSLNADKAHYADRNSRRMVTGIKVNELLNVDRRYVRNIRAALYSVEKLGKKGAQDKFESEHGGTSKLAAHLAGKIAWLAHIRGQSDPVFRAIAVRFNKNFPEARIAVTPTSEEIRDRAVWVVEHEEAQGTAFFLKGVGLITAAHCVEGVKEAQLYHPSKRANEFTVRVVNRDKDRDLALLEHTIPSTEYFELDRSNQPVAVGQELTAVGYPSFGPGDRLNVRDGKVSSLTVQHGVRLIEVTQKLPQGMSGGPLLSSQCAVVGIIHKGGPDEGRDFAIHMDVLAAWLAEKPPGDGCTS

SEQ ID NO: 344 - protein, 525 aa, unidentified
  source 1..525: note = Related to NZ_WOAC01000030.1; note = Mesorhizobium sp.
MPPSFFGIPVVRVAIPPELASEAALLAYLGVSAKELKKIWWFRGRMYHQFEIAKGNGKSRIINAPDKRLKYLQRKIAALLYHLYRVRNPVHGFVAGKSVKTNALAHLRKRFVLNIDLKDFFPSITENRVTGVLESLGIDSRVASIIGRLCCHNSHLPQGAPTSPVLSNMICFRLDKELLAFAKASRCIYTRYADDITLSSHQPMTALFEAVPPSGHFAPDQLKPAFRNIIVTNGFAINHDKAHYADQHSRRTVTGLKINELLNVDRRYVRNIRAAIYSVENLGKKTAQKKFESSHGGTSDLGKHLEGKITWLRHIRGQSDPVFRSIAVRFNTSFPERKIEVTPTAAEVRDRAVWVVEHFEGDMAQGSAFFLKDVGLVTAAHCVAGVEEVEVYHPSKPSNAFKAKVLKRDEPRDLAILEHAIPPTEYFELEQSNHSVVVGEGLVAVGYPSFGPGDRLNVRDGKVSSLPVKHGVKLIEVTQKLSQGMSGGPLLDHNDAVAGIIHKGGPGEGRDFAILIEMLNDWLAE

SEQ ID NO: 345 - protein, 513 aa, unidentified
  source 1..513: note = Related to JAIOIW010000047.1; note = Notoacmeibacter sp.
MDNETALLKYLGVSADELKKIWWFRVRMYHQFEIAKGKDKTRTITAPDERLKYLQRQIAPLLDQLYRVRNPVHGFVDGKSVKTNALTHLRKRFVLNIDLKSFFPSITENRVIGLLEALGIDNCVASITARLCCYNSHLPQGAPTSPVLSNMICFRLDRELLAFAKGTRCIYTRYADDITFSSHQPMAALFEGSAPPSGHFSPDLLIPALRNTFASNGFTINPHKAHYADRHSRRMVTGLKVNELLNVDRRYVRNIRAALYSVETLGKAAAQTKFASNHGGTSDLGAYLQGKITWLRFIRGQSDPVFRAIAVRFNASFPDRKIEVTPTADEVRDRAVWVVEYCEGEGEKLKTLQGSGFFLKDVGLVTAAHCVEGVDEVEVHHPSKPANKFKATVVKRDKDRDLAILEHTIPATEYFQLNGATQAVAVGDELTAVGYPGFGPGDRVNVREGKVSSLATKHAVELIEVTQKLSQGMSGGPLLNSDNAVVGVIHKGGPDEGRDFAVRIEMLNTWLAE

SEQ ID NO: 346 - protein, 527 aa, unidentified
  source 1..527: note = Related to CP021181.1; note = Rhizorhabdus wittichii
MPNLPPPFGASIRLALPRELADENALLVYLGLSPKELRKIWWCRARMYQHFDIAKGRDKVRTISAPDKRLKYLQRKLAALLTQIYRPRHPVHGFVVGRSVKTNAVAHLQKRYILNIDVKDFFPSITENRVEGLLHSLGVDMRVAAIITRIVCNEGCLPQGAPTSPILSNMICFTLDRRLMALARDNRCIYTRYADDITFSSHQPLASLFEGASPSAGQITPDLLSPALRDTFVHNGFALNPDKAHYADRHSRRTVTGLKVNELLNVDRRFVRNLRAALHSVETLGIAAAQQVYQDRYGGSASLGAHLEGKIGWLRHIRGQSDPVFRALALRFNACFPDRELRLTPTVSEIRDRAVWLVENDETIEQGTAFFLAGAGLVTAAHCVEKATELTLYHPSKPANKFVATVLKCDAHRDLALLGHDIPPTEYFELERSTAAVLVGQELTAAGYPGFGPGDRLNVRLGTVTSLPIKRGVHMIEVSQKLGQGMSGGPVLDEMLGLVGVIHRGGPGEARDFAIHLDVLNCWLAEE

SEQ ID NO: 347 - protein, 477 aa, unidentified
  source 1..477: note = Related to QHJY01000004.1; note = Caulobacter sp.
MYQQFDIAKSGKKVRSISAPDKRLKHLQRQIAPLLDSLYRVRHPVHGFVANKSVKTNAQAHLRKRFILNLDLKDFFPSITEGRIGGLLQSIGIDSRVADIIARLCTNDGRLPQGAPTSPVLSNMICFRQDKQLMSFAKENRCIYTRYADDITFSSDQPMAALFESAVPSPGRFPPDLLVTRLRAIFMANGFEINADKTHYADRHSRRMVTGLKVNELINVDRRYVRNIRAALYSVRTLGAEEAQKKFETKLGGKSNIGSHLEGKIAWLRFIRGQSDPVVRAMALRFNAAFPDRKIDVVPTRDEVRDRAVWVVDNDTDISQGSAFFLKGVGLVTAAHCAKGAKEVEVYHPSKRSNKFKATVVKRDEQFDLAILNHEIPTTEYYELERSLTAVAVGDDLTAIGYPDFGPGDGLNVRGGKVSSLPVKNGVSMIEVTQKLSQGMSGGPLLDDNDAVVGVTHKGGPDEGRDFVVRIEMIDKL

SEQ ID NO: 348 - protein, 545 aa, unidentified
  source 1..545: note = Related to SACP01000011.1; note = Methylobacterium oryzihabitans
MPSSSAFGFPIVSVAIPCELKSEEKLLEYLAISTKELKFVWWYRERMYRKFELGSKKGKVRAIAAPNNRLKYIQRRIAVLLNQIYRVRNPVHGFVKEKSVKTNALSHLKKKYIVNIDLKDFFPSITENRVIGVLNSLGIERSVSQIIAKFCCCNGHLPQGAPTSPVISNMICFKMDKSLMSMAKEMRLIYTRYADDITFSGYRPMTVLFEGAAPFPGRFDPNQLASELRQIISGNGFVLNANKAHYADPNMRRMVTGLKINEIINVDRRYIRNIRSALYSVQTIGETAAQDKYQIKYGGRSSLGAHLEGKITWLRYIRGQSDPVFRAIAVRYNLCFPNRRKIEVIPTPEEVRDRAVWVVEHSEGDMAQGSAFFLKGVGLVTAAHCVEEATGLQQISLYHPSKPNNLFAATVVGIDKHRDIAILEHSIPLTEFFELESSFRVVQVGDNMTAVGFPGFAKGDRLNVREGKISSLPAKSGVRLVEVTQKLTQGMSGGPLLDSDNKVVGIIHRGGPGEGRDFATHIGVLNDWLRERPEGVSKKIEEVRG

SEQ ID NO: 349 - protein, 455 aa, unidentified
  source 1..455: note = Related to SMAR01000071.1; note = Martelella mediterranea
MPNFFGDFHTPRVKLPEEFSSKEAFHQYLGLSTAELKKIWWYRERMYKQFPLAKKNGKNRLISAPDKRLKFLQGRLLLLLNQIYRARNPVHGFVFDRSVKTNAEAHLRKRYVLNIDLKDYFLSITEKRIVGLLESLGIDTEVACIAARLCCLNSRLPQGAPTSPILSNMICFRLDKRLQKFSKENRFIYTRYADDITLSSQQPMTSMFKSGTIVSGSISPDDLNATFVDIISGNGFQINPQKVHYADRNSRRIVTGIKINELLNLDRRYVRNIRAALYSVNTLGQIEAQRKFEDVHGGDCDLSRHLRGKITWLGYVRGRSDPVFRSIARRFNGCYPDMKIETVPTAKEVRNRAVWVIEHFEGDWAQGTAFFLKGVGLVTAAHCVKGAEKIKIYHPEKRSNEFDVHVVKINEDLDLAVLHHSIPTTEFYEFDQTTKDVAVGDELIALGYPGNPPEK

SEQ ID NO: 350 - protein, 479 aa, unidentified
  source 1..479: note = Related to NZ_VWNA01000001.1; note = Segnochrobactrum spirostomi
MYHNFNIGHHGRKLRVINAPNDRLKYIQRRLLKVISGIYSVRDPVHAYVEGRSIKTNAASHLKSKYIVNLDLSDFFPSITEDRIVGLMNSLCITPRVSAIIGRLCCMGGYLPQGAPTSPMLSNMICFRMDRDFLSIAKRYRYIYTRYADDITISSRSPLTNLFASGAPPVGHFDANILSKDVISIIYTNGFNINSQKCHYADRHSRRMVTGLKVNEFVNLDRKFIRNIRSTLYSIEKFGIAKATDEFISKHAGKGTLHAHLRGEIEWHGHIRGRSDPVFRKNADRFNLLFKPKILVEPTYEEIRKFAVWIVDNNTACDQGTCFFVHDIGLITAAHCVEGATDIDVYNPLNPTQKYKANVQKIDKHLDLAILSHSIPTSQYRNIKISKVRASVGQSIIAAGYPDYGPGDSLSIRTGTVCSLSMKSGVGRVEVTQKLSSGMSGGPLIDRDNCVFGVIHKGGSTEEKDIAVEISELTKLVHA

SEQ ID NO: 351 - protein, 563 aa, unidentified
  source 1..563: note = Related to CP031750.1; note = Cereibacter sphaeroides
MNGGEHLVPSGSYIFGSGKPRIGIPDELTTLSKMLDYLGISDKELLKIRLSRSFMYSEFTIPSPKKARLISAPDARLKFLQGRLKSSFEKFYRPRLSTHGFVSGRSIITNAAIHARKRHVLSLDLKAFFPSITENRVRGLFRNLGFATDVCDAITTICCHAGYLPQGAPTSPIISNLICFSLDRDLHSFAKKQNLVFTRYADDISISTNGTPAGLFSATVPSPGKLDISALSVDLIDVVVKNGFFLNEEKIRFSSGSHRKIVTGLIVNEFPNVPRTYISNIRAILFSIMKDGYAVAEAKFRQKRPSAKRSLEQYLRGKLNHLANVRGKGDPIYRSLADKFNKEFLPSLATEPTPRERQSSGIWIIEWQYNDRKIDKLYGEAEANGQGIMSVTEGAQGTAFFLDGVGLVSAEHCAPPEEIDLEFFRVFHPSAPNLKFEVKVAKRCKVRDICILKHDVPENKFEGLKPCRVPARGGDVVRAFGFTDYQVGDAVTTSRGEVSHVATRSGVKLLNLSFKIGQGMSGGPIMDRMERVVGVVHKGGPLELRDYAVTLNAVLSLHEEASL

SEQ ID NO: 352 - protein, 535 aa, unidentified
  source 1..535: note = Related to VSSR01000016.1; note = Bradyrhizobium cytisi
MLCIGREGGGAPFTMPTLPKALGSANDFYAYLGVGAGERKFLEKHAFHRYKRVIVPKRRGGTRVLMVPDRRLKFLQRKAHQLLNQLYRPRTPVHGFVKQKGAISNANEHQRRPYLFNIDLRNFFGVISRRRVLGMLISMGLPDDAAEAVCSVCLTANQLPQGAPTSPILSNLVAYRLDRDLMKFAKTYRLKYTRYADDISFSSYAPPLALFNAGLPIPGRVKSDQLSVELSTVLATNGFEIAPDKVWFAGPKSRKEVTGLVVNEFTNLKRSFVRNVRAALYKTEKLGLAAAQSAYQKKYTTNATLEQVLRGRLEWIAQVRGRSFDPYRTLAKRFNNLFPNSPLPILPTHEETAERAVWVVEFFADEDNCAQGTAFFLAGVGLVTAHHVLEKLPPGAHADLYRPSGGGNKFKATPSKRSCPIRDLMILEHDVPTTDYLSLPVVTSPEQRDDKIVALGFPDYGPGDQLSRRGGQIYGRATKHGVKLLEVSAILSDGISGGPVVNDQHQVIGIAKKGGIEERKQLAVEVSELLKLADE

SEQ ID NO: 353 - protein, 484 aa, unidentified
  source 1..484: note = Related to JADPJU010000115.1; note = Bradyrhizobium sp.
MLSDTAYFTYLGVGAKERQFLEKHAFYRYSEATIPKRRGGTRTLLVPERRLKFLQRRTHLLLTQLYSPRAPVHGFVAHRGAITNANAHQSRPYLLNIDLRNYFGTITRRRVLGMLQSMGLDEAVALAVCSICMTRNQLPQGAPTSPVLSNLIAYSLDRDLMKFAKDYRFRYTRYADDISLSSYAPPVALFEQGVPPPGKMTVEQLSASLRSVITSNGFEIAPEKIWFAGPKSRKEVTGLVVNEFTNLKRTFVRDLRAALHKVETMGGAAAEKDFQARYKTTASLEKILRGRLEWIAQVRGRSFSAYRTLAKRFNQQFPASAVTILPTYAEIAEHAVWVIDFFNGTVCEQGTAFFLEGVGLVTADHVLQNLPVGVSAEIYRPSGGGKKFKATPSSRRCPYRDLAIVDHDIPTGGYLSRPVTSSPERRDDDIIAMGFPNYGPGDQLSKRRGHIIGSATKHGVKFIEVSAMLPGGISGGPILMIAIR

SEQ ID NO: 354 - protein, 526 aa, unidentified
  source 1..526: note = Related to NZ_JYMS01000026.1; note = Bradyrhizobium sp.
MPTVPAELKTANALFAHLGVGSAERKFLEHHAFYRYTEVAIPKRRKGERKLLVPERRLKFLQREMLKLLSQLYVPRDPVHGFVVGRGALTNASAHEKRPYLLNIDLKNFFGVIARRRVRGMLLSFHLEEEIAEAICDICTTRNQLPQGAPTSPMLSNMIAYRLDRDLINFSKTHRLRYTRYADDISLFSYTPPMGLFNAGLPNSGRVAEEQLSTGLRSVFSTNGFETAPEKIWYSGPDFRKEVTGLIVNEFPNVKRTFVRNLRSSLYKAETMGISAAEKDYQKRYGTTASLQQVLRGRLEWIAQVRGRSFGAYRTLAKRFNAIFPASPIAVLPTYDEVAEQAIWVIDFCEDVAGKPEPTCAQGTAFFIANIGLVTAHHVLADLPPGYSAVLHRPSLPGKKFKATPTKRQCPYRDLMILEHNVPATDYLSLSAATSPERRNAPIVALGFPSFNAGDELGTRSGLVVGNATRHGVKMLEVSALLLSGISGGPIVNDRAQVVAVAHKGGYEENKQLGVIVSELIALANE

SEQ ID NO: 355 - protein, 518 aa, unidentified
  source 1..518: note = Related to nan
MAALPPQLTSVAALHAYLGVGAGEARFLSRYAHHRYRAVNIPKRRGGFRNLLVPEDRLKFLQRKMLELLEPRYKPRPAAHGFVVGRSAITNANSHQARPYLLNLDLENYFGNITRNRVHGMLQAIGFAPEVARAICHICIVNNQLPQGAPTSPLLANMVSFRLDKDLTQFSKANRIRYTRYADDITFSSYVRPVALFSEPLQEAGALSVEGLSKELRLIISSNNFTINPVKTRYADRKSRKEVTGLIVNEFTNVRRTFIRDLRASLYKIDKLGLSAAQTSYNEKYGSDALLKDVLRGRLEWLAQVRSRSFYTYRTLAQRYNKHFPDNPAPIDPTNEEVAKSAIFVIEHFDGDGAQGTAFLLDGVGLVTAFHTLDGMVSEWADLYRPHEPTKKFRAKVGGKFCKHRDIALLEHDIPAEDQASLRPATGAEHVKSSIIALGYPEFASGDGLSERTGKIVGRSTKSAVRYVEVDAILGDGLSGGPIVNDRYEVIALTHKGGLLESKQLGVDIVEITKVAEA

SEQ ID NO: 356 - protein, 517 aa, unidentified
  source 1..517: note = Alcaligenaceae bacterium; note = Related to SDYD01000559.1
MPTLPPELMTVPALYAKLGIGGAEAKFLAHYVRHRYRASQIPKRRGGYRTLLAPDNRLKFHQRELLDLLTPLYRPKPAVHGFVAERSPITNANAHQGRPYLLNLDISNYFGVITRNRVRGVLIAVGMPAAVADAVCNLTVVDNQLPQGAPTSPLLANMVTFRLDRDLTSFAKTHRLRYTRYADDLTFSSYVRPTALFAEAEPAPGLIDIAELAPVLSGLITGNNFNLNPVKARYCVSKTRKQVTGLVVNEFTNIRRDFLRNVRSSLYRMETLGVADAEAEYQSKYDPKAKLHSVVRGRLEWIAQVRGRSFEPYRILAGRFNALYPAATPLPINPTNDELLAKAVFVIDYGKGKNMAQGTAFFLEGAGLVTAHHVLAKMQSGSATLYRADEPTKKYKARFSARVCSHRDLAILDHDVPVSEQTFLKQAAGIDRIKSTVTVVGYPEFGPGDSLVQMEGRIVGRNTKSAVRYVQVDMQVGDGLSGAPIINDRYEVVAVGHKGGPSESKQLGIDVAEVHGL

SEQ ID NO: 357 - protein, 567 aa, unidentified
  source 1..567: note = Related to JADCGG010000223.1; note = Roseomonas sp.
MTRRVNATFDRMLPQDVAVAFGGLPAIRRRRRLSFMRHIPQQLASESELLVHLGVGAEELAFLRRWTGFKYRTVKISKRSGGERTLLIPDDRLKFLQKKILGILLNLYRPRAPVHGFTKDRSALTNAKAHEGRRFLLNLDLKDYFASVSRNRVVGLLEKLGIDAAVADVIAAFCIFRDQLPQGAPTSPILANMVTFRMDRELMEFGQKHHLKYTRYADDLTFSSYRPPTLLFKDGLPKEGKITEKALSDEIRLIINSNGFDLNSDKIWFSATRSRKEVTGIIVNQFPNVKRSFIRELRVLLHKAETLGLPQTEKDYQSFSGKNAPLEQVLRGRLEWISQIRGRDFPCYQILATRFNALYAKKPLRLPPSQEDVLQKSIWVIEYHPKESEKRECLIDIQGTCFFLKQVGLVTAHHVVSELPKGTRFSVFRPTHSWQKYEAWSSEITCQYRDLAILHHNIPPHAFLELEAANSQAVDQTRIKALGFPNFGPGDTLARIPGEVIRTLTKSAVKQIEVTAALPSGISGGPIIDAAQLRVLAVAVKGGATEDRQVAVAISELQTLFKEHPGS

SEQ ID NO: 358 - protein, 526 aa, unidentified
  source 1..526: note = Related to JAIVAG010000015.1; note = Yangia pacifica
MPYNPFVVHRKPKVPEGLRTLPVFLSDLGVSESELRLISAKKVEQYHLVSVRKRSGGMRTLSVPNERLKYIQKHTASLLAPLYQPRWCVQGFVKGRSALQNAQRHLGRKHLVKVDLKDYFNQVTVSRAKGVLRYFELDAGVIDAILTFCTLFGKLPQGAPSSPLLANMVTFSLDQELVRYARTNRLKYTRYADDIVLSSFSKPRLLRPSVTADYCKLTIEDVQEDFAKIFSNQGFELNEEKMRYCGQRASRTVTGYTINEFANVPREHIRRIRSILNDIEKRGYPLAQRRFSETTHSIKSLKASLKGRLNWVSSTKGVSDPVYRRLALRFNGLFPDDCLEIGPDYSKLAQLSTWVIEAERKTNGVPEAQGTAFFLKGVGLVSAAHCLPGGCNYSVFNIDNPSKTYPATIAKTHNHIDLAILDHSIPAESYLALELSDRQANLGEEVFSWGYPEHGPGKRITQKSGRVSSKPRVSGVDMYAVDMKLYQGTSGGPILNSSSAVIGVTHKGGHGEAHDLAILIKHLKDL

SEQ ID NO: 359 - protein, 311 aa, unidentified
  source 1..311: note = Related to NZ_PHJF01000002.1; note = Epibacterium ulvae
MPTAISVAFGKTPTPPVEFSSMAALKTHLKISDKELLVIRKHRSKMYSHFIIPKKSGGVRFIDAPKPRLLYLQRRLLEVLVKMHKPRNPVHGFVRKRSAITNAEEHLNRKHVMNIDLKDFFPTITQDRVSSLLRILGIPSDVRAAILSICCANGRLPQGAPTSPVFSNMICLRMDRQLMGFCKTRRIKYSRYADDLTFSLYTAPHQLFSESVPSPGKLASSQISRELKSIILDNGFVLNEDKLRYFGPSSRKEVTGLIVSDFVNVPRKFVRNIRATIFDIEKNGFPAAQIKFSTLYRKTNPLSEHLRGKIV

SEQ ID NO: 360 - protein, 549 aa, unidentified
  source 1..549: note = Related to NZ_CP025996.1; note = Stenotrophomonas sp.
MDIGSLRCAYDYDKLGTLFGVPGAALKKNLYSSRGYTDFTIPKKSGGVRLISAPGRLRKQLQRKLLPVLDDVYKMGPAVHGFAKGRSVRTNALPHESKGLVINFDLKDFFPSISFQRIRGVFLGHPFRLDWTVANILAQMCSLDGVMPAGAPTSPVLSNIICAKLDKRLSALAARLGGTYTRYADDLTFSFDRPLAKLSSIAMIDEEGKPAVGASVSEIVTSEGFAINVEKFRIAAKGSRKAVTGLVVNERVNVKRSWYLKLESAIYAVEKFGLNPVAAKMFPQEEVPGVAPARLLRQLHGKISYLRMIRGKGDWLAAEMAHRFNTLHGNVRLRVPSVEMISNPNRQVRGVHIVVAYAAAVPVFDPTEEQGTAFTTPSGLLVTAAHVLEHEDTKTLLPFVYVMNERKLSLVACDVLAVDWDRDIAILRVRDDKNRVSAERSRYGLGQDPHQGETLISIGYPDYARGQHGSAFETPVTKLFKIKVPGGQEILKARVGGPIQGGMSGGPAIDSNFDVRGVILKGVANPGGVPEIIAISEVRRVAQANGLNL

SEQ ID NO: 361 - protein, 550 aa, unidentified
  source 1..550: note = Related to NQYP01000025.1; note = Xanthomonas sp.
MDIESLRCVHSYDSLGALFGVPGSTLKNNLYKSRGYTDFTIPKKSGGVRLISAPGRLRKKLQHKLLPVLYSAYKMGPNVHGFAKGRNVRTNALPHATRKVVINFDLKDFFSSISFQRIRGVFLGTPLRLDWSVANILAQICSLDGVMPAGAPTSPVLSNIICAKLDKRLSALAARLGGSYTRYADDLTFSFDRPLTQLRSVAILDDEGKPLVGASISEIVTSEGFSINMEKLRIATKGSRKTVTGLVVNEKVNVKRPWYFALESTIYAMEKFGVDEVAAQKFPEEKTPGVAPARLLRQIHGKVSYLSMVRGKGDWLASDIAHRFNKLHETLQLRVPSVELISQLVRRARGVHIVNASTDPLFVFDLGQSQGTAFTTSSGIMVTAAHVVERDDTKTILPFVYVMNERRLALVICDVIAIDWNRDIALLRVRNDKHRLDLERSRYRLGRDPNQGDNLVTVGYPDYTRGEHATAVNSPVTRVFKNKATSGAHDIRKARVDGPIQSGMSGGPALDSKFEVRGVVHKGVLNPGGVAEIIAISEVLRVAQANGLSV

SEQ ID NO: 362 - protein, 518 aa, unidentified
  source 1..518: note = Related to NZ_MQXX01000031.1; note = Stenotrophomonas maltophilia
MGIRALRFPRNPGGVRAISAPGRLRKTLQRQLLPVLYDAYKMGPNVHGFARGRSVRTNAQPHAARNVVINFDLKDFFPSISFQRIRGVFLANPMRLDWSVANILAQMCSLDGVMPAGAPTSPVLSNIICAKLDKRLSALAARLGGSYTRYADDLTFSFDRPLAQLRSIAMLDEEGKAVVGASISEIVKSEGFSINMDKFRISVKGSRKTVTGLVVNEKVNVKRSWYLKLESTIYAMDKFGIPAVAAQVFPDEKIPAVASAKLLRQIHGKVSYLSMIRGKGDWLAADIAHRFNGLHGEAQLRVPSVELISQAGRRARGVHIVNASTEELLVFDLAASQGTAFTIPSGLMVTAAHVVEKDDTKTVLPHVYIMNERRKALAACDVLAVDWDRDIAILRVNDEKHRLDLERSRYKLGLDPAQGDHLVTVGYPDYTLGERATAVNSPVSRIFKSKAATHGAPDVNKARVDGPIQGGMSGGPALDSKFEVRGVIHKGVLNPGGVAEIIAVSEVRRVALTHGLKV

SEQ ID NO: 363 - protein, 540 aa, unidentified
  source 1..540: note = Related to LR828257.1; note = Xanthomonas hortorum
MLTIKNLQGVHSYGALAPLFSVTPAALKAQLYSAKGYSSFNIPKKSGGFRLIHAPTKIRKQLQRALLPVLNEAYKAPSFVHGFVDKRSVRSNAQPHVQARTVVNVDLADFFQSISFKRIRGVFLAPPFRFDWTISNILAQICCYGGALPAGGVTSPTLSNMICARMDKKLVRLSRRLGGEYSRYADDLTFSFRRPLAQLSSIVAVDASGNYLPGAALLEIFNAEGFSLNPVKFRVATGAARKLVTGVVVNHRTNVPRKWLRALESKIYAITRFGVGAIAAQEFPDVAPESARYRLLRQLHGRISYLRMIRGAGDWVASDLAYRFNKAHGENQLRVPCTELISNPQRVPRGVWVLGCSASTMHFFDPQNQGTAFVTSSGLLVTAAHVLLLDSGDVAGYIYIINERAKKLRRCELLAIDVEADVAILKASEHNLEVERSRFSLGNDPQSQDSVVAVGYSDYGSGDTATMLQASVQKVFKFNSIKKAQVGAFISGGMSGGPVVDSACRVRGLVHKGVSSAAGVSEIICVEAIIRVAVSNSLSL

SEQ ID NO: 364 - protein, 534 aa, unidentified
  source 1..534: note = Proposed Aureobasidium melanogenum; note = Related to JAHFXB010000114.1
SAHTHESLAAALGLAPAGMLKALYKRKGYTVWLIPKKNGQHRTIASPSRLRRHIQIQLKAVLEQVYKPDASVHGFLQGHSIVTNAKPHVRRRTIINLDIKDCFGSISFFRVRGLLLKAPFNLPWVTANILAQATTFENALPPGGITSPILANIVMAGLDKRLSRMMIRYGGRYTRYADDLTFSFPAPPGRLGEFVEKSAVGNYQIAPKLSAVLKEEGFESNQLKFRCLTGASSKRVTGLKVSDKVNLPRRWIRELDCKIYAMEKFGVNAVAAADHPDSPVEAAKARLLRHIHGKIAFASMVRGRADFITAAMANRLNQLHERSDLYLSDIEIISRGDRASRAVWVVTAAPEGEDHYFAPEGNGTAFCIRGGLLVTAAHVIEDHEGKTKAPYPVVCVRRADQPGTYLGCNVIAFDRDRDLAVLQLLVPRPDLTRFQFALGKVPVTDESMTSIGFPNYVVGNRSATEVHVVQDVRPRYGVLRIRATGNIMGGASGGPLLNKKFEVAGITHKGLLMKWEANEFISVGELRTVLNEIK

SEQ ID NO: 365 - protein, 542 aa, unidentified
  source 1..542: note = Related to JACVCG010000003.1; note = Brevundimonas sp.
MVDITLVPPRQSLRDITTTRELAALMGVSYSREFAYILYRFPPTGRYRSFNIAKKSGGDRQINAPIRLLKKLQRRLVPLLAEIYDAPPCVRGFQGGQSILTNASDHVGQRYVLNLDLNDFFPSIHFKRVSGILQTRRYSLSRDVAVAIAQIACHGGQLPIGAPTSGILANMVCGPLDSSLLRLAKAHKLRYTRYADDITFSTSNSRHLNEATGIHVGDRFVIRGTEELSDSFHALFTQNGFSLNPNKAVLMSRRVRQSVTGLTVNRKTNVSKEFYRNLKSSINAIENYGYEAAQSVYIDRFRKPNESLQLRENLLGRLAFLGHVLNYSERYNKLARRTARLFEERSIPRPRDDREKAIYVLTNEQDLMMGTAFHTGGGKFLTAAHIFADRPGVLRCELACPPHYPEQITAVVSHIDRERDIALVRATGTFDLSRHSIPTDGKSVRIGDDVFACGFPQYEDGNSISTISTRITAERYISGNQRLEVDRPLSHGSSGGPVFSRDGFLVGQINTGPRIGEDYSPMSYTITPFRPHADLVATWLAA

SEQ ID NO: 366 - protein, 527 aa, unidentified
  source 1..527: note = Related to NZ_LR732816.1; note = Brevundimonas sp.
MRQLALLLNVDYGKTLSFALYRANQTSAYRAFSIPKRDGSERIITAPKRARKSLQQSLLPLLEQLYDPAPCVHGAVKGRSVKTNAAPHVARRYILNVDIDDFFPTIHFKRVVGILSSSRYGVHPTVATAVAQICCHQGRLPTGAPTSPILANMVCGKLDSALLRLAKKNKLRYTRYYDDITLSSSTSGHLTAATGIDLSSDHIAHGADRLSDEFKDIFTNNGFSINSKKVWGTTRKVRQQVTGLVVNKKHNVPIAFVRSTRAMIHSIEKMGIKSAQEKFLRSRKDNDSLDLESHISGRLAYIGYITDYGLRYTTLAKRFMAVSQGTKLPLPLLERERSVYVAVSKPGNEQATAFHVGHGFFVTAAHLVDPNKKPIFILVHSPDYYESPIATKIVHINYATDVALLKNVGAVAVNDRPAIKLTSRQSSRGDQVEAYGFENYIPGNKLGVVKTEISSVRQLDGQTRHSVSAPWPHGMSGGPVFDTQGVFLGIVFSGPLYGEKISPYGTAFTPSNLFAAELEQWLIDQAS

SEQ ID NO: 367 - protein, 569 aa, unidentified
  source 1..569: note = Related to JAIQXU010000019.1; note = Deinococcus sp.
MQTKDDLANALGISKSKLTYFAYAVSDKRKYVSFYVKKRSGGKRVIHAPNRGLKAIQRSLAILLSEIYQPSNPHCNHGFGRNRDIITNAQSHIGRRYLFKCDLKDFYPSINGARIFGVLTAAPFNFSDEVAHLIAMLSTKDGALPQGAPTSPVLSNIIIRKLDRKMMNFAKSSGGLYTRYADDITISYRTISMTRSAIDSDGNISDRLRHIIEHEDFTLNESKTRLLTKRNRQIVTGVVINEKLNVKRGYIRDLRNLIYILVRYGESDAVNAYNKHHLFDKSAKDIKRVIEGRIKFLERVRGREDAVVLKLIGMYQQHDKGFRTDKAPPYDDNKIETFKVRLLAEGKTDYKHLQIAFEFFAESNLYPSLDLNLEPHPDIEGIKHLEAHVKVLEKVTLEHLHIAIYDSDDKTINERYANGPKQLGSDLYGFTLPRPGHLPADQPFCIEMLYTPKDLTTPDENGRRIFLIDEFDRNTNHHKQDKRITTNNKSWDKLIIDDKVFRLDENHNIESINLSKAAFASFIEKRKTAGDPPDLHAFKAIFDMIDKIARTYYGKNTSELGEKIDIIKT

SEQ ID NO: 368 - protein, 555 aa, unidentified
  source 1..555: note = Related to LIYN02000006.1; note = Deinococcus sp.
MKTTKELAQHLGIELKTLMFYAFALPDTKKYYHFEIKKRNGDSRRIDAPIITIKNIQSSLSLLLQNEYEKSAPKSVYGFRPGRGIIKNASAHLNKRVTIKVDLKDYFNSITGGMIVETLTSRPFGMDKQVARVIAGLCTIGGRLPQGAPTSPVLANIITRTLDIKLISFAHKTRGTYTRYADDLTFSYSHENTARQCAIYSEDGIVLNAEIIKHIESKGFTVNSNKLRYKKSTSRQMVTGIITNNKIPGLPREYIRETKLLIHILLKYGEKEAAEAYRRKYAQNRYGHRNNLDISAIVRGRLEYIKSVKGVKSSAYCKLALRYKAFNPQYKFEEEEQAVFNPEEIIILCEGKTDYKHLSAALAHFQRNGQFNSLKLDLTDKERGGYDGLQKQIDALLKVKLRQKHIAIFDADVPSISKKYYDPNDLYKVHENLFVIITPRPDHVESGENFCIEMLYKDKDLKRVSSEGRRIFLSNEFDAKTSKHKKEPYYVQDRIKDKLIVESPVYRFTDEGESLNYCRSKDDFAKEIEACHMTQPIDFSGFLPLFKKIYEVHSS

SEQ ID NO: 369 - protein, 409 aa, unidentified
  source 1..409: note = Related to VXRZ01000402.1; note = Rhodothermaceae bacterium
MVFSPSRPAEGSNSFMSPCITVYHDGIGSESPRRFGKFYPKVVEAVARTLHVMPKVAPCLRPQWADIPNQRFSQTIKSLSSVQDLARFWDLPVKQLNYHAYHATDASEYHNFSITRRNGRKRKISAPNRSLKYIQRIIHETLSKLYWPDTTVHGFVSQRSTITNAKTHLARKYVLNADLKDFFQTITRPRIIARLKVAPYELQPPVAVLIGFLATDGDGQLPQGSPCSPVIANIMAASMDTQLKELCKKLRCTYTRYADDLTISTDCEPFPPEIARYPSAAGTVQVVLGDSFLDIIENNGFQINHMKSRLQNHWTRQICTGLVVNREKLSLPRSYKRRLRALIHNWKSLGWEKAAKRMHEKEYRPLFHNRDRFVHHVYGRINYMRMIYGVDYIGAKKLLSALEEIPKDQ

SEQ ID NO: 370 - protein, 355 aa, unidentified
  source 1..355: note = Related to NZ_AUGK01000007.1; note = Adlercreutzia mucosicola
MTTGSSSIFTPNIFSVNSCAKLASLLNTTESRLESLVDQAGNYRSFRIPKKDGTTRLIQAPQNELKKIQSQLSEMLLCAWEPSPFSYGFLHSRSIVSNAREHLGKRWVLNVDLKDFFPSITSQQIKKALVSAPCDMKPEVADLIARIACNNNTLPQGSPSSPILSDIVASPLDDSLASLAQSRDCTYSRYADDITISTSQNLFPVEIARPIGRQIVLGAPIKDPIIRHGFKINMRKVSLNSNSHHQEVTGVVVNEKTNVRRQYISQLRSILYNCLESGVYPQALRYIKRNRHKTPAAVIERMDDIAYIEHWFSMVLKGKVEYIRMVKGNDSPTFFMMADRYNSVFGSTFNIPPKS

SEQ ID NO: 371 - protein, 366 aa, unidentified
  source 1..366: note = Flavobacteriales bacterium; note = Related to DPRH01000152.1
MEEHLSTHLRTGQDVQTLTRFLNAMLLRRAEKDGWTPWRWQERQIDAMLTDPSWFYRSFTIPKKSGGLRHIDAPKRTLKLVQWALVPLFSEMFTPSSQVYGFVKGRGIVDNASVHLGQSAVLNVDIQGFFPSVSRARIEAILKDGPVLRLSEYMARSIARLCTLHGGLPQGSPASAVLTNLVTVRLDARLAGLAEQFGCRYSRYVDDITLSASSRAALDRALPKLEMILLSEGFALNTNKTRIQTLSMRREVTGLVLSGERIGVPAVNVPRPYRRQVRAMLHHWRKHGISEAAARNGFDGDHGVRPDLAFVRQLQGRIAHLRHVNPTPEVERFYTDLSDLLVSEGFRTSPDTDLECCADLESAKAI

SEQ ID NO: 372 - protein, 321 aa, unidentified
  source 1..321: note = Flavobacteriales bacterium; note = Related to DNBY01000055.1
MTPFEEVTQFINDGLSVLKEAAPKKHREVFEVSLDQVFGVFKNLDTSYIAFEIPKKSGEMRQIEAPNRKLKWMQKGLKAQLETLFEAEPGAHGFVPERSIQSNAGVHVGQRYVLNLDIAGFFPSVKRGRVQTVLQLEPIGLSKPAARILAQFCTRNRALPQGAPTSPTLTNLVCMRLDRKLEKLARHYRCRYSRYADDITISGPSKDLMYHLLKRITLILKTEGFEVQESKTRILPTSQRQEVTGLSVHAFVNSPRTYRRHLRATLHTWQSRGMETAMEALQITDKAQFIAVIRGRLQHAQHTNNTAEVQRMRATFHQLIA

SEQ ID NO: 373 - protein, 554 aa, unidentified
  source 1..554: note = Ectothiorhodospiraceae bacterium; note = Related to PABJ01000186.1
MSLNKCNTLSDLALHLGISTSRLRWLLYHKQSDLYDSFQIPKHNGVSRTIDAPCMSLKDVQNRILNSLATYYKPPRCAHGFIDSKSIITNAKLHVRKKLILRIDLEDYFPSIHIGRIQGLLKKGLGCNPTISWAISRLCTLDSVLPQGAPTSPLIANMITKRLDHQLASFASSYSCRYTRYADDITISTTKKAFPRRILKRSELSRLDIEDLADEMIAIITENGFHINESKLRLYHCNQRQTVTGLTVNQKVNLPRKREKQVRAMIHDWETNGLSNAAKKYISRYDYKKRPDNTSSGLLFKKVVLGRLSYIRMIKGPDDWIVQKYAHRLSLLDSEFFEQYESKWKVIVRAFQAIECIRLIEVEYSKNGVEYYSQGTGVYIKNIGLLTCYHVLDPDFTGTTSSNIDVSLVQEKLISGKLIYSKKELGAGVLLKADKDCDLALLKVDNDRPNSITLSSNDPILGESIITLGYPNYTPGRSAHVQNTSIGSQKMYMGKTHFTISDDIFKGMSGGPVLNSNYQLVGLMIVGNEITCTKYKRSESSFIVLSHIVEFLRK

SEQ ID NO: 374 - protein, 546 aa, unidentified
  source 1..546: note = Related to SZVX01000028.1; note = Dickeya sp.
MGWVVSLHDKLLILGLTNTIKGVKDPIPDLPRMEPEPYKAGKKLKWDNKKLENHSQASKEEIIDICEKIINKDIVITSANDVANILEVPVGQLLYILYHKKGNYRQFDIEKKGGGSRTISAPQGGMAILQEKLKPIIEYFYRPKKSAHGFIIGKSIYTNAANHTKKRYVVNIDLEGYFDSVTFARVYGIFKSKPFNFSHPAASVLAQLCTRDGILPQGACTSPALANLASTSLDKQLTQLARRKNITYTRYADDITFSFNQEQIKDIITLGDEDEFELSETVISIIERCGFKVNLRKFRVQEKNVCQKVTGLVVNEKVNIDRKYLRVTRSMIHKWREDKLKASLIFFAAKGLETINNEHAISIFRNHIYGRLSFIKMIRGDDFPLYLKLMAQMSHNDPRKTKEGLRAMRVTENYDVFICHASEDKDTIAIPIYDALVALNISAFIDHVEIKWGDSLIEKINSALVKSKYVMAILSASSVNKDWPRKELNSVLAREISEGKVKLLTLVKKEDEEIVASVLPLLQDKLYMSYENNPQDVAENIKSLLE

SEQ ID NO: 375 - protein, 535 aa, unidentified
  source 1..535: note = Related to CP055010.1; note = Klebsiella quasipneumoniae
MLRLATANKQATDQVPDLPKMEPEPYKTGGRIKWNNKKLKNNSQTPNEDIIKICQKIENKSIIITSANDIANVLEVPVGQLLYILYDKKDNYRQFEIEKKNGKSRIINAPQGGLAILQEKLKPIIEHFYRPKKPAHGFIKGKSIYTNALNHTKKKYVVNIDLEDYFGSVTFARVYGIFKSKPFNFSHPAASIAAQICTKEGKLPQGACTSPVLANLASAALDKQLTQLARRKNITYTRYADDITFSFNQRQVKEIITLDEENNFELGETIISVIEKNGFKINTQKFRVQKRNESQKVTGLVVNDKVNVERKYLRVTRSMIHKWREDKLKASLLFASKKGIKTNSNEHAISVFRNHIYGRLSFIRMIRGGDFPLYLKLMAEMSHNDPVKTKEGLRTMKVTETYDVFICHASEDKATIAIPIYDELNKLNISAFIDHVEIKWGDSLIEKINSALVKSKYVIAILSANSVDKEWPKKELNAVLAREIAEGDVKLLTLVKEEDEKIVAESLPLLRDKLYMAYTDNASEVAARVHALLDR

SEQ ID NO: 376 - protein, 535 aa, Enterobacter sp.
  source 1..535: note = Related to CP012871.1
MLSLSSANKEENETIPELPKLEPQPYQAGKNLKWGNKELKNHPITSKIDINVICKKIENKSIVITSANDVANLLEVPVGQLLFILYNKKDNYRTFEIKKKNGKSRIINAPQGGLSILQEKLKPVIEYFYRPKKPAHGFIKNKSILTNAEKHTKKKYVVNVDLENYFGSVTFARVYGIFKSKPFNFSHPAASILAQLCTKDGKLPQGACTSPILANLASASLDKHLTQLARRKNITYTRYADDITFSFNQQQVREIITLDNENNFELGEAVISVIEKSGFSINTSKFRVQKRNERQKVTGLVVNEKANVERKYLRVTRSLVHKWREDKLTSALLFVTKKGFKATNNEHAISIFRNHIYGRLSFIKMIRGDDFPLYLKLMAEMSHHDPLKTKEGLRAMRETETYDVFICHASEDKISIAIPIYEELTELNISTFIDHVEINWGDSLIQKINSALVKSKYVIAILSANSVDKHWPKKELHSVLAREIAEGEVKLLTLVKEADEAIVAASLPLLSDKLYITYKDNPAEVADKVRALLNK

SEQ ID NO: 377 - protein, 535 aa, unidentified
  source 1..535: note = Related to PDDV01000006.1; note = Edwardsiella tarda
MLNLTTTNKEAKGLAPQLPNVEPNPNTIGKSVTWENKKLKNYPIASESDIRTICSKIENGSISITSTTDVANLLEVPIGQLLYILYQKKDNYKSFKITKKNGGVRIIDAPCGSLSILQEKLKPIIEYFYRPKKSAHGFIKNKSILTNAEKHIKKKYVINIDLEDYFGSVTFARVYGIFKSKPFNFSHSAASILAQLCTKDGKLPQGACTSPVLANLASASLDKHLTQLAQKKQITYTRYADDITFSFKQKQVRDIIIKNKENDFELSKTIVDIVERNGFKINFNKFRVQKKSERQKVTGLVVNKKVNIERSYLRVTRSMIHKWRTNRSESASLFSIQKGYTSKNKDEEISIFRNHIYGRLSFIRMIRGNDFPAYLKLMAEMSHHDTVKTREGLRAMKETETYDVFICHASEDKESIATPIYNELVKLNIATFIDHIEIKWGDSLVDKINSSLVKSKYVIAILSTNSIRKHWPRKELHSVLSREINDNKVKLLPLIKKDDTGIVLSELPLLCDKLYVTYDNNPEEIANMIQSRLGK

SEQ ID NO: 378 - protein, 547 aa, Citrobacter sp.
  source 1..547: note = Related to LR134204.1; note = Citrobacter koseri
MSLHIKILLNNLTSTNHADLLPNLPQVEPQPNLSPSKTEWDNKKLSNRSLLTDDERNKILSGIENSKIIISSPTDVANLLEVPTGQLLYILYKRKNNYRSFIVKKKNGKNRIINSPYSGLAILQQRFKLILDYFYRPKKSAHGFIKDKSIISNAEKHIKKKYVVNLDLEDYFGTITFPRIYGIFKSRPFNFSHPAATVLAQLCTHEGKLPQGACTSPVLANLVSASLDKQLTQLAKRKNITYTRYADDITFSFKQNGINEVIKLSEDEKYEIGDQLISIIEKNGFKINQDKFRVQKRNNKQVVTGLTVNDKVNINKKYIRLTRSMIHKWSQDKTTAALMYTATHGIKTRDNDHAISIFRNHIYGRLSFIRMIRGKNFSTYLKLMSRMSHSDPKKTNEGRRAMSETETYDIFICHASEDKELIAIPLYKALCDKNIPTFIDHVEIAWGDSLIDKINNALAKAKYVVAILSENSVEKKWPKKELNSVLAREISNGKVKLLTLVKKEDEEAIADKIPLTHDKRYMVYDDNADFIADEVRKMLDNQASINQ

SEQ ID NO: 379 - protein, 534 aa, Escherichia coli
  source 1..534: note = Related to CP057087.1
MHNFALANKKSPDFISELPQIEPKPYSNGHKIKWINHTLTSTEVTPPDNLIKICILIESGEIAITSVSDIANLLGVPAGQLLYILYRKKDNYRTFEIEKKNGKKRVINAPCGGLSILQTRLKPVLEYFYRPKKSAHGFIKGKSIITNAGMHIKKKFVVNIDLENYFESISFARVYGIFKSKPFNFSHPAATVLAQLCTHNGKLPQGACTSPILANIASASLDKQLTQFAGRKKISYSRYADDITFSFNQRNIDIIKKNDDGSYSLSETIDNIISKNGFKINYDKFRVQTRNTRQSVTGLVVNDKVNINRRYIRITRSMIHRWTDDKLKYALLFATEKGYQAKDNNHAIQIFRNHIYGRLSFIKMVRGKDYPGYLKLMSYMSHNDPLKTQEGLRAMKETENFDVFICHASEDKKDIAIPIYDELTKLKISAFIDHVEIKWGDSLIEKINAALVKSKYVIAILSANSVNKEWPQKELRAVLASEISSGDVKLLTLLKKEDKEVVNLSLPLLSDKFYMVYDNNPEVVANNIKSLLQR

SEQ ID NO: 380 - protein, 543 aa, unidentified
  source 1..543: note = Related to NZ_CAKLOR010000001.1; note = Klebsiella variicola
MSLHDKLLMHNLALANKENADVISELPQVEPTPYKNGNKVKWRNKKLNNKAAIEPDSLMKICMLIESGKLLITSVSDVANLLEIPVGQLLYILYRKKDNYRTFEIEKKSGKKRIINAPVGGLSILQTKLKPVIEYFYRPKKSAHGFIKGKSIITNANMHIKKKYVVNVDLENYFESITFARVYGIFKSKPFNFGHPAATVLAQLCTHNGKLPQGACTSPILANLASTSLDKQLTQLAGRKKISYSRYADDITFSFNQEKVIDIIERSEDGSYIIGETIDNIISKNGFKINHEKFRVQTKNTRQSVTGLVVNEKVNIDRKFIRITRSMIHRWKEDKVKYALLFTTEKGYQTEDNNQAIEIFRNHIYGRLSFIKMVRGGDYPGYLKLMSYMSYNDPSKTKEGVRAMKETENFDVFICHASEDKEDIAMPIYEELSKMKISAFIDHVEIHWGDSLIEKINSALVKSKYVIAILSADSVNKEWPQKELRAVLASEISEGKTKLLTLVKKNDEEIVTKALPLLQDKLYMVYDNNPDMVAESIKKRLQS

SEQ ID NO: 381 - protein, 535 aa, Proteus sp.
  source 1..535: note = Related to CP063440.1; note = Proteus mirabilis
MYNLVSVNKKNQDIVPELPQVEPVPYKNGNKIKWRNKKLKNKTITNCENLIKICKLIESNEILITSSNDIANLLEIPIGQLLYILYHKKDNYRTFEIEKKSGKKRIINAPNGGVAILQGRLKPIIEYFYRPKKSAHGFIKGKSIITNASMHTKKKFVVNIDLENYFESITFARVYGIFKKKPFNFAHPAATILAQLCTHNGKLPQGACTSPILANLASTSLDKQLTQLASRKNISYSRYADDITFSFNQSNVFNIIVKNNKGNYEVSENIDSIISKNGFKINHEKFRIQTKNTRQSVTGLVVNEKVNIDRKYIRITRSMIHRWKVDKVKYALLFTIEKEYQTKDNNQAIEIFRNHIYGRLSFIKMVRGENYPGYLKLMSYMSHNDPLKTKEGLRAMKETENFDVFICHASEDKNDIAIPVFNQLDRINISAFIDHVQIKWGDSLVEKINSALVKSKYVIAILSANSVNKEWPQKELRAVLASEISDGNIKLLTLIKKDDEEIVKTALPLLRDKYYMVYNENPEVIADKIRELLHR

SEQ ID NO: 382 - protein, 535 aa, unidentified
  source 1..535: note = Related to CP082141.1; note = Erwinia persicina
MHSLTFANKENPDSIPEIPQVEPEPYKDGKNVKWRNKKLKNKSTIDHESLINLCKLIESGSIVITSASDIANLLEIPVGQLLYILYHKKDNYRTFEIEKKNGKKRIINAPNGGVSILQEKVKPIIEYFYRPKKSAHGFIKERSIITNAFMHTKKKFVVNIDIENYFDSITFARVYGIFKSKPFNFAHPAATVLAQLCTHNGKLPQGACTSPILANLASTSLDKQLTQLAGRKSISYSRYADDITFSFNQKKVPDIIEQNDDGSYEISEALEGIILRNGFRVNSDKFRVQTKNTRQSVTGLVVNDKVNVDRKYIRITRSMIHRWKYDKVKYSLLFTTEKGYKTKDNKQAMDIFRNHIYGRLSFIKMVRGKDYPGYLKLMSYMSHNDPLKTKEGLRAMKETENFDVFICHASEDKEDIATPVYDELTKINISAFIDHVEIKWGDSLIEKINSALVKSKYVIAILSASSVNKEWPQKELRAVLASEISDGDVKLLTLVKKDDEEIVKTALPLLRDKLYMVYEENPEVVADRVRTLLHR

SEQ ID NO: 383 - protein, 550 aa, unidentified
  source 1..550: note = Related to CP065673.1; note = Serratia plymuthica
MQLRKQIIAFNEKCRAEGLDEDRLIPLLKDTEPSSVKVGNTVIWNNSFKGNVFSLTEQEVSKVCAAISRGDVNIESVQDVANLLEVPVGNLIHLLYRSSSIKYKSFTIPKKNGGERIILSPQGGIKILQERARKYLDAFYRPKISAHGFILNKGIFTNAEKHVKKKYVLNIDLKDFFESITFPRIYGVLKKHPFNMGRPAAAVLAQLCVHNGKMPQGAPTSPVLSNIIASALDKTLVRLAGKYRMRYTRYADDITFSFNQSPPLDIAKKIEDTGGYELGDSLRHAIENNGFKINEEKFRLQLKTERQVVTGLTVNEKVNLDRKYIRLTRAMIDGWGKDKVQAANKYHKIRYGKCDKNDEFAVESFRNHIYGRLSFIRMIRGAEWPLYLKLSAWMSSNDDNPTIEGRRAMKAMEMFDVFLCHASEDKESIVMPIYDELCKLHIHAFVDTKYIEWGDSLTEKINGALARSKFVVAVLSSNSVEKRWPLKELHSVLAREIAEGDKKLLTLVKDGDEELIKAKLPLLADKLYAVYKGDPIEIAHGLSSLLTGKK

SEQ ID NO: 384 - protein, 543 aa, unidentified
  source 1..543: note = Related to CP065717.1; note = Serratia rubidaea
MAFNSKCKKEGLDEEQFLPLLNDNEPSSVKVGNSFLWDNRANRNAFSLTERDISKLCVAISKGDINITEVQDVANLLEVPVGNLIYLLYRTSSVKYKEFTIPKKNGDERKILSPQGGVKILQERAKKYFDAFYRPKISAHGFILNKGILTNAEKHVKKKYVLNVDLKDFFESITFPRIYGVLKKHPFNMGHPAATVLAQLCVHNGKMPQGAPTSPVLSNIIASALDKTLVRLAGKYRMRYTRYADDITFSFNQSPPSEIAKKIENTDGYELGDSLRHAIENNGFKINEDKFRLQSKTERQVVTGLTVNEKVNLERKYIRLTRAMIHGWGKDKVTAAKKYHKTRYGNFDKDDNYLVANFRDHIYGRLSFIRMIRGAEWPLYLKLSAWMASNDDNPTTEGRRAMRAMEMFDVFLCHASEDKNDIVIPIYDELCKLDVHAFVDNKYIRWGDSLTEKINSALARSKFVVAVLSRNSVEKEWPLKELNSVLAREIADGDKKLLTLLKEGDEELIQAKLPLLADKLYAVYTGDPIKVAQDLKALLSDGE

SEQ ID NO: 385 - protein, 550 aa, unidentified
  source 1..550: note = Related to HG427573.1; note = Xenorhabdus bovienii
MGLREKIASFNNELNYGVDYKDSLIPLLKNNEPLAIHMGNKVLWNNFFKKNEFSLTDIDVYKITTAISKKNIYIISPQDVAALLEVPVGNLLYLLYKSNSNKYREFTIPKKNGDKRTILSPQGGVKILQERAKKYLDAFYRPKASAHGFILNKSIFTNAEKHVKKKYVLNVDIKDFFESITFPRIYGVLKKHPFNMGNSAAAVFAQLCVHEGRLPQGAPTSPVVSNIIASSLDKTLVRLARKYKMSYTRYADDITFSFNQYPPVGIARKIDGTNDFELGDSLRNAIESNGFKINNSKFRLQSRAEKQVVTGLTVNEKVNINRDYIRTTRAMIDGWGKDRFQAAKKYHKIRYGKCDKSNQSAIISLRNHIYGRLSFIRMIRGAEWPLYLKLISRMANNDDSPTVEGKRAMKIMEMFDVFLCHASEDKDDIVEPLYEELVNLRVNAFLDTKYIKWGDSLIEKINGALAKSKFVIAVLSRNSVEKKWPLKELNSVLAREITGEDKKLLILVKDGDEELIKDKFPLLVDKLYLVYKNNPEIIAGELLSLLAGKQ

SEQ ID NO: 386 - protein, 546 aa, unidentified
  source 1..546: note = Related to QRAU01000016.1; note = Serratia fonticola
MLLKQQIIAANFIRGESGKAFLPTLLYVEPKSIKTGSKYKWMNPRSIRAYSLSENDIHSLLSAVLTGEIEIKTANHVAEILEIPVGQLIYILYKKTTENYVEFEVKKKMGGVRKIYSPQGSVKIIQNRVKKILDFFYRPKAAAHGFIKEKSIKTNAKKHIGKKYVLNIDLSNFFESITFARIYGVFKARPFNFGHDAASILAHACTYNGVLPQGAPTSPTLSNIVAASLDKKLVTLARRFKIQYTRYADDITFSFNQKPPEDLVKVLDGEGLCEVGDLLNEVIESCGFKVNSKKTRLQSKTQRQEVTGLVVNNKVNVNRDYIRITRSMIHGWCKDRAFSARKHFNITDECSVEKEKNIIESFRNHIYGRLSFIRMIRGVDFPCYLKLMAYMSHNDPKQTKEGKRAMKETETYDIFICHASEDKDEIAVPVYDELNNLSIVTFIDHLSIKWGDSLVDKINNALAKSKYVIAILSKNSVEKNWPIRELNSVLAREIKGGKVKLLTLIKASDEEYVQDKLPLLADKLYMVYNGNPAEVASRVRDLLGHP

SEQ ID NO: 387 - protein, 544 aa, unidentified
  source 1..544: note = Related to NZ_CABHYS010000030.1; note = Yersinia mollaretii
MLLKQQIITENFIRDENGKSLLPAPSYVEPKSIKSGNKYRWINPKSIRKYSLSESEIHSLLSAILTGELKINTVNHVAEILEIPVGHLIYILYKKISSNYVEFEIPKKMGGVRKIKAPHGSIKIIQGRVKTILDFFYRPKTAAHGFIKGKSIKSNAKKHIGKKYVLNIDLSNFFETITFARVYGVFKSRPFNFGHDAASVLAQACTYNGVLPQGAPTSPALSNIIAASLDKKLVTLARKFKIQYTRYADDITFSFNQKPPEDLVKVIDGGALCEIGDLLNEIIESCGFKVNLKKLRLQSRTQRQEVTGLIVNNKVNVSRDYIRITRAMIHGWCRDSTLAARKHFNITDGQGEDKSLVNSFRNHIYGRLSFIKMIRGAEFPCYLKLMAYMSHNDPKQTKEGKRAMQETETYDVFICHASEDKTEIAIPVYEELSKLGIVTFIDHLSIKWGDSLVEKINNALVKSKFVIAILSENSVEKKWPIKELNSVLSREVKGGKVKLLTLIRDSDEEYVQEKLPLLSDKLYMVYKGNPVDIASKVEDLLRNS

SEQ ID NO: 388 - protein, 528 aa, unidentified
  source 1..528: note = Related to LKDX01000002.1; note = Pseudoalteromonas sp.
MLTFNKLQFRLQATEPTRLYNNYWVKWLNPSLSPTLSRNIETSRELILGLQSSNDVANLLEIPVGQLLYILYTLEPKYKSFTVTKKSGKKRLIDSPNESIKILQDKVRPLIEAHYRVKKPVHGFVGGGKGIVTNAMQHKKKNYVLNIDLSDFFHSVNFGRVQGIFRNAPFNMGSAAATVLAQLCTHNKCLPQGASTSPVLSNLAASTLDRKLVQLAKKFHLTYTRYADDITFSSNKPFSGKIVENRKEESGLETHRVGKLLEQIITDSGFQVNHTKTRLQYKSQRQEVTGLVVNEGVNVNRKFIRKTRAMIHEWSNDLISAEARFIMQRYNVSDSEVGNDRDGSIFKRAVYGNLSFIKMVKGEEHSPYLNLCRKVLELDNEPPSFISKLKDVLDMYDVFICHARENKNEVAIPLYEALKSKGINTFIDSSAINWGDSLVSKINTALQKAKYVIAIISDDSLNKSWPMHELRSVLSTEIRSGEIKLLPLMVGDADALISQIPLLADKRFIHFEDNIDDVVEEIQKLLKD

SEQ ID NO: 389 - protein, 330 aa, unidentified
  source 1..330: note = Related to NZ_BLPI01000001.1; note = Agarivorans litoreus
MSNLAATSLDKKLVQIAKKFHLTYTRYADDLTFSSNKPFPSILVERKTQDNGQDKHRVGKLLEQVIKDAGFEISHDKTRLQHKSQRQEVTGLVVNEGVNVNRKFVRKTRAMINEWGKDLRAAEIRFIKHRYHVTDSEINMENLDGSIYKRAIYGNLSFIKMVKGEEHSPYLNLCKKVLELESNPPEFIKKLKGVFDMYDIFICHASENKSDVALPLHAALAERGINAFVDCFEIKWGDSLVAKINTALQKSKYVIAVISEESVKKSWPMKELNAVLSSEIGSEQTKLLPLMVGDDESLLKQLPLLGDKLFVNFDDNIEEIAGKVDSLLRG

SEQ ID NO: 390 - protein, 531 aa, Vibrio sp.
  source 1..531: note = Related to CP009984.1; note = Vibrio vulnificus
MSTPLGSLLFNLESFEPEKIPNKKTYSWKNPKLSPTLTRDLEVAKTHFVGLQTDNDVANILEIPVGQLLHILYYQKQNYNSFTIKKKSGKTRLIDSPKASIKILQDKVKPLIEAHYRVKKPVHGFVGDGKGIITNAFQHRKKNYVLNIDLQDFFHSVNFGRVQGIFRNTPFNMGIPAATVLAQLCTHNGRLPQGASTSPVISNLASTSLDKKLVQIAKKFHLTYTRYADDLTFSSNKPFPTILVEREIDENGKEIHKVGRLLEQAIKDSGFEVSHHKTRLQHKSQRQEVTGLVVNEGVNVNRKFIRKTRAMINDWSKGLAQAEIRFLKQRYHLTDSEIKTDGLDGSIFKRAVYGHLSFIRMVKGEEHSPYLKLCEQVLALDSKPPEFIRKLKGVFDMYDVFICHASEDKAEVALPLYDALAKREIKAFIDCFAIDWGDSLVSKINTALKKSKYVIAVVSDESVKKSWPMKELNTVLAAEISSEETKLLPLMVGDGEELLKEIPLLGDKLFVNFNDNIDEIADKVEKLLQRS

SEQ ID NO: 391 - protein, 436 aa, Aeromonas salmonicida
  source 1..436: note = Related to NZ_CP051883.1
MQEKIKPLIEAHYRVKKPVHGFVGGGKGIVSNAEQHKKKDYVLNIDLQDFFHSINFGRVQGIFKNTPFNMATPAASVLAQLCTHNGRLPQGACTSPVISNLAATSLDKKLVQIAKKFHLTYTRYADDLTFSSNKPLPSILVEKIAEDNGQYKYKVGRIIEQAIIDSGFNINHNKTRLQHKSQRQEVTGLVVNEGVNIDRRFIRKTRAMINEWRKNLLEAEIRFIKKRYNLSDSEIKNRKLNGSIYKRAIYGNLSFIKMIKGEEHSPYLTLCKQVLELDNNPPYFVRKLKGIFDMYDIFICHASEDKDKVAIPLYDELIKRDINTFIDCFAIKWGDSLVSKINTALKKSKFVIAVISDSSVKKSWPMKELHAVLSSEIGSEETKLLPLMVGDGEALLKELPLLADKLFVAFDNNIEEIADKVETLLKKYNLYDISQR

SEQ ID NO: 392 - protein, 531 aa, unidentified
  source 1..531: note = Related to NZ_CP033065.1; note = Pseudoalteromonas agarivorans
MTKLMDFLSFHSNAFEPTKSSKNAGYTWINPSLTPHLTRELDFVQRQFLGLQSDNDVANILEIPVGQLLYILYSQKDTYVNFTVKKKSGENRNIESPCSSIKILQDKVRPLIEAHYRVKKPVHGFVGNGKGIISNAEQHKKKTYVLNIDLKDFFHSVNFGRVQGIFKNIPFNMGTPAATVLAQLCTHKRRLPQGASTSPVLSNLASTTLDKKLTKIAKKFYLTYTRYADDITFSSNEPFSQALLEKDKLDDGQYIYRVGNVLEAAVISSGFSINHKKTRLQHKSQRQEVTGLVVNKGVNINRKFIRKTRAMINEWDKNLIEAEKRFIKVRYHAQETEIDMSKLDGSIYKRAVYGNLSFIRMVRGEDHSPYLTLCKKVLELDHNPPAFINKLKGIFEMYDVFICHASEDKESVALPLYESLEKRNINAFIDCFAINWGDSLVAKINTALQKSKYVIAIISEDSVKKSWPMKELNAVLSAEIAADKTRLLPLMVGDGEALVRQLPLLADKLFVGYKDNIEEITDMIESLLTEK

SEQ ID NO: 393 - protein, 529 aa, Vibrio sp.
  source 1..529: note = Related to VFNK01000001.1; note = Vibrio crassostreae
MATTFSSLSFYLVSFEPKKVPYKKSIVWKNPNLSSTLTRDANVAKEKFIGLKTDNDVANILEVPVGQLLHILYSQKQNYDSFVIKKKSGKSRIIESPKTSVRILQNKVRPLIEAHYRVKKPVHGFVGGGKSIVSNAEQHKKKNYVLNIDLVDFFHSVNFGRVQGIFRNTPFNMGIPAATVLAQLCTHNGRLPQGASTSPVLSNLASTTLDKKLVQIAKKFHLKYTRYADDLTFSSNKPFSSILVDKEIQEDGQYKYKAGRVIEQAIKESGFSINHNKTRLQHKSQRQEVTGLVVNDGVNINRKFIRKTRAMINGWRQDLLEAERRFIKIRYHAAESDIDASKLDGSIFKRAVYGNLSFIKMVKGEEHSPYLTLCKQVLALDNNPPEFVKKLKGVFDMYDIFICHASEDKAEVAIPLYNSLKERDINTFIDCYGLMWGDSLVAKINTALQKSKYVIAIISEDSVKKTWPMKELNAVLSAEIGSEETKLLPLMVGDGEALLEQLPLLRDKLFVSYDDNIEEIVGKVEALLI

SEQ ID NO: 394 - protein, 527 aa, unidentified
  source 1..527: note = Related to NZ_PNCO02000001.1; note = Pseudoalteromonas galatheae
MNQANFVFRDFEPKKFSYSGNQYWVNPSLSHELAGDIDNAIQQFIGLKTSADLASILEVPVGQLLHILYAQNNQYTSFEVKKKSGKSRLIESPRNSIRILQNKVRPLIEAHYRVKKPVHGFVGGGKGIVSNAEQHKKKNYLLNIDLQDFFHSVNFGRVQGIFRNTPFNMGKSAATVLAQLCTYNQRLPQGASTSPVLSNLAAASLDKKLVKIAKRHHLTYTRYADDITFSSNKPFSTMLVDREILEDGTYKYRAGKLIDQAVEDSGFKINHSKTRVQHKSQRQEVTGLVVNDGVNVNRKFIRKTRAMINEWRKDILAAEIRFIKERYHADEAEIDVSKLDGSILKRAVYGHLSFIRMVKGEEHSPYLTLCKQVLELDGNPPDFVKKLKGIFNMYDVFICHASEDKEAVATPLYESLTKLGINTFIDSEAIKWGDSLVSKINTALKKSKYVVAVISEESINKSWPMKEINAVLSLEIGEENTKLLPLMVGDGDALLKQLPLLGDKLFESFNNNAEEIARKLAERLQKS

SEQ ID NO: 395 - protein, 490 aa, unidentified
  source 1..490: note = Related to NZ_JXXX01000040.1; note = Pseudoalteromonas piscicida
MTQTNFFFGDFEPKKYSYRGNQYWVNPSLSHELTGDLDNAIQQFIGLKTSADLASVLEIPVGQLLHILYAQNNQYTSFEVKKKSGKCRLIESPRNSIRILQNKVRPLIEAHYRVKKPVHGFVGGGKGIVSNAEQHKKKNYLLNIDLQDFFHSVNFGRVQGIFRNTPFNMGKSAATVLAQLCTYNQRLPQGASTSPVLSNLAAASLDKKLVKIAKRHHLTYTRYADDITFSSNKPFSTMLVDREILEDGTYKYRAGKLIDQAVEDSGFKINHSKTRVQHKSQRQEVTGLVVNDGVNVNRKFIRKTRAMINEWRKDILAAEIRFIKERYHVDEAEIDVLKLDGNPPDFIKKLKGIFNMYDVFICHASEDKEAVATPLYESLTKLGINTFIDSEAIKWGDSLVSKINTALKKSKYVVAVISEESINKSWPMKEINAVLSLEIGEENTKLLPLMVGDGDALLKQLPLLGDKLFESFNNNAEEIALKLAERLQKN

SEQ ID NO: 396 - protein, 492 aa, Aeromonas sp.
  source 1..492: note = Related to NZ_CP023141.1; note = Aeromonas dhakensis
MNTDTSSDISVTTSFEPKRIIAYNGHQWINPKLSPTILSDQLKAAEKIIGLKEASDVANILEIPVGQLLYILYQQNKKYTSFTIKKKSGKERLIEKPNNSLQILQSKIKPLIEAHYRVKKPVHGFVSGGKGIVSNAEQHKKKNFILNIDLLDFFHSVNFGRVQGIFRNIPFNMDVPAATILAQLCTYNGRLPQGASTSPIISNLAAATLDKKLVQIAKRFHLTYTRYADDITFSSNREFPAVIVQRDVNTQDKLKYIVGPLLERAITDSGFHVNHNKTRVQHKCQRQEVTGLVVNNGVNINRQLIRNTRAMINEWRKDLQSAEIRFIKHRYHVNENDIEINKLDGSIYKRAIYGKLSFIKMVRGEDHSPYLKLCKQVLELDSNPPPFIKKLKGVFDMYDVFICHACEDKNRVAIPLYHALEKKGIKTFIDCFAIGWGDSLVGKINTALQKSKFVISIISEASIDKSWPMKEIHTVLSMEIRNTKTKLLPLIV

SEQ ID NO: 397 - protein, 525 aa, Vibrio parahaemolyticus
  source 1..525: note = Related to CP040101.1
MQQPLEFSEFEPIKFGNGDETIWGNPTLSPRLTRDHKVAETLLLNLESDNDVANLLEIPTGQLLYILYEKPKRYTIFSIKKKSGKPRLIESPNSSIRILQNKLRPLLEAQYKIKKPVHGFVGNGKSIISNAEQHKKKNYLLNIDLLDFFHSVNFGRVQGIFRNTPFNMGYKAATVLAHLCTHNKRLPQGAPTSPVLSNLASTTLDKKLVQLAKRFQLTYTRYADDITFSSNRPFPPLLVETIHLEDGTSHHRVGKALKQAVEDSGFAVNPNKTRVQHRSQRQEVTGLIVNEGVNVNRKFIRNTRAMLHSWRKDLIEAELTYLKNRYHAVDVNKSNLTGDIFKRAIYGRLSFIKMVKGQEHGPYLNLCRQALELDNNPPKSIAKLKGVFEMFDVFICHASEDKEAIALPLYDELNTLGVKTFIDKVEIQWGDSIVGKINSALQKSKFVVAIISESSIGKAWPLKELHAVLGMEIGSGDTKLLPLIVGNEEELLMQLPLIKDKAYLPYTNNCSEIAKILKDKLDTSN

SEQ ID NO: 398 - protein, 523 aa, unidentified
  source 1..523: note = Related to JACXAF010000008.1; note = Neiella sp.
MQLTLEFLDISEFEPKRIEASWSNPRLSPTLKRERDAVAQRLIGIQTDNELANLLEIPVGQLLHILYEEKKRYHEFYIKKKSGQLRVIESPNKSLKILQHKVKPLIEYHYRVKKSCHGFVGNGKGIVSNAEKHKKKQYVLNIDLKDFFHSVHFGRVRGIFMNVPFNMGNSAASVLAQLCTNHSRLPQGAPTSPVLSNLAASSLDTALTKIAKRYHLTYTRYADDITFSSNRKFPLAIVDRFETDLGKVEWRVGSLLRQSIEESGFTVNDSKTRVQHRSQRQEVTGLVVNDGVNVSRKFIRNTRAMLNSWSKDLVEAERRFLMTRYHMSESEIDSKKLDGRYFKNAIYGRLSFIKMIRGEDNSSYLTLCKKILELEPSPPKSIAKLKERFEMYDVFVCHASEDKDDVAIPLHRALEDKGIKAFIDCFEIKWGDSLVAKINTALQKSKYVVAIISQHSVNKAWPMKELNAVLSSEIDSKQTKLLPLIVGDQNALIEELPLLADKLFKVFDDDIDQIASELEMRLK

SEQ ID NO: 399 - protein, 521 aa, Aeromonas sp.
  source 1..521: note = Related to NZ_LKJS01000005.1; note = Aeromonas veronii
MMTLFRDDFQPRKTRNQFGESSWLNPKLNPYLTAGQEEVNQKLKNLNDVSDVANLLELPTGQLTYILYNKKPAYKTFGIKKKSGKVRIIDSPNNSILILQNKIKPVIESYYRVKKPVHGFVSGRSIISNAEQHKKSKYILNLDLKDFFHAVNFGRVKGIFKSTPFNFGDKAATVLAQLCTYQGRLPQGAPTSPLLSNLAATSLDRELVHLAKRFHMTYTRYADDITFSSNKKFDEQIVTFLIEKECFEVGVLLRKKIEESGFEISESKTRVSHRSQRQEVTGLTVNDKVNVPRKYIRETRAMLHSWGLGLLEAERKYLSLKKGWTSEKLNSTKLDGSYFKRAIYGRLGFIKSIQGEDSSPYLSLCKKAITLDSNPPKFIQVAKEKLDMYDVFICHASEDKEAIVFPLEKALVAKGVKVFVDSSVIKWGDSLVDKINHGLRVSKFVIAVLSPASVNKAWPKKEINAIMSMEIKAEKKKLLPLLAGSDDLINEFPLMSDKLYKKFDNNVDEIVDGLCEMLQET

SEQ ID NO: 400 - protein, 468 aa, unidentified
  source 1..468: note = Related to NZ_PVBM01000010.1; note = Neorhizobium huautlense
MKDIDDLARVLEVPKGNLVYIAYTRGLSAQYKTFEIRKKSGGTRIIHMPKGGLRVLQQKLKKIFDFLDRKPKCSHAYHKGKSFLTNAVEHKKKRFVFNMDLEEFFPSIHFGRVQGVLRAAYKMPPSVATFIAHLCCYNGSIPQGAPTSPSISNLVSNNLDKKILALAIKHHVSYTRYADDITFSYRYRNFPPAIGHFAATGQLFGPAAVGATLEQLIKDQGFQVNHKKTRLQYNHYQQSVTGVIVNQFPNVRRRKVLEVRKLIYLWRTFGLEKAETFRFEKAEGGDYFRAVLFGNLAYLKGVRGENDKIVRSFCRDILRITTKVPNWVRVAAEEFQVKDVFLSHASEDKVAVAKPLFDACQAVGISVFYDAEDIKWGDSVIEKINHGLGEAKIIVPVISETFLEKKWPVRELNVALSRFMKDKARILPIIYNIDHLDDYPLLSDFHYKKWEDNPAELVALLKERLNSI

SEQ ID NO: 401 - protein, 502 aa, unidentified
  source 1..502: note = Related to NZ_VISO01000003.1; note = Rhizobium mongolense
MNVFISSLEDPIVSLRFAHSVQDVASVLGLDPARFFYVVQNADNGSYYKQFQIPKKKGGKRDISKPVRGLALAQDRLAAILAQKYSPKQYVKGYVKGESFLTNAQYHERQRWILNIDIKDFFPSINFARVRGLFMSSYFGFNDRVATILARITTFNDGLPQGATTSPIIANLIAHNLDKKLLSIAISERLRYSRYADDITFSSNQKTVPASVIRSWEPLHGERSVELGNAIREAFRSARFEVNEEKTRILFSSERQEVTGLIVNRKANVWRGDVALLRMKLHSARVHGAQNAAKLWLKTTDNPDHFWRHIEGWLAYISQVRGRDDPVTAKLCKMAVLSGLKGAEWIEKYADMVREFDVFLSHATEDKPTVVKLKRKLESLGIKVFFDVDSIQWGDSIVEKINHGLLKSSFFVPFLSDTFSAKGWTNKELNSAIAMNINRKGRILPICEANFSIADNYPLLNETLYQRWPEDPALEAAFVTSVADQILKIVQQEKSKPNDLSD

SEQ ID NO: 402 - protein, 510 aa, unidentified
  source 1..510: note = Related to NZ_JABFCN010000062.1; note = Rhizobium sophorae
MVKSEGQALETRETPINNALLQLRMAHSVTDVAFSLGLEPSKFFYVVQNADNGRYYKEFQIPKKKGGMRHIAKPVRGLALAQDRLAAILRDKYEPKPFVKGYVKGQSFLTNARYHERQKWVLNIDIKDFFPSIGFARVRGLFMSSYFGFNDRVATILARITTFKDGLPQGATTSPVIANIVAHNLDKKLLAIAVKERLRYSRYADDITFSSSQKAVPPSVVRGWEPMHGPRTVDLGGAVLEAFRSARFEINDEKTRILLASERQEVTGLIVNRGANVWRRDISLLRMKLHSARVHGPEKAAKLWLKTTESPVHFWQHIEGWLSYISQVRGGDDPVTAKLCKMAVLSGFKGTTWIEAYAEMVREFDVFLSHASEDKPKVRILKNKLEYYGIKVFFDADSIEWGDTIVEKINHGLLKSSYFVPFLSKTFSSKGWTNKELNSAIAMNVNRRGRILPICDGDFSIEENYPLLNETLYKTWPSDPTEEDQFVTSVADEILKRVQDKQSQQNDLSG

SEQ ID NO: 403 - protein, 501 aa, unidentified
  source 1..501: note = Related to JAAXST010000004.1; note = Rhizobium laguerreae
MTITLGLDDPLLLLRLAHSIQDVAFALGLEPAKFFYVVKNSDNGRYYKQFQIPKKKGGMRDIAKPVRGLALAQDKFAAILAQKYEPKQFVKGYVKGQSFLTNAQYHERQKWILNIDIKDFFPSISFARVRGLFMSSYFGFNDRVATILARITTFNDGLPQGASTSPIIANIIAHNLDKKLVEIAIRERLRYTRYADDITFSSSQKAVPSSVVKSWEPLNGARTIALGNDVIDAFRSARFEINDEKTRILFPSERQEVTGLIVNRKANVWRRDISLLRMKLHSARVHGPSKAAKLWLKTTENPVHFWQHVEGWLSYVGQIRGPNDAVVAKLCKMAVLSGLKGSEWVERYADMVREFDVFLSHASEDKPKIRKLKDKLESYGLKVFFDETSISWGDSIVEKINHGLLKSSFFVPFLSETFSTKGWTNKELNSAISLNINRKGRILPICDGNFSVENNYPLLNETLYKKWPTDAAQEEEFLVSVSDAILKKVQDAQATSNDLSG

SEQ ID NO: 404 - protein, 505 aa, unidentified
  source 1..505: note = Related to JAHBRY010000004.1; note = Chelatococcus asaccharovorans
MSDPQAKVDLIDLTADPMFRLLTAHSVVDVAHALHLDPARFFYVVQHAQDGTYYKSFSIAKKKGGVRHISAPKKGLRLAQARLAAVLLKAYKPKPFVHGYVKGQSFLTNAKLHQRQRWVLNLDIKDFYPSITFPRVRGLFMSSAFGFNDRVATILARITTTSNGLPQGARTSPVIANMIAYTLDRKLIELATRHRLTYTRYADDVTLSSSRKEVPADVVKSWSPPFGERQLDLGGVLSAAFQTAGFQINDAKTRLSFQYERQEVTGVVVNQKANVWRKDISRMRMILHSARKHGAAQAATVWVGKDANADRFWRFVAGWLSFFAQVRGRDDPVVAKLCKLAVFAGLKGIEWIEKGADMVREFDVFLSHASEDKERVRKLNDRLVDLGVTVFFDESSIGWGDSIVEKINHGLLKSSFFVPFLSDSFARKGWTNKELNSAIAMNINRKGRILPIKDIGFSLEDNYPLLNETLYRTWPAGGEDEAACSLADEILLKVQTAHEIRSDLG

SEQ ID NO: 405 - protein, 481 aa, unidentified
  source 1..481: note = Bdellovibrionales bacterium; note = Related to JAGRAU010000490.1
MQDVAFALNLDPAKFFYVVQHADDGSYYREFVIPKKRGGVRSISAPQKGLALAQTRFYELLLEKYKPKPFVKGYVKGESFLTNAKYHEKQKWILNIDIKDFYPSITFARVYGLFLSPYFGFNRRVSAILARITTYRNELPQGARTSPIIANIIASNLDKKLVSLAADLKLKYSRYADDITFSSSQRRIPAGLVKGWEPSFGDREIKLGAALLEAFNGAGFRVNDAKTRLLFSYERQEVTGLVVNQQANVWRKDISRLRMIIHSARKHGPREAASIWVGKNASEEEFWQFLCGWLAYVAQVRGQSDPVVAKLCKLAVIAGLKGPKWIDRSADMVREFDVFLSHASEDKPRVRLLYEKLVEVGVTVFFDEDSIAWGDSIPEKINHGLLKSNFFIPFLSKRFSEKGWTNKELNSAISMNISRKGRILPIIDGHFSVEENYPLLNETLYKKWPIEVELQAKFISTTADEILKKVVAEKLKKHDLG

SEQ ID NO: 406 - protein, 476 aa, unidentified
  source 1..476: note = Related to NZ_KB890024.1; note = Hoeflea sp.
MAFALGLDPEKFFYVVQHAADGTYYREFQVPKKRGGVRNISAPRKGLALAQNRLAEVIRSHYVPKKFVKGYVRGESFLSNARYHEKQKWILTVDIQDFYPSIGFARVRGLFLSRYFGFNERVATILARITTYRDGLPQGASTSPLIANIIAHNLDKKLVAIAVKGQLKYTRYADDITFSSSRRAVSSDVVQSWEPAFGRREVHLGQSITEAFKHSGFEINHTKSRILFPFERQEVTGLVVNRKANVWRRDIARLRMKLHSIKRFGATEAAKVWLGPGGDKQKMWSHVAGNLAFIRQVRGMTDPVLAKLCKDAVIAGMTGPSWVLQMAEMVREFDVFLSHASEDKEKIRRLKDKLEECGVKVFFDETSIKWGDSIVEKINNGLLKSSYFIPFLSKTFSEKGWTNKELNSAISMNVSRKGRILPIIDSNFSVEENYPLLGETLYKKWPADESSEDAFIGEVADAILHLIEKKVTSVAT

SEQ ID NO: 407 - protein, 510 aa, unidentified
  source 1..510: note = Related to NZ_MYFQ01000014.1; note = Shinella sp.
MKGKDRGSSILLPENPFSDPIFRLKIAHSVQDVASALGLDSAKLFYVIRHCDDGRYYKKFKIPKKSGGFRDISRPIRGLAMAQDRLATILTAHYKPKSFVKGYVKGESFLSNAQYHERQKWVMNIDIEDFFPSIGFARVRGLFLSSYFGFNSNVSTILARITTFNNQLPQGASTSPILANILANNLDKGILSTAIRGRLRYSRYADDITISSSQRHVPSLIVKNWEPDKGKREIRVGNDIVDAFKKAHFKINEKKTRIQFTYERQEVTGLVVNKKANVWRKDVSKIRMKLHSAKKYGAENAAKLWLGKDKSGKDFWIHIEGWLAYIRQVRGVDDPVLAKLCKQAILSGLKASKWIQRCSDMVREFDVFLSHASEDKEKVRILKNALEIRGIKVFFDEDSIEWGDSIVEKINHGLLKSSFFIPILSDKFSKKGWTNKELNSAIHININRKGRILPIAINGFSIAENYPLLNETLYKVWPNNEIEQNIFIEEVSDQLLLKIQKTHSESAGLG

SEQ ID NO: 408 - protein, 497 aa, unidentified
  source 1..497: note = Related to NZ_CAKKMZ010000001.1; note = Rhizobium sp.
MSVFDDPITKLRLAHSVQDVAFALNLDPAKFFYVIQNSENGSYYKKFEIPKKSGGVRQISRPLRGLALAQDRLSAVLTAHYKPKSFVKGYIKGESFFTNAKYHERQKWVLNLDIKDFFPSIHFGRVRGLFISQMFGFNEQVSTVLARIVTFENGLPQGASTSPIIANIIANNLDKQLIAIAAKERLRYTRYADDITFSSSQKTVPSALIKLWEPDKGNRQITLSSAVHDAFRQSNFAINEDKVRIQFPYERQEVTGLIVNKKANVWRRDVSKLRMKIHAARKHGAESAAKIFIGESADGEKFWQHITGWLAYVRQIRGNDDPVVAKLCKQAILAGLNGAEWIRRYADMVREFDIFLSHASEDKEKVRKLKDKLEGKDVRVFFDESSISWGDSIVEKINHGLLKSLYFVPVLSETFAKKGWTNKELNSAIQSNIGRKGRILPIVMPGFSVAENYPLLNETLYRSWPAQEQKEGEFLEEISDQILLKIQKSHHEKTDLG

SEQ ID NO: 409 - protein, 498 aa, unidentified
  source 1..498: note = Related to NZ_VCDK01000006.1; note = Shimia sp.
MALPENFDPEQAHLFLGFAYSIQDIASALHMRPDGIFHITKTSEDGGYYRSFRIPKKNGGERSIDQPLRGMAMAQERLAAILRATYVPKSHVHGYVCDRSFLTNAQYHVGQKWILNVDIEDFFGSITFPRVRGLFQTYFGYSDRVATTLARICTYQGKLPQGAKTSPVLANLIAHNLDKSLLAIATKHSLRFSRYADDITFSTSQRRFPPSLVTAWEPLYGDREIQLGGPLKDAFMKAGFRINQTKTRIQRYDERQVVTGLVVNKKANVWRSDIKRLRMKLHSAHKFSADEAAKIWIGPSATQEDFVAHVEGWLAFIRQVRGKNDAVLSKLCQQAVVAGVTQQAWVKELAKTVHEFDVFLSHASEDKPKVRLLRDALEHLGVNVFFDEDSITWGDSIVEKINEGLLRSSFFVPFLSETFAAKGWTNKELNSAITNNVQRKGRILPITDAGFEVEDNYPLLNDILYKSWPAEGPEQSAQIEELADQLLAVIEKNKLKAQ

SEQ ID NO: 410 - protein, 498 aa, unidentified
  source 1..498: note = Related to NZ_AQQR01000002.1; note = Marinibacterium profundimaris
MGLPNHFDPATAHLLIGVAHSVQDVAGALMMRPGGLLRILKNTETGEYYKTFEIPKKRGGTRTIDKPLRGLAMAQERFAAVLLEVYNPKPFVHGYVSGRSFLSNAQYHQRQRWILNIDIEDFFGSIGFARIRGIFMSKLFGYNDRVATILARICTYQDRLPQGAKTSPALANLIAHNLDKELIALAAKENLRFSRYADDITFSSSSKRIPRTLIKAWEPEYGDRVVELGERLEEAFRGSSFQINRDKTRVQLFGERQVVTGLIVNQCPNVWRKDVKRLRMKLYSAKKYGLEQAASLWIGLDAKPEAFWSHVEGWLGYIKQVRGEGDPVLSKLCKQAMEANPKSSDWIQEHAHMIHQFDLFLSHASEDKPRVKKLHDKLVVLGVKVFFDQSSISWGDSIVEQINIGLMKSNFFVPFLSNTFAEKGWTNRELNSAISININRKGRILPICDHDFHVGRNYPLLADILYESWPGPDADEEAKLNEIADKLLAAAEKAKHSQ

SEQ ID NO: 411 - protein, 486 aa, unidentified
  source 1..486: note = Related to CP010623.1; note = Phaeobacter inhibens
MLLGVAHSVQDVAHALSMPAGGLFYVLQNADNGKYYQSFEIPKKREGTRPIDKPVRGLALAQERLAAVLKQSYRPKSFIHGYVTERSFLTNARYHEKQKWVLNIDIEDFFGSIGFARIRGLFMSQFFGFNHRVATILARLTTYKDALPQGARTSPILSNIIAHNLDKHLVEIAVKERLKYSRYADDITFSSSRRKIPPSLVRTWEPEYGDREVILGEKITDAFKTAHFRINPDKTRIQLFRERQVVTGLIVNEGVNVFRKDISRLRMKLHSGKKFGLEQAAKVWIGPTATVKDYWAHIEGWLGHIKQVRGDDDPVLSKLCKQAADINPAAPEWIIRHAEMVREFDIFLSHASEDKPRVRKLKKKLEAVGIKVFFDEESITWGDSIVQRINHGLLKSTFFVPFLTNTFAAKGWTNRELNSAISANVNRQKRILPICDHDFHVGKNYPMLEDVLYKTWPKAGPKEDEWLNAITDELLALVEKVKLETS

SEQ ID NO: 412 - protein, 507 aa, unidentified
  source 1..507: note = Related to SMSI01000004.1; note = Pseudohoeflea suaedae
MANRGARIEVKNEEQALLLPSEEEKALFSLQYAHSIQDVAFALGLDPAKFFYVVKNCDSGEYYKSFTIPKKNGGERKISKPLRGLALAQVRLLIILKHVYKPKGYVKSYVEGESFLTNANYHSNQKWVLNFDIEDFFGTITFPRVRGLFMSKFFGFNPRVSTILARICTHEGSLPQGAPTSPILSNIIGNALDKNLVALAREYKLKYTRYADDITFSSSQKLPPGAVISLWEPKFGKREITLGKDIREAVKNAGFRINPEKTRIQFPYERQVVTGLVVNKKANIRRADIARLRMKIHSAQRFGAESAAKVWLGPNATASSLQSHIEGHLSYVRQVRGKDDVVLAKLCKSAIIAGLANATWMKAQADMVREFDVFLSHASEDKEKYGKLNKALKAVGVKTFFDVDVIQWGDSIPEKVNFGLLKSDYFIPFLSNNFTRKGWTNKELNSAISININRKGRILPIIDSDFSVDDNYPILAENLYKKWPEKESEEDDFIEEICAEITKRIVR

SEQ ID NO: 413 - protein, 506 aa, unidentified
  source 1..506: note = Related to JAGHRO010000004.1; note = Shimia sp.
MKSKERGSSQVKASIVFHTDFRLIQLRAAHSVRDVALALGLDPKKFFHVLKHTDDGRYYRDFEIPKKTGGYRQISKPVKGLALAQDRLSTILDHVYNPGSYVKAFVKKTSFVENARYHKAQRWILNIDLKDFFPSISFPRVRGLFLSTLFGFNERVATILARICTYKGSLPQGASTSPRLANIIAKSLDKKILEIAKSHQLKYTRYSDDISLSSSKKVIPTLVVKNFHDNPDGRDVILGDGLKNAVRSSGFFINASKTRLMMPNNRQEVTGLVVNKRVNVRRTDIAKLRMKIHSVKKVGFSEAAKVWVDGNEAQLKNHLVGWLAHIRQVRGPSDPVLAKLCLQAHEAGLTEIKWIEELADMSKEFDVFLSHASEDKERVRRLQAELEERKVSVFFDESTIKWGDSIVEKVNHGLLKSTFFIPFLTETFSKKGWTNRELNSAIQMNMTRKRRILPIKSPDFDVDSKYPLLNDTLYKTWPRDPADEAAFISEISDELVALIEMEKSSV

SEQ ID NO: 414 - protein, 493 aa, unidentified
  source 1..493: note = Related to NZ_JFZB01000068.1; note = Paenirhodobacter enshiensis
MNELDLCLFQLKIAHSVKDVSFALKLDPEKFFYVLQHTDDGRYYHTFEIPKKNGGKRAIAKPLRGLALAQDRLAPLLHHVYNPGPHVKAFVTGSSFVSNASYHKGQRWILNIDLSDFFPSITFPRIRGLFLSKLFGFNPNVSTILARICTFQGSLPQGASTSPVLANIIANSLDRKFLEIARSEKIKYSRYSDDITFSSSKKSIPKCLVKSFHDHEDGREIILGNDLQDAVRAAGFSLNDQKTRLMTPNNRQEVTGLTVNERVNVRRSDINRLRMVIHSAKKVGFEEASKVWLPDGKNNLREHILGWLAHIRQVRGASDPVLAKLCLQAHGAGLTKVGWIEELADMSKDFDVFLSHASEDKDRVRKLSDALTAGGVKVFFDESSIKWGDSIVEKVNHGLLKSRFFIPFLTTTFSKKGWTNKELNSSISMNISRKGRILPIKSEDFEIGDRYPILNETLYKTWPKSSVDETAFIQEVVDSIIKLIEEDKAAPSV

SEQ ID NO: 415 - protein, 505 aa, unidentified
  source 1..505: note = Related to FOXV01000005.1; note = Roseivivax halotolerans
MRVDKVKSEGRADTVKSEAEVLFSLQTAHSVKDVAYALGLDPEKFFYVVQRADDGHYYDTFKIPKKSGGERDIAKPKKGLALAQARLVPILSFVYSPGECVKGFVKGSSFLDNAHYHHAQRWVLNIDLLDFFPSVTFARVRGLFMSSLFSFNPRVATILARICTFQGGLPQGATTSPILANLIAKSLDKRLTGLARTHRLKYSRYSDDITLSCSKAYVPKSIVSEIIEIDSAWEVQLGSELKDIIRHSGFRVNDKKTRLMRRNNRQEVTGLVVNEKANIRRADIQRLRMKIYSTRKYGQAEASLLWLGDSSKSISMHLVGWLAYIRQVRGQSDPVLAKLCQQVVAAGISDIEWIVRLADMTKEFDVFLSHASDDKSKVRPLYESLNSAGVKVFFDESSIKWGDSIVERVNHGLLKSRFFVPVLSSTFSRKGWTNKESNSAIAMNISRKGRILPIKFSEFDLDGRYPTLNDTLYKTWPEDSGKEDDFIREVTDDLIALVEQDKQLG

SEQ ID NO: 416 - protein, 492 aa, unidentified
  source 1..492: note = Related to JAINWD010000002.1; note = Halomonas sp.
MKLLNPSSRSIAKLNSLDELCNLLGINKGHLLFICYKRPDELKYKSFEMRKKRGGFRKIDSPQKGLRVIQGKLAELLEENVEFKTCVQGFVKERGVLENATLHKKSNWVLNVDIKNFFGSINFGRVRAVFVAKPFEIHPDVATVIAQICCFKNYLPQGAATSPIVSNIVASTLDNQIIRRIRNHRLLYSRYADDITISAKRVFPRELAYISEGRTIVGEDLVNIFSRASFEINQKKSRLQSKYSRQEVTGLIVNRKVNVPAEYKNKLRAAIHHWVDDPREAERKYYVDILGLTPEEAELTDDGSKLRRNIYGRLSFLNMVKGGDDPTYIKLILKMAEHDPLPPKFVKNIKAEYKMYDVFLCHASEDKADIVEPLYQELSKIGVHAFYDKKEIGWGDSLVGTINKALLKSKYVIAVMTDNSVGKSWPQQEINSVLNGDISGGTKRLLPLIFGDKEKILNNNFLMNDKLYVEWKDNPTEIAQKVQELLAQKSNE

SEQ ID NO: 417 - protein, 491 aa, Pseudomonas sp.
  source 1..491: note = Related to NZ_QBEO01000006.1; note = Pseudomonas aeruginosa
MKLLSPLNRSIAKLSSLDELCGLLGVQKGHLLYICYKRSDNAKYKSFEMRKKRGGFRKIDSPQKGLRVIQNQLAGLLQENIEFKSCVKGFIKERGILDNAALHKKSDWVLNVDIKDFFGSINFGRVRAVFIAKPFEIHPDVATVIAQICCFNNYLPQGAATSPIVANIVASTLDNRIIKHIRNHRLLYSRYADDITISAKRIFPRQIAYINDGQTIVGEDLASIFARSGFEINEKKSRLQAKFSRQEVTGLIVNKKLNVPAEYKNKLRTAIHHWVDNPVEAERKYYIDILGLSPEEAELTEDGSKLKRNIYGRLSFLALVKGADDPTYVKLILKMAEHDSTPPKFIKSIKAEYKMYDVFLCHASEDKEEIVKPLYDELEKLGVHAFYDAKEISWGDSLVGTINKALLKSKFVIAVMTDNSVGKAWPQQEINSVLNGDISGGTKRLLPLIYGDKDSILNNNFLMSDKLYVEWKGNPEEIAQKVKDLLTQKAQ

SEQ ID NO: 418 - protein, 495 aa, Pseudomonas sp.
  source 1..495: note = Related to NZ_NEIO01000001.1
MKLLNPPSRSILKLNSIDELCSILGVQKGHLLYICYKRSDDLKYQSFEMRKKRGGFRKIDSPQKGLRVIQKKLAEIFEENIEFKSCVQGFIKSRGILENAALHKKSNWILNVDIKDFFGSINFGRVRAAFIAKPFEFHPNVATVVAQICCFKNYLPQGAATSPIVANIVASTLDNRILKYIRSQRLIYSRYADDITISAKRVFPNEVAHINDGKTIIGEDLANIFSRASFEINEKKSRLQSKYSRQEVTGLIVNKKVNVPAEYKNKLRTAIHHWIDDPVDAERKYYIDVLGLSPEDAELTKDGSKLKQNIYGRLSFLSMVKGKDDPTYIKLVLKMAEHDPSPPKFIKSIKAEYKMYDVFLCHASEDKEKIVEPLYQELSKIGIHAFYDTKEIGWGDSLVGVINKALLKSKYVIAVMTDSSVGKAWPQQEINSVLNGDISGGTKRLLPLIYGNKDNILGNNFLMNDKLYVEWKNNPDEIAKKVQELLTHNESLNSR

SEQ ID NO: 419 - protein, 491 aa, Pseudomonas sp.
  source 1..491: note = Related to NZ_CP009747.1; note = Pseudomonas parafulva
MKLLNPPSRSILKLSSLDSLCELLEVQKGHLLYICYKRADDLKYQSFEMPKKRGGFRKIDVPQKGLRVIQQSLAKLLEENVEFKPCVQGFIKKRGILENANLHRKSNWVLNVDIKDFFGSINFGRVRAVFIAKPFEMHPDVATVIAQICCFNNYLPQGAATSPIISNIVASTLDNRIIKHIRSHRLIYSRYADDISISAKRVFPREIAHISEGKTIIGEDLSNIFSRARFEINEKKSRLQSKYSRQEVTGLITNKKVNVPAEYKHKLRTAIHHWIDNPVEAERKYYIDILGLKVEDAGLTGDGSKLKRNIYGRLSFLAMVKGSDDPTYVKLILKMAKHDPSPPKFIKPLKEQYQMYDVFLCHASEDKAEIVEPLYNELNKLNIHAFYDAKEIGWGDSLIGTINKALLKSRYVIAVMTDKSVGKAWPQQEINSVLNGDISGGTKRLLPLIHGDKETILGNNFLMNDKLYVEWNNNPAEIAQKVQALLAQKAE

SEQ ID NO: 420 - protein, 488 aa, Pseudomonas sp.
  source 1..488: note = Related to NZ_CP075180.1; note = Pseudomonas lundensis
MKLLNPPSRSIHKLDSLDLLCNLLGVKKGHLLFICYKRADEKKYKSFEIPKKRGGLRKIDSPQKGLRVIQQKLAELLTENLEFKPCVQGFIKGRGILQNAILHKKSNWVLNVDIKDFFGSINFGRVRAVFIAKPFEIHPDVATVIAQICCFNNYLPQGAATSPVVSNIVASILDNRIIKHVRSHRLIYSRYADDITLSAKRNFPREIAHVSDGRTIIGEDLANIFSRASFEINEKKSRLQSKYDRQEVTGLITNKKVNIPAEYKNKVRAAIYHWIQDPKEAERKYFIDILKLNPDEVELTEDGRKLKHNIYGRLSFIAMVKGKDDPTYVKLILKMAEHDKTPPKFLKSIKEEYKMYDVFLCHASEDKAAIVEPLYEALTKIGVHAFYDSKEIAWGDSLIETINKALIKSQYVIAVMTDNSVVKAWPQKEINAVLNGDISGGTKRLLPLIHGDKEKILNNNFLMSDKLYVVWQENPDEIAQKIKALLAS

SEQ ID NO: 421 - protein, 488 aa, Pseudomonas sp.
  source 1..488: note = Related to NZ_JYKS01000054.1
MKLLTPPNRSIYKLASLDRLCELLGVKKGNLLFICYKRADALKYKSFEIPKKRGGLRKIDAPQKGLRVVQNKLAELLNENLEFKNCVQGFVKKRGILQNAMLHKKSSWVLNVDIKDFFGSINFGRVRAVFIAKPFEIHPDVATVIAQICCFNNYLPQGAATSPIVSNIVASTLDNRIIKHVRSHHLTYSRYADDVTISSRRAFPREIAHIIDGQTIVGEELSSIFARARFEINEKKSRLQSKYDRQEVTGLVTNKKVNVPAEYKNNVRAAIYQWVKDPKEAEKHYYIDVLGLKPEDISLTDDGSRLKHNLYGRLSFIAMVKGKDDPTYVKLILKMAEHDKSPPKFLNAIKEEYEMYDVFLCHASEDKETIVEPLYNELKKLGVHAFYDTKVIAWGDSLIETINKGLIKSKYVVAIMTENSVIKAWPQKEINAVLNGDISGGTKRLLPLIHGDKEKILSSNYLMSDKLYVEWKENPEEIAKKIKDLLAS

SEQ ID NO: 422 - protein, 496 aa, Pseudomonas sp.
  source 1..496: note = Related to RHQN01000003.1
MALKLLNPTANPLFRLNSLDALSGLLEVKKGHLLYICYKRADVHKYKSFEIPKKNGGIRKIDAPLKGLRLIQNRLAAILTENIEFKSCVKAFVKGEGIFNNAVLHKKSDWVLNVDVKDFFGSINFGRVRAVFIAKPFEMHPDVASVVAQICIFQNSLPQGAATSPVVANIVASMLDNKIIKHINGVKSGRLVYSRYADDITISAKRFFPSEIAHLSEGKTIVGESLVNLFSRSGFVINDSKSRLQPKINRQEVTGLVVNKKVNIPSEYKNKLRSAISQWILNPKEAERKYFVDILGLNESEFEASATGENLKRNIYGRLSFMSMVKGKDDPTYLKLILKMAEHDDSPPKFVRLIRAQHNMYDVFICHASEDKAEIAEPLYHALTALGLNVFYDAESIEWGDSLIETINKGLYKSKYVIAIMTDNSVVKKWPQKEINAVLNSDISGGQNRLLPLIHGDAENILSANFLMSDKLYEVWKGNAEEIAGKVKVKIEGRAR

SEQ ID NO: 423 - protein, 490 aa, Pseudomonas sp.
  source 1..490: note = Related to CP013124.1; note = Pseudomonas mendocina
MKLVEPDKNPLLKLATLDELCSLLNVKKGQLLHICYDRSGPAKYSSFDMKKKRGGVRKIEVPLKGLGLVQKRLSILLSDFIAFKPCVKGFVEGESICTNASLHKKSKWILNVDIQDFFGSINFGRVRATFLAKPFEMSNEVATVIAQICTFENHLPQGAPTSPVVANIIASMLDNKMLRLAQKYRLRYSRYADDITLSSPRGFPGEVATATEGRTILGEELKLIFDKARFTINPNKSRLQAKNSRQEVTGLIVNKKLNIPAEYKHKLRTAIKHWTSDPEEAERNFYLNIKGEDPATFAVSKGGERLKGNIYGRLSFISMVKGSDDPTYIKLVLKMAEHDTQPPKFIQKIKSEHNMYDVFLCHASEDKDAIVKPLYDELKELGLSVFLDGEEIGWGDSLIDIINKALHKSKYVIAVMTENSVDKKWPQKEINAVLSNEIKHDKNKLLPLIHGDAEEILGKNFLMSDKLYKKWEGDPKKIAQDVLALLQKNA

SEQ ID NO: 424 - protein, 489 aa, unidentified
  source 1..489: note = Related to JAAYGA010000118.1; note = Pseudomonadaceae bacterium
MKLVKSDKNPLLKLSTLDDLCSLLSVKKGQLLFICYKRSDKAKYSSFDMKKKSGGVRKIEVPIKGLGLIQKRLSVLLSELITFKPCVKGFVKGESICSNASLHKKSKLVLNIDVQDFFGSINFGRVRATFMAKPFEMSNEVATVVAQICTFENHLPQGAPTSPVVANIIASMLDNRVLRLAQKYRLKYSRYADDITLSSPRKFPPEVAATVEGRTVLGEELKTIFEKARFVINPNKTRLQAANSRQEVTGLIVNKKLNIPKEYKHKLRAAIKHWISDPVEAERKFYVDIKGELSEEFVSQGGERLKNNIYGRLSFMSMVKGIDDPTYIKLALKMAENDNQPPKFIKTIKSEHNMYDVFLCHAAEDKETIVRPLYDELKKLNLNVFLDSEEIHWGDSLIDIINRALHKSKYVIAVMSENSVEKKWPQKEINAVLSNEIKHDKSKLLPLIHGNAEEILGTNFLMSDKLYKEWENNPEEIAQAVLKLLQKAG

SEQ ID NO: 425 - protein, 490 aa, Pseudomonas sp.
  source 1..490: note = Related to NZ_SULN01000012.1; note = Pseudomonas rhizoryzae
MRLVESDKNPLVKLSSLDALCALLNVKKGQLLYICYQRSNKAKYDSFEVKKKRGGVRKIEVPQKGLAVVQKRLCKLLSEWIEFKPCVKGFVTGESICSNALVHKKSKWVLNVDIQDFFGSINFGRVRAAFLAKPFEMSSEVASVVAQICTFENHLPQGAPTSPVVANIIASMLDNKILRLAQKHRLRYSRYADDITLSSLRSFPGEVAKLLDGRTFVGEELRLVFERSRFSINPQKSRLQAKNSRQEITGIIVNKKLNVPIEYKQKLRAAIKQWALDPEAAERNFYIDIKGEDPETFKVIEGGRRLRDNIYGRLSFVSMVKGCDDPTYINLALKMARHDTHPPKFIKKIEGEHNMYDVFLCHASEDKDAIVKPLYDELKRLGLNVFLDDEEIGWGDSLVDIINKALHRSKYVIAVMTENSVDKKWPQKEINAVLSSEIKHDKSKLLPLIHGDAEIILGKNFLMSDKLYKKWEGNPEKIAQDVLALLRKKT

SEQ ID NO: 426 - protein, 488 aa, unidentified
  source 1..488: note = Related to NZ_PZJW01000002.1; note = Salinicola acroporae
MKLIEKEENPLRDIKSIDDLLSVLNIEKGKLFYVLYEVGVDKRYKKFSIPKKRGGERPISAPTKGLRLAQYRLFKLLTDNIEFKQCATGFVSKRGIIKNAKVHKGTKWILNVDIEDFFGTINFGRVRGVFMSSPFDMPKQVATLIAKICTFNNALPQGAPTSPVISNIIASSLDNKLLRLSKQYRLRYTRYADDITLSGFGQPPQDIAKIVEQKTVLSEKLVAAFTKSGFKVNESKTRLQKKVVRQEVTGLVINSKVNVPVEFKKSLRAAIHQWCDNPEEAERKFLASTGKIKEGEEVTQGGQILKRNIYGRLSYLAQAKGNEDPTYIKLAMKMGRADPEPPKFLRRIMEKYHEYQVFICHASEDKTKIASPLYEALEEREISTFIDNKVIEWGDSLVDTINHALYKAKLVVAVVSENSLGKSWPQKEINAVLASEIQGESKLLVLVDGDGQELLGRLFLLQDKLYRQWEDNPDELADEIARIAMKIQ

SEQ ID NO: 427 - protein, 564 aa, unidentified
  source 1..564: note = Related to AE008922.1; note = Xanthomonas campestris
MPPLPDYASTELLLGLKTRKDLASWLGVSDRALRYMLYRLGDGDKYSTFSIRKRNGGLREIHAPKKALKYLQNKVAHALAGVVPVRQIAKGYVPGRSIYDHAKMHRSKKWVVLVDLKSFFPSINFGRVLGLLRAPPFSLENEVAVAVAQLCTRAGELPQGAPSSPVISNLICRKLDRQLLELAKQAGCGVSRYADDICFSTNRKRVSVEICDFVNEHGWVPGAGLKQLICSNGFEINFSKFRVHEGRDRKLVTGLVVNKGVSTPSRWRDQLRSSLHVIDKYGEAAGVEIISGWTSGFFRKEPGDVLRTIRGKLGYLKWIDKVANHLATDALRRNFPSLASLMPISNDGVSFRIMAEGPTDLLHLEAALDYLRKSGGFLDVRPRFQNFLGDVGDSELWETLLRIAKADVNELTIGVFDCDSPAFMKKTSLVPGGNIQLGPRVYAFCLAPPGTSISNNFCIESLYSRSDATLVDGSGRRLFFGDEFDSASGFSHDGLYKCLHPKKKAIVVSDQVARVHDGASVLLSKAGFASQVKDKAPPFDVVSFDGFRPTWLGIRALAIAAVRK

SEQ ID NO: 428 - protein, 562 aa, unidentified
  source 1..562: note = Related to DOBS01000129.1; note = Stenotrophomonas sp.
MPPPSSTVEVFLSLKTRADLASWLGVSDRALRYILYRLEEAEKYKTFLVRKRDGGFREIDAPKPALKYLQEKIASALIEVMPVRQIAKGYVPGRSIYDHAKVHRTKRWVVLVDLKQFFPSINFGRVLGLLRSAPFNLEQEVAVAVAQLCTKAGALPQGAPSSPVISNLICRKLDRQLLELAKNAGCSVSRYADDICLSTNRRQVSKSICEILPEHGWVPGVGLKQVISSNGFEINISKFRVASGRERKLVTGLVVNRGVSVPRRWRDELRSSLHVVSKYGELRGAEIISQWNSGFFRGDGSNALRTIKGKLNYLDWIDRVARRSAIGALRRQFPSLGTLMPRPRGGIPFRVMAEGPTDLLHLKAAFDRFRDDGHLFDILPRFQNFSGDVGDSELWETLRRIAKADVHELTVGIFDCDSPAFLRKSSLAPGGHVQVGEKVYAFCLAAPNSSLSGEFCIESLYSREDATMLDGSGRRLFFGDEFDATNGLSHDGEFRRLHPQKKSIVVSDQVTRVSGGGSVLLSKANFASLISEKVPPFDRVSFEGFKETWRGIRELVIANSRK

SEQ ID NO: 429 - protein, 327 aa, unidentified
  source 1..327: note = Related to JAGOCJ010000020.1; note = Pseudoxanthomonas sp.
MSVKSRSDLAGWLGVSERALRYILYKLPDERKYSTFEIKKRNGNARVIDAPSPALKFLQSKLAETLSEIAPPRQLAKGYVRERSIFDHAKVHRSKRWLVLADIKDFFPSINFGRVGVFRAAPFSFGHEVAVCLAQLCTKGGQLPQGAPTSPVISNIVCRRLDRELLELSKRSRCSVSRYADDVCFSTNTRDISARVADFVGEAGWVPGLELKSVFQRNGFQINPNKFMVRCGRERKLVTGLSVNSGVSIPRSWRRQLRSALHVIRKYGEVPGDSIVLSWRPAFQRGSAVNIGQVIRGKVRYAHWIDRLAGRGSVEALHRNYRAGSMG

SEQ ID NO: 430 - protein, 564 aa, unidentified
  source 1..564: note = Related to NZ_LMHF01000016.1; note = Lysobacter sp.
MGPLSLSPEAIAFSGLKTRAELAGWLGLTDKKLCYLLYVLPATQKYITFQVAKRDGSSRTIDAPHPALKQIQRKLLSVFRELAPATGVAKGYVNGVGVIDHARLHRRQRHVVLVDLENFFPSITFPRVRGALLGKPFLFPPKVATCIAQLCCKDGVLPQGAPTSPVLSNLICRSLDHKLLALAKANRCRVSRYADDICFSTSLVEVPSIIATLYDGNYLVGPALIAAIHASGFTINQKKFKAKSQRTQQLVTGLVVNRGVSLPRRWRRQLRVLLHLADKKGAARATEIASAWTKPVAFRRGSGSIEQLVRGKTNYAQHVDLRCDKSFSESIYRNYGGVRKLMPRPLRGIAFRVMTEGKTDLLHLESALKWFQERAEFAEFKPRFLNFPGDIGDVELLKTLQRIAKSDVPELTVGVFDYDNIKDMNKIGLAPGAHLQLGSRVYAMCLGEPAGFTGTRFCIENLYQKNQLVAMTSEARRVFLPEDFDQDGISLDGLFKRAQPRATAAIVSDKVVRLSDGFSASLSKAEFAEMIFRSVHPFDQIDFSGFGPTFNALRRIVEEVSLAG

SEQ ID NO: 431 - protein, 563 aa, unidentified
  source 1..563: note = Related to NZ_JAHXYK010000004.1; note = Lysobacter sp.
MGPHSYSPGALAFLNLKTRADLAGWLGLTDRKLCYLLYALDASKKYTSFQIAKKKGGVRTIDAPHPALKYIQRKLMHVLVELAPPTGIAKGYVAGVSTIDHAWLHRRQRHIILADLDSFFPSITFQRVRGALLAKPLSLTAKVATCIAQLCCKDGALPQGAPTSPVFSNLICRSLDHKLLALAKAHRCKVSRYADDICFSTDLKVIPTTIASWVGDRYLAGPSLISAVSSSGFSLNPSKFKVRSKESQQLVTGLVVNDGVSLPRHWRRQLRVILHLSSKRGLVRAKEITDGWARPAASRCEADSLEHFIRGKTYFAQYVDFRCRRKFSESIYRNYSGMRKLMPRPLSGASFRVMAEGKTDLLHLEVALKWFQSNGEFTDFRPRFVNFHGETGDVELMKTLERIAKSDIPELTIGIFDCDNSKFMLKNGLSPATHQSLGGKVYAMCLGAPLALTKSTFCIELLYPRSQLLTMTSGGRRIFLPDEFDLNSGLTPDGLYKNKFPKATAPIVSDHVERVVDGFSALLSKADFADMVHQAVHPFDAMDFSGFRATFDAVRRVVDEVYS

SEQ ID NO: 432 - protein, 551 aa, unidentified
  source 1..551: note = Related to NZ_JAKPBV010000011.1; note = Lysobacter sp.
MALSSRQDLAKWLGLTDRELRYVLYALSSDKKYTTFTIKKRTGADRVIEAPHPALKNLQRKLLTAISEIAPASGLAKGYVLGRSTIDHAWLHRRKRFVILADLKEFFPTITFRRVRGALLAKPFQLPSAVATCVAQLCCKDGVLPQGAPTSPVLSNLICRSLDHKLLQLAKKHRLAVSRYVDDICFSTSRPTIPGNIAVPHGAEWEAGPELTEAIRVSGFELNHSKFKVRSRETTQLVTGLVVNHGVSLPRRWRRQLRVLLHLVKKHGEKKAGEIAASWVRPTASRRGFASIEQVIRGKSHFAQYVDRRCNRAYSDALFRSYPGQRRLLPRPLRGVQLRLMAEGKTDLLHLEAAHRAFNTAGEYAHIRPRFVNFPSDTGDVELLKTLNRIAKSDIPELTIGVFDCDNPKFMKDAGLQPAGYVQLGSNVFCMCLAPPPSLAGVPFCIELLYERDELCAMTTDARRVFLPDEFDQATGLSHDGLYRRTNPKKSALVVSDQVVRVSDGYSSLLGKADLATLVSQQVPPFEEMNFGGFQPTFDLIGSIIDMVHGR

SEQ ID NO: 433 - protein, 577 aa, unidentified
  source 1..577: note = Related to NZ_LXXZ01000065.1; note = Stenotrophomonas sp.
MSASPPPIKKTSLLSPNAIAFRSIKSRSELANWIGIKESTLIYILYRLPTSKKYTDFLIPKRNGGTRMISAPRKALKYAQKRISSVLYDISPPRNLSKGYIPGRGIFDHAYRHRRRSTVVTADIKGFFPSINFGRVRGMFAAAPFGLPLDVATMLAQLCCKDGELPQGSPSSPAISNIICRSLDLDLAGFSRKHRITVTRYADDVCFSTNMRKNLFPLVERNDLLGEVPGGEVSRIFEKNGFELNLKKFNLSKSNSRQMITGLIVNSHVNVPRQWKRQLRTLLHLRSRMEDAQATEIANTWARPQASRKGVTESIDHLIRGKASFAAYIDSRSGTRHIASLHRGYPKLRQMLPRMNPSFPVRIMAEGPTDLLHLEAALRHCSDRIDFSNVALRLHNYQGDVGDTDMIKTLHRINKVDVEELTIGIFDHDNPSFLKEISLNEGSHVRLGRMVFAACLSRPKFVTGNYCIESLYRRIDSSRVTSEGRRLYFSDEFDAEGLHSQGVLRRQYPKKTALVLSERVFDPKDPNVSLTLSKTDFAAMVNAGAAPFSDMDFSGFLPTLAHLRKMIDEAMYFSGNS

SEQ ID NO: 434 - protein, 578 aa, unidentified
  source 1..578: note = Related to CP076250.1; note = Xanthomonas translucens
MPSSPPVKKNSQQLSDRALEFKAMASRSDLAQWIGIKEKTLLYILYKLSDSEKYKDFTISKRDGGTRLISAPLKALKFSQKRISAILQEISPPRHLAKGYVPGKGIFDHAFLHKHRKTVVTADITNFFPSINFGRVRGMFLSPPFSLPTSLATMLAQLCCKDGQLPQGSPSSPAISNIICRSLDLELLEFSKRHRISVSRYADDICFSTNMRKPIFGLYEINSQFGNFPGTELSDIFTRNGFTLNIKKFKVSKSNSRQMVTGLIVNDRVNIPRAWRRQLRVLLHLRSRMEDAATTKVVNSWSSPLPSRKGETSSIDNLIQGKASFAAYIDRRSGTNHIGGLYRSYPKLRGMLPRVTQTFPVRIISEGPTDLLHLQAALEHYGSKLDLSNISIKFHNYQSDQGDADTLQTLRRIAKVDVEELTIGIFDYDNPKLLRDLSLDAGGYVRLGRMVFAACLARPAQTNGMYYCIESLYRRDQASRTTTEGRRLFFADEFKEDGSSQDGSLRREHPKKSALVLSERVFDPAKPEVSLTLSKTDFASMVFTKAAPFSDMDFSGFLPTLTLLRRMVDEAMRYQGIK

SEQ ID NO: 435 - protein, 574 aa, unidentified
  source 1..574: note = Related to JAJUAC010000002.1; note = Xanthomonas campestris
MPVKPPSLSNRSLQFLAIRTRADLANWIGLSEKALLYILYKLSPERKYTTFLIKKRNGQFRRISAPQKALKFSQHQISLAIQEITPPRHIAKGYVKGKSISDHARQHVRKKIVVISDLKNFFPSINFGRVRGLFLSPPYSFPTDIATILAQISCKDGELPQGSPSSPAISNAICRKLDRQILQLASRNRVSVSRYADDICFSSNKKISLSICDTSLITGDVAGQALRGIIQNNGFQVNDAKFHRIPYNQRQMVTGLVVNEGISIPRKWRRQLRAILHLRSKFDDPRSTEIVNSWSSPQASRSGKITSVDHLIKGKASFAKHIDRTSGRRVVESLHRGYPSLSELFPRVSPEFPVRIMTEGSTDLIHLDAALQRYEKQLELFNISIKLHNYIGDTGDVDVLSTLRRIAKVDVDELTIGLFDCDNPRLMKEISLEAGSYVRLGRMVFAAALAPPNSSTVPPFCIESLYPREQSTRRTKEGRRLFFGDEFDKSGKFIGEDINREFPQKTAVALSEKVYSSSDPSTSLTLSKVDFANMVSSGAHPFEDIDFSGFLPTLNLLRAMIDDATRHRYRGKER

SEQ ID NO: 436 - protein, 527 aa, unidentified
  source 1..527: note = Related to NZ_CP031059.1; note = Xanthomonas axonopodis
MSPEKKYKSFRISKRNGGEREISAPTSVLKKIQKRIAFGVDGVRKKSLISNGFEKGRSIFDHAQPHKRKSLVITADVKDFFPSINFGRVRGVFLSPPFGFNNKVATLLAQLCTDGASLPQGAPSSPSIANVVCVQFDRLLVTLAGKCRCSVTRYADDICFSTGMADVPKYIAVRKDGNYVPSQALIKTFKDGGFEINLDKFRVVDGKDALVTGLKYRGGIGLPRKWRRRLRTELNLLRKYGDGAEKIIASWGGVTEVAGLPESQGSPRILGKIGFLRWLDGKAGSSNALRMARSYPQLRKEFRAVIPYENIDLLVEGVTDKVLLLAALSALQAKGSFSDLKLNFPESAMKGGPDLEKTVRLVASTGARRNLTIALFDSDDSEVLARAGLAPQSGVYYRAIASGVYVMALKPPPWMLVESFCIENLLRNDTFSVEDSHGRRMFLANEFSENGLHQSKEFFRTRPNKKAIVVDSDVYSVKSGKSMALAKYAFSELVANGQAPEEDYYGFHGTFSLIQEVSYDFALDKVR

SEQ ID NO: 437 - protein, 527 aa, unidentified
  source 1..527: note = Related to JADUNR010000014.1; note = Stenotrophomonas maltophilia
MSAEKKYRSFQIRKKNGGQRAITAPTDVLKRIQKRIAFGVDGVRKRSLISHGFEKGRSIFDHARPHKSKSFVITADIKDFFPSINFGRVRGVFLSAPFGFNNKVATLLAQLCTEGNCLPQGAPSSPSIANVVCVQLDRLLVLLAGKCRCSVSRYADDVCFSTGSSTVPKYLSVRKDGKYVPSQALLKTFKDCGFEVNLEKFRVVDGKDALVTGLKYRGGIGLPRKWRRRLRTELNLLRKHGSGANKIISGWSGVQEIAGITEKSDCPGISGKIGFSHWLDVKAGSSRTLRMARSYPQLRKEFKAVIPHQKIDLLVEGVTDKVLLLAALAALQVRGGFSDLSFNFPDSAMKGGPDLEKTIRLIASTGARRNLTIALFDSDDSEVLAKVGLSPQTGIYYRAVAEGVYVMALKPPDWVISEIFCIENLLRKDTFAVQDANGRRIFLASEFSENGLHQSKNFYRIRPNKKAIVVDSDVYSVTTGESMALAKHAFSELVAAGEAAGEDYNGFRYTFSLIQEVSYEFALEKSR

SEQ ID NO: 438 - protein, 574 aa, unidentified
  source 1..574: note = Related to CP043540.1; note = Xanthomonas translucens
MASLSPNSFGLTDADLIRFLSMASRNELAAWLGVSERQLKYVVYAMPLHKKYKVFRIKKKNGGEREISSPTDILKRIQRRIASAVDSARTRSLISNGFEKGRSIFDHARPHKGRVFVITADIKDFFPSINFGRVRGVFLAPPFRFNNVVATLLAQLCTDGESLPQGAPSSPSIANIVCVQLDRLLMELAKKSKCSVTRYADDICFSTGIAQVPKYLAVKNGDDYIPSQALCKILNNNGFEINLEKFRVCRGKDALVTGLKYRGGIGLPRKWRRRLRSELQVSRKYGAAAANIIAAWDGSDEPKLTGENNELLCVSGKIGFSKWLDGKVGAQRTLALARSYPQLRGVFKAVIPHREIDLLVEGVTDRILLIAALLALQKRGLFLSLKFNFLSSAMKGGADLEKTVKLLAATGARRNLTIALFDSDDGEILAKVGLVPASGVYYRAIAEGVYAVALKPPSWLTAETFCIENLLHPDTFSIEDDLGRRIFLATEFSERNGFHQSGKFFRVKPNKKAIVVDSDVYSTTSGEPVALAKHAFSELVAQGAAPSEDFYGFHETFSLIQEIAYEFGLAAGRT

SEQ ID NO: 439 - protein, 565 aa, unidentified
  source 1..565: note = Related to JAGHWV010000014.1; note = Xanthomonas sp.
MAPPLSKKEIVNFLAISNRSELATWLSVSERQLKFVVYALPIDCRYRKFKIAKKNGGTREISAPVEVLATMQRKIGSAIDSIRKRSLISNGFERGRSIYDHAKAHKGKSKIITVDIEDYFNSINFGRVRGIFLSSPFLFSPTVATLLAQICTDGKSLPQGAPSSPSIANLACVRLDRMLVEIASKARCSVSRYADDICFSTGLSEVPKFLAYEDDGSYLPSNVLADIFKSNGFSINKDKFAVRSRNKAMVTGLKFHGGIGMPRKWRRRLRSELQVCRKYGDEAASIISSWTFGPNRVQLKSHGISSVAGKVGYLHWLDGKSGADKVRRLAESYGQLAGIFGPLMSFGEIDLLVEGMSDEILLNAALRNLQKKGMFEGLKFNFLELGKKGGPELEKSVRLLVTTGARRNLTIALFDCDDNDVLTKVGLEPANGINFRRLSDGIYVAALRPAGWTQSDQYCIESLLRRDTFELSDISGRKLFLSSEFSDNGLHHSMNFYRTTPKKKTLVVDSEVYCVRTGASMALSKIVFAQIVASGTGVAEDFYGFVETFKMLYEIHLNHRVVAVK

SEQ ID NO: 440 - protein, 561 aa, unidentified
  source 1..561: note = Related to NZ_CP049872.1; note = Thermomonas sp.
MPLEEREAEFLALRTREALACWLGITDKQLRFLLYKKLDQSYRTFVIPKARGGSREITAPSKFLARLQRKIALVVAAISPPRGLAKGFVKGLSVLDHAALHANKRWVVCLDLKNFFPSINYGRVLGVFRSRPFEFPDAVAIPLSQICCYLGLLPQGAPSSPAISNVVARQLDRRLAEFARKNKLSVSRYADDISFSTNARIVPVGLMLEDRSPGNEILELLVQSGFVINGEKFRVRHASERQQVTGLIVNDRPRMPRFWRRQTRVLMHLRRVHGDENALSIAKDFRSKRKLSDVKSIEALVRGRATFASHLDDRFQTDFVESLARAFPEQRSVLESRRKVAHIRVVAEGKTDKKYIAQAFSALSGHDSRYRRVKIEFSDLPDKSEGFGDVALRKHVQEISTVQLPVFTIALFDCDNSKLMADLNLTAASYVPLSPTLAIACLPQPAHVSDAAFCIEHFIPAHIRALRDSKGRRIFTVDEFDSTNGRHRTESLYRIHPKQATLIVDSDVFSMTSAESVALSKSQFCDLVCERAPPFEDFDWEVFRPVIDFLLSVYEGATSRR

SEQ ID NO: 441 - protein, 563 aa, unidentified
  source 1..563: note = Related to NZ_QREQ01000002.1; note = Xanthomonas arboricola
MAPPDLSLQAASLLAVSNRAELAEWLGTTDKRLRYMLYGRGNIGLYKVFEVAKRSGGTRKIAAPKPFLKALQRRLAAVFPLISAARGISMAYTAGRGIIENAKVHRRKRWVVATDLEEFFPSINLGRIRGLFLSEPFNFPKEVATVLAQVCCYQGALPQGAPTSPALSNIICRSLDRKLVEFARRSGIAVTRYADDIVFSFNFKECPDSLVNKVDGRWIVSDILSEIIESSGFKVNHKKTRVTPRSQRQLVTGLVVNQRPAMPREWRRRNRVILRLLQTYGKERASQIISEWKGLRRPGADAEAIIRGATAFASNLDKNFNGTYTSSLRRNYPLLSQVISYSPDLVPVEVLTEGKTDRLLLEFAYAQLRLLPEFQDLRLKFSRLSDTAGDGALAKRLDELAARGVRTLTIGLFDADNDQYLSKYRIAAGEFSAVSKTSDYVYSGIIPKPTDDAPSRFCIEHYFPRDFISRTDEFERRLYFLDEFDKRNGRHKSLPLYKISEKSTLIVDDKVFSIMTDDDRNYAMTKADFAEKVVSRTPPYEDADVNWFSPVFKMLKNFSLRYS

SEQ ID NO: 442 - protein, 541 aa, unidentified
  source 1..541: note = Related to JAFWYH010000002.1; note = Clostridia bacterium
MKDIKTYEDLCMVLEINQGYFYSVLNKIKNKKGYTKFSIPKKNGGAREILAPSPIIKSLQLKIKAYIEGKYFPHTCAKGFKKGCCNVDNAKMHVKRNWCLNLDLKDFFPSINFGRVYGLLMSEPFNANKKIAVALAHILCYDNELPQGAPSSPLISNLIAYSLDNKLLALAKEYHCNYSRYADDISFSSNSTHMPKQLVVFDDLIHEWIIGDDLQNTIESCGFSINHGKTRLLKKNQRQEVTGIIVNSKLNLNRKYYREIRSIFHKIKVNGIKEVAKQNHERYGKCKDNSEFGLISFINGKLAYYKSVVGEDNPCYNKLCKLYNNTIEYKYKNCKSSKQELIDNAMFIIETSEGQGTAFLLKDLGLVTCKHCLGFKHDDFCTEEELIIFNKQNEDIIYAYRVSNPENRFKLKLKKIFKESDLAILELLTDEILQYYFYPSKERLDIHSKNCTLLGFPNHSKGSSISEINNIQVSSKKAYFGRDYYCLDKPIITGNSGGPLLNEQNEVLGIACKGAGDITSASETDFNGVIPIELLYTEKDA

SEQ ID NO: 443 - protein, 690 aa, unidentified
  source 1..690: note = Related to CP074390.1; note = Cupriavidus necator
MTKLPSMDQIIEALVRSSPSFFSRRVLGMSYDHLKAIVYPRPSYQSFTIKKRDGTDRTIHEPRKPLKIIQVKVLAFLKERSSPLKPAVHGFVAKRSILTNALVHCSPKTKHVFNVDLEDFFPSITFYRVRGVLLHHPFNFSHQVATVIAHICTLDNVLPQGAPTSPFLSNLVCRTMDRDLTDLARRSMARYSRYADDITFSFRVSKTLKLPAAVCSVNGDGDLAIGTELHDIIVNKHHFKINSAKTRLSDRTRRMEVTGLTINRFPNVPRVFIDRIRGALNAWEKHGYDQADKAWQARITAAATGAYEKKPWKRQIRTGKAPALKNVLWGKLLYLRMVRGKDDLIYTRLAERYNAAAAATTAAGSFSAPTLPVEPVVRDKETALDACFVVDWYGDYKHPALGDEMPMAQGTAFVYRELGLIITCNHVFEWEGQVGKVDTVIDYESPYLTNKILQLIQPGTKKSWPAKVLFRDKPMDFAILAFAEEPPQHRYFSAMDTPIEPGAQGVLIGYPAWKQWTLPDFNDQKVLNRTSPHAGMNSFTITGAGSIRPGNSGGPFTDDRFRVAGMAQRGAYMGSGHDESLCFEIIDDLIAKYKASLVPPPAAISVPPAAPVIGSGAPPATPPASIPVLPAPPAPAPPNAGCTRTCRSADATGPTARVRRMNRTTAQADYAITRRRLSRSSDRLRSGTAV

SEQ ID NO: 444 - protein, 638 aa, unidentified
  source 1..638: note = Related to PDDY01000004.1; note = Burkholderia gladioli
MAILLGTDQITEALVRSNPSFFSRRVLGMPYDRLKAIVYPQPPYKSFILKKRDGTDRTIHEPRKALKIIQNKVLAFLEERSPALKPTVHGFVAKRSILTNAMVHCSHKTQHVFNIDLEDFFPSITFYRVRGVLLHHPFKLSHQLATVIAHICTLENVLPQGAPTSPFLSNLVCRSMDRDLADLARRSLARYSRYADDITFSFRVSKTLKLPAAVCSVDISGNLTIGTELHDIIVNKHHFKINSAKTRISDRARRMEVTGLTINRFPNVPRVFIDRIRGALNAWEKYGYDQANKTWQARVTEGATGTYEKKPWKRQTRGGQVPALKNVLWGKLLYLRMVRGKDDLIYTRLAERYNAMVATSTAAGQFSASTLPVEPVVRDKETALDACFVVEWYGDYKDPTLGEEMPIAQGTAFVYRELGLIVTCNHVFEWAGHVGTVETVIDYESPYLTNKVLRLIQPGTKASWPAKIVFRHKPMDFAILAFVGEPPQHRYFSAMDAPIEPSAQGVLIGYPAWKQWTPPDFNDLKVLNRTFPHAGMNSFTISGAGSIRPGNSGGPFTDDRLRVAGMAQRGAYMGTGHDESLCFQIIDELIATYKASLLPPLAASTLGAAAPPTTSPAPISHPPSHPAPPVQDAPASDT

SEQ ID NO: 445 - protein, 1224 aa, unidentified
  source 1..1224: note = Related to BKCJ010000001.1
MTTLSELNRCDVATFIDRLRGIYEHSPWIPERAATHRPFANETALKLALQAVVTHATEGEQLGLIREHPELAGKAAVAGELTMESTSEQAASGLHLCSADEYATLHQLNADYNAKFGFPFILAVKGPTGKGLTRRQVIAAFTRRLKNQRADEIAECLRQIKRIAEIRLNDLLGVSLEFGPAIMQWAETIAAWSDADNAADADFDLTCAYMTPAHRRTADQLRDWMTDAGMDAHIDAVGNVVGVYRSPVPGAKTLMTGSHYDTVRNGGKYDGRLGILLPIAIVRHLYLRGETLPFHLEVVGFAEEEGVRFKSTFLGSNAITGHFDLSLLDQVDADGVSMRDALTAAGHDVARIPALARQPEDILAFVEVHIEQGPVLLQRDLALGVVTAIAGSSRYLVQLTGLASHAGTTPMSMRKDAAAAAAEIVLLVEQRCAQGQSLVGTVGQLEVPGGSVNVIPGACKLSLDIRAADDAVRLAAVQDVLDGIASICAERQVAFALERIVDASAAPCAPHLMQQLGAAIERAGLPRFELLSGAGHDAMAMAAITDVAMLFTRCGNGGISHNPLETMTADDADIAARASHEVTPRATDRRLYNWAIIQVQEKDTGGRLLFSIRAYMAILPNMDQIIETLVRSSPSFFSQNILGINYNELRAIIYPRPSYQSFTIPKRNGTVRTIHEPSKTLKIIQLKVLNFLLERSSPLKPAVHGFVANRSILTNALVHCSSKTQHVFNIDLKDFFPSITFYRVRGVLTHHPYNFSHEVATVIAHTCTLNNSLPQGAPTSPYLSNLVCRTMDRDLTELARRSLARYSRYADDITFSFRVSKTSKLPAAVCSVDSDGDLVIGSELHDIIVNKHHFNINSAKTRLSNRTRRMEVTGLTINRFPNVPRVFIDRIRGALNAWEKYGYIDAEKKWQERVTSAATLAYEKKPWKRKTRAGRVPALKNILWGKLLYLRMVRGKDDLVYTRLAERYNAAVLTATSAGPFSAPKLPVEPVVRDKETALDACYVVEWYADFNDPTIGEEMPLGQGTAFVYRELGLIVTCNHVLEWNGEINNIGITIDYENKYLTNKVLKLIQPGTKKSWAAKVIFRNKQMDFAILAFADEPPPHRYFAAMDAPIEPEANGMLVGYPAWKQWALPDFNEQKVLNRTTPHAGMNSFTITGAGSIRPGNSGGPFTDDRFRIAGMAQRGAYMGEGHDENLCFQIMDDLISKYRATLRIHVAIPPASGA

SEQ ID NO: 446 - protein, 647 aa, unidentified
  source 1..647: note = Related to NZ_RSFB01000003.1; note = Burkholderia pseudomallei
MDQIIEALVRKHTSSFSQRVLGMPYDALKALIYPRPSYRSFTIKKRDGSDRTIHEPRKALKNVQLKVLAFLQERSSPFKPAVHGFVADHSIFTNALVHCSPKTQHVFNLDLEDFFPSITFYRVRGVLLNHPFKFSHQVATVIAHICTLDNMLPQGAPTSPFLSNLVCRTMDRDLTELARHGLARYTRYADDITFSFHVSKTSKLPASICSVDDDGALVVGSELRAIIVDKHHFKINAAKTRLSDRTRRMEVTGLTINRFPNVPRIFIDRVRGALRAWETYGYENAEKVWHARVAAAATGPYEKKPWKRQTRAGGPPALKNVLWGKLLYLRMVRGKDDLIYTRLAERYNAAVLNEQAAGAFVAATLPVEPVVRDKSNVLDACFVLEWYGDYSSPTLGEEMVGGQGTAFVYRELNLLVTCSHVFEWSGKIGKVDAEIDINDPCIATKTLQLVQPGTKKAWPAKILFRDKPMDFAIVAFEDPPPHRYFSAMDNPIEPSAQGFLIGYPDWKQWNLPDINGLTVLNRTMPHAGMNSFTITGAGSIRPGNSGGPFTDDRFRVAGMAQRGAYIGRGHDENLCFKIIDALIAKYKATLPSPPPLAPAVMAASAPASAAPIVVPTSTDALSATPSAAGATPIVPPSEGESPPPDAI

SEQ ID NO: 447 - protein, 639 aa, unidentified
  source 1..639: note = Related to CR555306.1; note = Aromatoleum aromaticum
MAILLSLDQIVEALVRSEPASFSRDVLGMPYDSLKAIIYPRPPYKSFTIKKRDGSDRTIFEPRKRLKVIQLKVLDFLQKRSTPLKPAVHGFVAKRSILTNAQVHCSPKNHHIFNIDLEDFFPSITFYRVRGVLLHHPFKFSHEVATVIAHICTLDKTLPQGAPTSPFLSNLVCRTLDRDLTELARRCLARYSRYADDITFSFRTRKTIKLPAAICSVDSDGDTVIGTELHDIIVNQHHFKINSAKTRLCDRNRRMEVTGLTINQFPNVPRVFIDRIRGALIAWESHGYAAANKVWNERVTAARSGAYEKKPWKRQTRRGQVPDLKNVLWGKLLYLRMVRGKDDLIYTRLAERYNSAVLITAATGTFTAPKLPVEPVVRDKETARDACFVVEWMGDYDEPGVGTEVPISQGTAFVYRELNLLVTCNHVLEWQNGEEGKFLAQIDYESPFLSDKALKLIQPGTKKSWDAKILYRNEQMDFALLAFEDPPQHRYFSAMDNPIEPGAKGFLIGYPAWKQWNLADVNSQTVLNRTSPHAGMNSFTITGAGSIRPGNSGGPFTDDRFRVAGMAQRGAYMGDGHDENLCIEIIDELIAAYKASLVAPAVLVPAASAAAPASPATAAPSAKPTAPPPAPTPPPPVMP

SEQ ID NO: 448 - protein, 664 aa, unidentified
  source 1..664: note = Related to NZ_QMFZ01000074.1; note = Burkholderia sp.
MAIVASIDEIIESLVRNNPAWFSRRILGIPYSTLKEIVYPRPPYKRFTIKKRDGTDRVIFEPRNRLKIIQQRTLKFLLDRSGPLKPAVHGFVSKRSILTNAQVHCSPKVHHVFNIDLEDFFPNISFYRVRGVLEKHPFNCSHQVATVIAHICTLDKVLPQGAPTSPLLSNLVCRSLDRDLTDLARRSFARYSRYADDITFSFPVRKTSRLPAAICHVDEDGDLLIGTELHGVITKHNFKINPAKTRLRDRSRRMEVTGLTINRFPNVPRRFIDRIRGALHAWEKYGYDAAEKAWSERVEKATTGPYEKKPWKRQMRRGRLPKLKNILWGKLLYLRMVRGKDDLIYTRLAERYNDAVLAAHAAGPFTAPRLPVQPLVRDKETARDACFVVEWLGDYQSAAGVTDDIPMGQGTAFVYRELNLLITCDHVFEGKANVGHFEVEMDYEDVELVNKTLNLVKPDTHQKWPAKILYRNAQMDLALLAFDHPPQHRYFSAMDNPIESGAQGILIGYPAWKQWNLPDFNDQKVLNRTTPHAGMNSFTISGAGSIRPGNSGGPFTDGRFRVAGMAQRGAYMGDGHDECLCFEIIDDLIDKYRASLVPPAPVPAPTPAVGAAAGLAAAMSAAPPAPIPIPAAVASYTEAPSVSASAIGSVATPVQPPPSDEPLM

SEQ ID NO: 449 - protein, 660 aa, unidentified
  source 1..660: note = Related to QXFE01000005.1; note = Burkholderia pseudomallei
MAILASLDQIIEGLVRNHTAWFSSRILGIPYSTLKGIIYPRPPYKRFTIKKRDGTDRVIFEPRNRLKIIQERTLKFLQERCGPFKPAVHGFVSKRSILTNAQVHCSQKIHHVFNIDLEDFFPSISFYRVRGVLEKHPFNCSHQVATVIAHICTLDKMLPQGAPTSPFLSNLVCRSMDRDLTDLARKSLARYSRYADDITFSFPVRKTSRLPASICHVDEDGELLIGTELHDIVTKHSFKINAAKTRLSDRTRRMEVTGLTINRFPNVPRVFIDRIRGALHAWEKYGYDAAEKAWSKRVVKAALMGAPYEKKPWKRQVRRGRMPKLKNVLWGKLLYLKMVRGKDDLIYTRLAERYNEAVLRAQAAGPFTAPRLPVQPVVRDKETALEACFVVEWLGDYQSTAGVTDDILMGQGTAFVYRELNLLVTCHHVLEGKANVGHFQVEMDYEDAELVNKTLNLVKPDTKQKWPAKILYRNAQMDLALLAFDYPPQHRYFSAMDNPIEPGAQGVLIGYPAWKQWNLPDFNDQKVLNRTTPNVGMDSFTISGAGSIRPGNSGGPYTDDRFRVAGMAQRGAYMGDGHDECLCFEIIDDLIAEYRASLAPAPVPAVSTAATSATVTAGTTPAAVSAPAAAAMSASAAIVPSSAMSSLGTLVQPPPRADDT

SEQ ID NO: 450 - protein, 643 aa, unidentified
  source 1..643: note = Related to QTPQ01000002.1; note = Burkholderia sp.
MRTHLSIEAILEELARQKVFWFSTHVLGIAYSELKAIIYPQPPYKHFTIKKRNGTDRVILEPRKRLKIIQEKVLAYLQNRAGSIKPAVHGFVRKRSILTNAQAHCSPKNHHVFNIDLEDFFPSITFYRVRGVLEKQPFNFSHEVATVIAHICTLDKKLPQGAPTSPFLSNMVCRTMDRDLADLARRNLARYTRYADDITFSFPVRKTSRLPAAICRVDDDGDVLIGTELHDLIANKHHFKVNSAKTRLSDRTRRMEVTGLTINRFPNVPRIFIDRVRGALHAWEKYDYAAASKVWSDRVVAASTGPYEKKPWKRQTRSGKVPELKNVLWGKLLYVRMVRGKDDLIYTRLAERYNAAVLKTRAAGPFVAPRLPVEPVVRDKTTAREACFVVEWWGDYQSAPGHTDDIPMGQGTAFVYRELNLLVTCNHVFEGVATVNKHSFNTDFDAPEMVNKTLTLVQPSTKQSWPAKILYRNPQMDFALLAFEDPPSHRYFSAMDCAIESGAQGILIGFPAYQQWNLPDFNEQKVLNRTLPNAGMISFTLSNSGSVRPGNSGGPFTDDRFRVAGMAQRGAYMGTGHDECLCMEVIDALISEYKATLASSAPVTPASALDAAPIVAPSGAVIAPRTAAPAPADPEGPRPPADA

SEQ ID NO: 451 - protein, 650 aa, unidentified
  source 1..650: note = Related to CAJQYY010000007.1; note = Paraburkholderia gardini
MASIPNFDAITESAVRSNIGFFSRRVLGISYDRLKAIIYPRAPYRSFIIKKRDGTARLIHEPRKRLKILQEKVLAFLDERSGPVKPSVHGFVRKRSILTNARVHCSPKTQHLLNIDLEDFFPSITFYRVRGVLRKHPFNFSHEVATVIAHLCTLDRTLPQGAPTSPFFSNLICRSMDRDLTELARHSLARYTRYADDITFSFHVRNAARLPAAICSVDAEGAVQIGQELHDVLVNKHHFNLNSSKTRLSDRSRRLEVTGLTINRFPNVPRIFIDRIRGALNAWEKHGYDAAEKTWQARVVAQSNGAYEKKPWKRQTRSGKVPELKNVLWGKLLYLRMVRGKDDLIYTKLAERYNAAVGAAQATGVFHAPKLPVQPVVRDKVTAQEACFVVEWYGDYNEPGIGAEMPYVQGTAFVYRELNVLITCNHALVWENEEGKFPAVIDYESAHLSGKVLSLVRPGTKEKWPAKVIYRNKPMDFALLAFDGAPPLHRYFSAMDNPIEPGAQGFLIGYPAWKRWNLPDINQQTVLNRTSPHIGMNSFTVTGAGSIRPGNSGGPFTDDRFRVAGMAQRGAHMGVGHDENLCIEIIDDLIAKYRASMVPPPPAAPAPADPAASVSAPVLGVPPPAPSAPAAPASSQNAAPVALPPPQTDT

SEQ ID NO: 452 - protein, 635 aa, unidentified
  source 1..635: note = Related to NZ_SSSP01000009.1; note = Rhodocyclus tenuis
MAIVKMNEMHEALSRNFVTWFSNNALGIPYSSLKGIIYPRPPYKQFVIKKRDGSARVIAEPRNRLKVIQQKVLTFLTERAGPFKPVVHGFVPKRSILTNAQIHCTPKNHHVLNIDLKDFFPSITFFRVRGVLRKHPFNFSHEVATVIAHICTLDGTLPQGAPTSPFLSNLVCRSMDRDLTDLARRNLARYSRYADDITFSFPVRKTSRLPAAVCIVDDDGHLQVGAELQDLITNKHHFTINPAKSRLRDRGRRMEVTGLTINQFPNVPRVFIDRIRGALHAWEKYGYEAADKQWNDLVKNAVTGAFEKKPWKRQTRRGKTPELKNVLWGKLLYLRMVRGKDDMIYTRLAERFNNAVLATHVAGPFSAPKLPVQPVVRDITTARDACFVVEWVGEFHSTPGTCDDVMCKQGTAFVYRELNLLVTCNHLFEHIATINKHEFPTDYEAPEIFNKTLNLVHPGTKQHWPAKILYRNAPMDLALLAFEGPVPPHRYFPAIDSPIEPGKQGILIGYPAWKQWNLPDFNDQRVLNRTSPHAGMNSFTITGAGSIRPGNSGGPFTDDHFRVAGMAQRGAYMGDGHDECLCIQIIDDLILKYKASLTLLTVPALAAVSPDEAAVAATSTPALTSPAPTTPAVTV

SEQ ID NO: 453 - protein, 594 aa, unidentified
  source 1..594: note = Related to NZ_VTUZ01000025.1; note = Paraburkholderia panacisoli
MLRNHVTWFSRNALGVDYEKLKRMIYPRPKYKHFTITKRNGSPRVISEPRKRLKIIQERVLAFLEPRSGPLKPAVHGFVPKRSILTNARVHCSPKNHHILNLDLQDFFPSITFYRVRGVLRKHPFNLSHHVATVIAHICTLDGTLPQGAPTSPFLSNLVCRSMDRDLTDLARRNLARYTRYADDLTFSFPLKKTSNLPAAVCVVDEDGGITLGAELHDLITNKHHFAINPAKTRLSDRGRRMEVTGLTINKFPNVPRIFIDRIRGALNAWERNGYDAAEKGWEERIGKAATGPYEKKPWKRQTRGGAAPKLKNVLWGKLLYLKMIRGNDDLIYTRLAERYNAAILKEMAAGPFSAPKLPVQPVVRDYKTAREAVFVVEWLADYHSSPGHHECPIEAQGTAFAYRELNLLVTCDHVLVGKAEFAGMEVPADFDAPEVVNKMLTVVRPETQESWAARVVYRNKQFDFAILQFEEQPPHHRFFSAMDTPIAPHADGVLIGFPAYQNWNLPDINPQKVLNRTLPNAGMVSFTIANTGSIRPGNSGGPFTDDRLRVAGMAQRGAYMGVGHDECLCFEVMDKFIGEWKAKSAAAAPPAVP

SEQ ID NO: 454 - protein, 636 aa, unidentified
  source 1..636: note = Related to JAEDZX010000001.1; note = Burkholderia plantarii
MVAIPSADALFESLARNNVNWFSHHILGISYAHLKRMIYPRPPYKHFSITKRNGSPRVISEPRRRLKVVQERVLAFLEARRGPLKPAVHGFVSKRSIVTNARAHCSPKNHHILNLDLQDFFPSITFYRVRGVLRKHPFNFSHHVATVIAHICTLDGTLPQGAPTSPLLSNLVCRSMDRDLTDLARRNLARYTRYADDITFSFPVKKTSRLPAAICVVDDDGGVTIGAELHDLIATKHHFTINAAKTRLSDRFRRMEVTGLTINKFPNVRRIFIDRIRGALNAWERNDYAAAEKGWQDRVQKASAGAYEKKPWKRQTRGSAVPKLKNVLWGKLLYLRMVRGKDDLIYTRLAERYNAAVDKEMAAGPFAAPKLPVEPVVRDHDTAEEAVFVLEWFGDYQSQPGHTDDMVMAQGTAFVYGELNLLVTCSHVFEAEAKVGKMMVPTDFQAVEMANKTLQLVRPGTQQAWPAHILYRNKQMDFALVAFDDPVPQHRYFSVMDNPIQARADGILIGFPAYQNWNLPDFNDQKVLNRTIPNAGMNSFTIANAGSIRPGNSGGPFTDDRFRVAGVAQRGAYMGTGHDECLCFEIADALIAAWKATLVPPAPPPAPAAVVPPPAPPPIAPAGHAPTAPPTPPTTP

SEQ ID NO: 455 - protein, 609 aa, unidentified
  source 1..609: note = Related to NZ_BMYS01000009.1; note = Advenella faeciporci
MVAITSAMALNESMLRTSVTWFSSHVLGVPYSQLMRMIYPRPPYKRFTITKRNGSPRAIAEPRQRLRIVQEQVLAFLKERSGTVRPAVHGFVVDRSIVTNAKVHCLPKTQHILNLDLQDFFPSITFYRVRGVLRKHPFNFSHHVATVVAHICTLDGKLPQGAPTSPFLSNLICRSMDRDLTELARRNRATYTRYADDITFSFNVRTASRLPVAICVVDDDGHVTLGTELHDLITAKHHFAINAAKTRLSDRHRRMEVTGLTINKFPNVRRIFIDRIRGALNAWERNGYEAAEQGWQDRVIIGGKVPYEKVLWKRQTRSRVVPKLKNVLWGKLLYLRMVRGKDDVLYTRLAGRFNALVDFEQSFGSFAAPKLPIEPVVRDHDTAQEGVFVVEWAGDYHSSPGRHEDTLQAQGTAFAYRELNLLVTCDHVFEVDATVGSLKAPTDYEAPEIVNKSLRLVRPGTKDSWPARIVYRNRQFDFAILQFEGPVPPHRYFSAMDTPIKPRADGLLIGFPAYQNWNLPDQNEQKVLNRTEPNRSMFSFTISGAGSIRPGNSGGPFTDDRFRVAGMAQRGAYMGDGHDECLCFEVMDTFVTAWRSSTKSTPTTSEIPA

SEQ ID NO: 456 - protein, 601 aa, unidentified
  source 1..601: note = Related to NZ_VIUO01000001.1; note = Herbaspirillum sp.
MPNPFLFPALTDSLIRNDVAQFSRRILGLPYSQLQKLIYPQPNYRVFTLTKRNGKLRSIAEPFANIKAFQLLILEYLTKKSSPFKPSVHGFVPHRSILTNANAHCSPRTQHVLNIDLQDFFPSISFYRIRGVLQKRPFNFSHAVASVVAHICTFDGSLSQGAPTSPFFSNLVCRSMDRDLQDLARRHKAAYTRYADDITFSFTTRNSLSLPKNICMEAPDGRVVIGAELNDLITVKHSFAINADKTRLSNRARRMEVTGLTINENPNVRRIFIDRIRGALRAWETHGYNAAQSVWQAKVAKSILAPHENKIWKRQTRTGSTPQLRNSIWGKLLYLKMVRGGTDPLYNHLAERYNAVVEIEKSLGTFVAPRLPVDPVVRDERGARKAVFVVEWFGDFELSATAADVVSGQGTAFAYRESNLLITCDHLFEATATIKDKSYPADINAPEIKNLALFAILPDIPKKTWPVRILYRNAYDDIAILCFEGEPPPHKYFNPMSAPITRNTNGILMGYPAYKQWNLPDFNRQSVLNRFLPAAGMSSFTITGAGSIRPGNSGGPFTDLEYRVAGMAQRGSYEGRGHDACLCFEIIDKHLQKWKASTTLN

SEQ ID NO: 457 - protein, 623 aa, unidentified
  source 1..623: note = Related to nan
MGLTIEQITKILIRSRVSDFCDEILGVPYSEIKKLLYPRAPYLFFELKKRSGGVRRIAKPTKRLKEIQLRVLEFLEKNRGPYKASVHGFISRRSIVTNARTHCSPKTHQILNLDLEDFFPSITFYRVRGALQSHPYHCSHAVATVIAQVCTVDGVLPQGAPTSPFLSNLICRSLDADLNNLARRNRAKYTRYADDITFSFATRSSTGLPAAICSVGADGRVTLGAELNDLITTKHNFKIKESKTRVSNRATRMEVTGITINKHPNVPRIFIDRVRGALNAWKKYGYAAAESAWQKRVRESGTVAYEKKPWKRQTRLGVPPLLKNVLWGKLLYLRMVRGSEDLLYTRLAERYNALVEFEQSIGPFSAPKLPVVPVVRDHKTAMDATFVVEWSADYRISKEDVDSIIGQGTAFSYRQQNFLVTCSHVFEGKATVGSMEVPVDIDTAELENLSIHVVHPHLKERWPAKVLYRNRQFDFAIMCFDGEIPPHRFYPALESPIEVRDEGMLIGFPAYKNWNLPDMNELAVLNRSEPHRGMRSFTITGAGTIRPGNSGGPFTDMRFRVAGMAQRGAYLGNGHDECLCFEVMDDLIAKWREKIAAECANATTKAAMAENKVDASGSLEQLP

SEQ ID NO: 458 - protein, 673 aa, unidentified
  source 1..673: note = Related to NZ_CADFFK010000002.1; note = Burkholderia vietnamiensis
MAAAVMEKDGRGRHPDLSEARIQSLEEVAERITRTDVPIFCRSVLGIEYRQLAPIIYPTPPYKHFAITKRDGSPRYIAEPRKRLKILQYKLLEFLTERMTPLKPAVHGFVPNKSIVTNALAHAHRRNHFILNLDLDDFFPTISFKRVRGVMMNRPFNFSFEVATVIAQMCCLNLKLPQGAPTSPFLSNLVCRTMDRDLTDLARRNRATYTRYADDITFSFIVRSRKSLPAAICTADDEGHLALGAELQELITTKHHFTINEAKTRLSDRNRRMEVTGLTINKFPNVRRKFIDRIRGALNAWERNDYAKVQKGWEDRIAAAEKLHVDLKPWKRQYRSGRLAQLKNVLWGQLLYVRMVRGKDDLLYTRLAERYNAVVAKERAAGPFAAKVLPVEPVVRDKTTLRDACFVVEWTGDYDEPGGGSEIPYSQGTAFVYRELNLLVTCNHVLEWENEDASKFPAMIDYESPYLTGKSLNLVQPGTRLSWPAKILYRNKPMDFAILAFEDPPPHRYFSAMDNPIQPGAHGYLVGYPAWKRWNLPDVNAQTVLNRTSPHHGMDSFTITGAGSIRPGNSGGPFTDDRLRVAGMAQRGAHMGSNHDESLCLEIINTLIDTYKATLAPPAPVGAADVVALPPAPAPIAVPSAQVAPVPTAPAEGTAAPIAPPTGAGAPDGLQPT

SEQ ID NO: 459 - protein, 612 aa, unidentified
  source 1..612: note = Related to NZ_AMPR02000466.1; note = Cupriavidus sp.
MEVNIFDLEEIGERLTRTDVPMFSRSVLGIEYSKLASIIYPTPPYKHFTIKKRDGSSRHLAEPRRRLKDLQYKVLGFLTERMTALKPAVHGFVPNRSIVSNANAHAHRKNHFILNLDLEDFFPSITFYRVRGVLTSRPFNFSHQVATVIAHMCTLHGTLPQGAPTSPFLSNLVCRTMDRDLTELARRNRATYTRYADDITFSFIVRARRGLPSAICTADDEGHLALGAELQELITNTHHFSINEAKTRLSDRHRRMEVTGLTINKFPNVRRKFIDRIRGALNAWERNGYAAAQKGWQDRIAASASHAYEERPWKRQYRSGGTAELKNVLWGKLLYLRMVRGKDDLIYTRLAERYNAQVQKEQEAKPFTASLLPVEPVVRDHATALEACFVVEWFGEYCSRAGVVDDIPMGQGTAFVYRELNLLVTCDHVFEAFANVNGHSFKTDYEAQEVINKTLNLIRPDTQQRWPAKILYRNAQLDFALLAFEDPVPPHRYFSPMDNPIERRSDGVLIGFPDWKQWNLPDFNDQKVLNRTEPNKGMISFTITGAGSIRPGNSGGPFTDNRLRVAGMAQRGAHMGSGHDECLCLDIINNLIAKYKAALTTVASTPTTYAVD

SEQ ID NO: 460 - protein, 661 aa, unidentified
  source 1..661: note = Related to NZ_CABPSF010000003.1; note = Pandoraea iniqua
MDIHSLDDLGELLTRTDVAVFSRSVLGIEYSKLASIIYPTPPYKHFIIKKRDGSPRYIAEPRKRLKVLQYKVLSFLTERMTPLKPAVHGFVPHRSIVSNAKAHTSRKNHFVLNLDIEDFFPSITFFRVRGVLTSRPFNFSHQVATVIAHMCTLGGKLPQGAPTSPLLSNLVCRTMDRDMTDLARRNRATYTRYADDITFSFSVRARRSLPQAICAADDEGHVALGAELQDLITTKHHFSINTAKTRLSDRHRRMEVTGLTINQFPNVRRKYIDRIRGALNAWERNDYAAAQKGWEARIAASTTLLYEQKPWKRQYRSGGIAELKNVLWGKLLYLRMVRGKYDSIYTRLAERYNALVQKEQAAGPFAAPILPVAPVVRDHPTALEACFVVEWLGEYHSTPGVSDDIPMGQGTAFVHRELNLLVTCNHVFEAVAHVNGHPFETDYEAVEVVNKTLNLIRPDTQQKWPAKILYRNAQMDFAILAFEDPVPPHRYFSPMDKPIERRADGTLIGFPDWKTWNLPDFNDQRVLNRTEPNKGMFSFTITGAGSIRPGNSGGPFTDDRLRVAGMAQRGAHMGSGHDECLCLDIINDLISKYKATLAPPAAHANAPAVSATMPAPVASPPIRLLAPLPLSDPAPEAPAQAASPPTAPPLAANSEPPLGDV

SEQ ID NO: 461 - protein, 658 aa, unidentified
  source 1..658: note = Related to NBTY01000203.1; note = Caballeronia sordidicola
MVIPSLNVIFEQLTRTFVPSFSQAALGIPYAQLKDIIYPSPPYKHFQIKKRNGSPRFIAEPRQRLKVMQEKVLTFLEERMSPLKPAVHGFVPKRSIVTNARAHCSRKTQFVLNLDLQDFFPTITFFRVRGVLRNRPFNFSHEVATVIAHMCTLNGSLPQGAPTSPFLSNLVCRTMDRDLTDLARRNRATYTRYADDITFSFAVRTASRLPAAICVVDEDGHLTLGAELQDLITGKHHFTINPPKTRLSDRARRMEVTGLTINKFPNVRRKFIDRIRGALNAWERNGYAKAESGWQARVANAESGPYEKKPWKRQTRTGAPPKLQNVLWGKLLYLRMVRGKDDLIYTRLAERYNKAVLKEQAAGPFKAPKLPVEPVVRDKVTAQDACFVVDWYGDYKDPTLGEEMPMAQGTAFVYRELGLLVTCNHVFEWEGKVGKADTVIDYESPYLTSKILQLIQPGTKKSWPAKILYRDKQMDFALLAFEGDPPQHRYFSAMDNPIESGAQGVLIGYPAWKQWTWPDFNDQKVLNRTFPHVGMNSFTISGAGSIRPGNSGGPFTDDRFRVAGMAQRGAYMGTGHDECLCLEILDGLIAKYKATLVPPVPPAPATVLGAPPTPAAGSAALPLPVPAAPAATVNGAAAPAARAPAHPVPAAPIPPTLP

SEQ ID NO: 462 - protein, 624 aa, unidentified
  source 1..624: note = Related to WBTZ01000029.1; note = Zoogloea sp.
MNLDAFDEMQKRTSVSWFSHIVLGTPYSQLKTVVYPKPHYKSFVIKKQNGGPRVIHEPRKELKLIQKKILAFLSERAGPIKPAVHGFVHKRSILTNALKHCSPTTHHILNLDLKDFFPSITFRRVRGALRKHPFDCSHEVATLIAHICTFNGTLPQGAPTSPFLSNMLCRRMDRDLTDLARRYRATYTRYADDLTFSFNVRSAERLPSAICMVEDGNVAPGTELTELITTKHGFAINPTKTRLNDRFGRMEVTGLTVNNFPNVRRNFIDRIRGALNAWETYGYAAAQLEWEKRNATYIAAPYITKLWRRQTRANFVPKLKNVLWGKLLFVRMVRGKEDALYTRLAERYNKACAAEQGTVPFVYEKLPIEPVVRDYGSAEDAVFVLEWMGDYHSSPGVFEDMVCSQGTAFAYRELNLFVTCDHLLSGAKAKVGTFEVEADYDAKEMVNKTLQLVHPFTKQSWPAKVLYRNAQLDIALIAFDMPQPPPHRYFAAMENSIRVRTSGILIGFPAYKNWNRPDFLEEKVLNRTEPNKGMASFTITGAGSIRPGNSGGPFVDDRFRVAGVAQRGAYMGDGHDECLCFEVLNQLIDKWKAPQAKSVLPENKIAATIVATSPGAVSTAAPQT

SEQ ID NO: 463 - protein, 601 aa, Thiobacillus sp.
  source 1..601: note = Related to JAJPEP010000007.1
MTTTLSTISLNDILLRHDVHHMSSKILGVPYSTLKALIYPLPPYKSFVITKRNGSPRLIQEPRRALKELQYKALDYFYEQCGLPKPCVHGFTKDRSIVSNAKSHCSDQTQHLLNLDLEDFFPSITFYRVRGVLQKKPFELSHQVATVLAHLCTFKGVLPQGAPTSPLLSNLICRSMDRDLMSLAKRHRATYTRYADDLTFSFSVRRSESLPSNICSFDGGNLTLGNELQAIIAAHSFRINAEKTRLSTRLHRLEVTGITINEFPNVRRVFIDQIRGALNAWEKYGYNLAQKDWERRITDGVASAYEKRPWKRQIRANSPPDLKNVLWGKLLYVRMVRGKDDVIYTRLAERYNAICETEDAKGPFAFSRLPVELIVRNAQDAERAVFVVEWSGDYQPEGNTAPLDVVLSQGTAFAYKDVGLVTCDHVLSYSGKIGGVTYTTDVQSSDVINKTLTVRNPVTGASWRVKVVHRDATRDLAILVFDEAPPAHRHFSSMVAPMNQGMRGILMGFPNWSPGRRVNQTKADVLSCYARSALKRFEISTNIRQGNSGGPFVDESYRVAGVAQQGARQDAGNDECLCVTDLDAWIAQWKASAMGTMAASS

SEQ ID NO: 464 - protein, 602 aa, unidentified
  source 1..602: note = Related to JACXUH010000009.1; note = Betaproteobacteria bacterium
MNDILLRNDVHYMSSKVLGVPYSTLQALIYPRPPYKSFTINKRNGSPRLIQEPRRALKALQYKVLDYLYEHSGLPKPCVHGFTKNRSIVSNAKAHCNRQTQHLLNIDLEDFFPTISFYRVRGVLQKKPFEFSHQVATVLAHLCTFNGILPQGAPTSPLLSNLVCRSMDRDLMALAKRHRATYTRYADDITFSFSVRRSESLPANICSFDSGILTLGHELQATIATHNFRVNAAKSRLSTRLHRLEVTGITINEFPNVKREFIDRIRGALHAWEKHGYDLAQRAWEKLVSDGAIGTYTRRPWKRQTRIGKLPPLKNILWGKLLHVRMVRGKDDVIYTRLAERYNAVCEAENVKGPFAYSRLPVGLIVRNAQDAERAVFVVEWDGDYQPIGSAAPLDMVSSQGTAFAYKDVGLITCDHVLSYSGMIDGKSFTTDVQSGDVINKTFTVRHPATGESWKVKVVHRDAARDLAILEFDDEIPSYRYFSCMAAPTNQNMRGLLIGFPNWSPGRPANQSKADVLSYYPRSGLKRFEISTNIRQGNSGGPFVDEFFRVAGIAQQGARQDGGNDECLCVTELDAWVAQWKAATTASISAPTLVEPVAKSFP

SEQ ID NO: 465 - protein, 595 aa, unidentified
  source 1..595: note = Related to JAHIHT010000028.1; note = Gammaproteobacteria bacterium
MAVHVPLTPSALHTLLIRNNLPYMSRHVLGVSYDTLQAMIYPLPPYKTFALMKRNGTPRVIHEPRQRLKVLQERVLAFLYEHAAPAKPCVHGFTPKRSIVTNAQMHCSQKTQHLLNIDIEDFFPSITFYRVRGVFQKKPFEFSFPVATVLAHLCTFSGVLPQGAPTSPLLSNLVCRSLDRDLMTLAKRHRATYTRYADDLTLSFSVRRAESLPSNICSFDSGILTLGHELQALIEHHSFRINPNKSRLSTRLHRLEVTGITINEFPNIKRKFTDRIRGALHAWDKYGYDHAQLEWERRVNKAAEEAYAKRPWKRQTRTRTVPALKNVLWGKLLYVRMVRGATNTLYLRLAERYNALCARERLKSEFVCSSVPIDSIVRNSNQAKKAVFVVEWYGELDGKDVGGLGTAFKYEDVGLITCEHVIKHQDHGPYADDIPRSEIFVRDAETDETWPVRIVHRDKDHDLAILQFDTANPPVSRHFIRGEKPITVNESGVLIGFPNPTRGRQANQVNAQVVNVFPRAGLPRFEIKERIRQGNSGGPFVDENYRVVGIAQQGAEQGKGNDECLCITEVNRWLDAWKTSLVVAVAVASAPDPIP

SEQ ID NO: 466 - protein, 565 aa, unidentified
  source 1..565: note = Oxalobacteraceae bacterium; note = Related to DPRS01000035.1
MSDQLFGITYSELQALLYPRQPYKTFIIAKRNGSPRVIHEPRIALKVVQEKLLHFLYENAGMAKPCVQGFTPGRSIVTNAQKHCSPRTLHLLNIDIENFFPSITFYRVRGLFLKKPFEFSHQVATVLAQICTYQGILPQGAPTSPMVANLICRSLDKDLTLLAKRHRAIYTRYCDDITFSLSVRDIAKLPVNICSFDSGVLTLGDELQSIFVKNSFRINPLKSRLGNRRHRLEVTGITINKSPNVKRSFIDSIRGALHAWDKYGYEAATAEWEKRPYKRQRRIGGIPSLKNVLWGKLLYVRMVRGGDDVLYTRLAERYNMLCEKEQAARKSFTYSSLPIEAVVRNAADAENAVFVLEWLGDYKGEPVGGQGTAFAYKDVGLLTCEHVFHTVTENGEPVSFDEVKGATLTLQNPSTGKFWPAKLIHKDPYRDLAVVHFDTRIPPAHRHFSALEAQINRNSKGILIGFPNWSPGKRANQLYVTVLNRFPITGLQRIEINGSVRKGNSGGPFVDELFRVAGVAQQGATQANGNDQCLCVTELDKWLVEIKGLAHGLSLDALPDTPVAD

SEQ ID NO: 467 - protein, 581 aa, unidentified
  source 1..581: note = Related to JACVPM010000001.1; note = Polynucleobacter sp.
MTVNFHEILIRCDVDYMSKHIFSTSYADLAKLIYPSPRYKAFVISKRDGTPRVIEEPFRKLKRLQYKLLDYLSRNSSTPKVCVHGFIKERSILSNARVHCSSKTSYLLNVDIENFFHSITFYRIRGVFQGEPYNFSYEISTVLAQLSTFNGRLPQGAPTSPFLSNLICRSLDGELMRLAKSHRGMYTRYADDLTFSFSARTPLGLPKNICEFDGGNLHIGNELLSIIEKNSFKLNEKKSRISSRKHRLEVTGLTINEFPNVRRNYVDQIRGAIHAWDVHGYEAAQKRWIEKNNVAVKVRQTRNLYAPQLKNYLWGKLLHLKMIRSRGDPIYTRLAEKYNTLCAKESGKGFIFAPKLPIEPIVRNANDIESAVFVLEWSGDYILNEASPEHTEVVGAQGTAFIYKDFGLITCDHVLSSMLRIGGVDVSVDIDSDRILNKKLYVCNPLLAKSLPVRVIHRDRHLDLAVLEFVDGVVGNRYFSSAERPILRNEQCTLVGFPNWTVGRGVNLLPVSVVIRFFRSLFNRIEISGAIRKGYSGGPLIDSSFRVIGIAQEGATQADGNDECLCITEVDKWLSGLTVRP

SEQ ID NO: 468 - protein, 621 aa, unidentified
  source 1..621: note = Related to NZ_AP018441.1; note = Undibacterium sp.
MKDVEVATAWAHMTDSDIHFDVLNLPFREALIRTNVEFMSRYLLGIPYSEVKKIIYPTPSYKIFLITKRNGKARIIQEPRKALKELQLKVLSFLETRGGNPKACVHGFTKRRSILTNALRHCSTQTHHLLNIDLQDFFPSINFFRVRGVFQSKPFECSYSVATVLAHLCTHRNELPQGAPTSPILANLVCRKMDSELMALARRHRATYTRYADDISFSFSIRDAVRLPENICRFESGTLTLGQELQSIILENSFNINSTKNRLSNRLNRLEVTGITINEFPNVKRNFIDRIRGALHAWEVFGYIKARDQWDALISEGLRLTREKRIWLRQRRTRAVPELANVLWGKLLYLRMVRGADDAIYTRLAERYNVLCAKEVEEGRNFFFSKLPVEPIVRNSHDVDHAVFVVEWGGLYPVEGAKAPEFVCGQGTAFLYQSNNCLVTCEHVFRYKESVKITKYGEEVEEILDTGYMSPDVYEKNITIHSPVRGQTWDAKLVHYDSDRDLAILEFVSPPENVRHFTSLDAPIKKNEPGYLIGFPNWNPGRFSNQTNASVLNRFPRKGLQRIEVSTNVRKGNSGGPYVDELFRVAGIAQEGATQSGGNDECLCVSELNTWLKNSTNKKET

SEQ ID NO: 469 - protein, 573 aa, unidentified
  source 1..573: note = Related to JACHCH010000008.1; note = Janthinobacterium sp.
MSKNLLGMPYSEIQKIIYPTPPYKVFVITKRSGGPRLIQEPRRKLKELQLKVLAFLEEHGGKPKPCVHGFTKNRSIVTNARKHCSRQTQHLLNIDLKDFFPSIGFFRVRGVLQKRPFACSHSVATVLAHLCTHRNELPQGAPTSPMLANLVCRRLDSDLMDLARRHRSTYTRYADDLTFSFSVRDTSRLPENICAFESGGLTIGHELLSIIDKHNFDINPTKSRLSTRLHRLEVTGITINEFPNVKRIFIDRIRGALHAWEKHGFDAASAEWERRITKGKTCIYEKRPWKRQTRTRKIPELINVLWGKLLYVRMIRGADDVIYTRLAERYNVLCEHEQGLSADFSFSRLPIESIVRNANDAERAVLVVSWLGDYQPVGVAESEAVGGQGTAFPYQSNNCLVTCDHVLRWEGVVNENNVSTDCTSVDVHGANLKVISPALGLEWPVRVVHRDVDRDLAILEFIGPPPNIRHFAGLDAPIKRNETGYLIGYPNWNAGRVANQVNVVVTNRFARRTFQRLEISTTIRQGNSGGPFVDDLFRVAGVAQEGATQVSGNDECLTVDELDTWIATWKTRN

SEQ ID NO: 470 - protein, 579 aa, unidentified
  source 1..579: note = Related to JACOGB010000003.1; note = Undibacterium sp.
MSTFPLGILTRNFVESLSANLFGMPYSDLQKIIYPSPRYKSFIINKRNGSPRVIHEPRAKLKALQDKVLLFLEENAAPVKPCVHGFIIGRSIVTNAKKHCSPQTKFLLNVDLKNYFPSINFYRVRGIFMKKPFSCSHAVATVLAQICTHNNELPQGAPTSPFLANLASRRLDTELMDLAKRHRASYTRYADDLTFSFSVRKASSLPENICSYDSGVLTLGKELISTIEHNSFNINPVKSRISTPLHRMEVTGLTINEFPNVKRNFVDWVRGTLHAWDKYGLAATQVEWERKMEAAKTSPYEKKPWRRQRRCKGFPSFYKILWGKLLYLRMVRGPNDALYTRFAERFNGLYQRDMGGAALLLPIENIVRNAADVERAVFVVSWMGDYQLEGGASEFCASQGTAFAYMSANKLITCEHVLRCELEVNGQVLMVDFQDAQMRNGEMTAHSPTLGFSVPVRVVHRDQDRDLAVLEFVNPPPANIRHFVGRDSLIKRNEHGILVGYPNWNPGRIANQAAANVLNRFPRRGLQRIEISTNIRRGNSGGPYVDELFRVAGVAQEGATQADGNDECLCVEELDKWLD

SEQ ID NO: 471 - protein, 597 aa, unidentified
  source 1..597: note = Burkholderiales bacterium; note = Related to JACPOI010000015.1
MKDVEVTPPMPVVSSPIDLHGVFLKVDADYFSRHVFGVPYSSLKAVLYPTPRYRAFIIAKRNGSPRIIHEPKRQLKEFQLKLLSFMESQVTQIKPCVHGFVKGRSIVSNAERHLETQPHHLLNLDLEDFFPSISFYRVRGVFKKAPFGLSHEVATVLAQLCTYSNSLPQGAPTSPMLSNLVCRSLDRDLTALARRHRATYTRYADDLTFSFTVRDPNRLPSNICSFDSGIVNLGHELQALIQEQHHFRINPKKTRMSTRFHRMEVTGLTINEFANVKREFIDRIRGALSAWKKYGYGKSQASWQDRVIDGQTKPYEQRLWRRQVRGGGVPELKNVLWGKLLYVRMVRGRDDSIYTRLADLYNELCKQEKKVDKDFLFSSLPVEKIVRNAVDAERAVFVIEWSGDYCPPGASASEMVGGQGTAFAYKKADQLITCDHVFNWEGQYAGASVSVNCQSSDVHGLTLRAVNPATGLSWPVTIVRRDAPRDLAVLQIAGGSLAHRHFVAIEAPLKRNTRGFLIGYPNWSPGRVANQVTANVQSLYNRSALARFEISTLIRQGNSGGPFVDAQFRLVGVAQQGATQQSGNDECLSVLELEKWL

SEQ ID NO: 472 - protein, 587 aa, unidentified
  source 1..587: note = Related to JACIBG010000006.1; note = Variovorax sp.
MAFLGVKEFHDYMLRSDVPYFSRHIFRAEYSSVEGYLYPHPRYTSFVLAKANGKNRFIAEPSKKIKELQYRALRYLEKTVPQPKACVHGFVEGRSILTNARKHLERRPYHILNLDLTDFFPSITFFRVRGALMAPPMKFSFGVATMLAHLCTHEGTLPQGAPTSPFLANLICRSLDSQLTLLSKRHRATYTRYADDLTFSFSHRHANRLPANIVNFDGGTVSIGSELRSIIESNSFGINNDKTRVSTRMRRMEITGVVVNEDPNVTRKFIDKIRGALHAWDRYGYVAALANWNARVAETLKEPRAGKQWARQTRTGNIPSLQNVLWGRLLFVRMIRGDDDLLYTRLAEKYNHLCRTHKAIDPEFRAASLPIALQVKNSLDADFATFVFEWSADYAASDAHESEPLVSQGSAFAYGDGRRFITCDHVLKGQSADGEVDVANPRVRNLTMNLRNPVTRIDFQARVLHRDAHLDLAVLELVDPAARAKRYFDGRTEPLERDARARLIGFPNWTQGRTANNSVVSVQQRFPRAGLQRIEIGGSMIRQGNSGGPLVDASYKLAGVAQQGASQSSGNDECLCIMELDRWLASL

SEQ ID NO: 473 - protein, 586 aa, unidentified
  source 1..586: note = Related to NC_022247.1; note = Variovorax paradoxus
MAILGKNEFHDFLLRADVPYFSRHIFGAEYWKIEGLLYPTPRYTNFVIAKANGKNRHIAEPSKKIKALQYRALAYLKGTVPPAKPCVHGFVEGRSILTNAEKHLERRPYHILNLDLSDFFPTITFFRVRGALMAPPMKFSFEMATMLAHLCTHEGSLPQGAPTSPFLANLICRTLDSQLTLLSKRHRATYTRYADDLTFSFSHRSAERLPANVVAFDGGTVSIGSELRSIIESNSFHINEGKTRISTRLRRMEITGVVVNEFPNVTRKFIDKIRGALHAWEAHGYVAAQATWTARITEKLKNPPRERPWARQTRTGNIPSLQNVLWGRLLFVRMIRGNDDLLYTRLAEKYNHLCRLHQTIDPGFRGASLPIDLQVRNTLDVDFATFVLEWSGDYTAPGTDESEPLVSQGTAFAYGTGRRFITCNHVLTGQSKDEEIDISNPFVQNVSIVLRNPLTGTVSPARVLNRDSARDLALLEFVDSETRAQRYFDGRPEPLERSAQARLIGFPNWTPGRTANNTEVSVQHRFARAGLQRLEIGQTIRQGNSGGPLVDSSYKLAGVAQQGASQSSGNDECLCVMELDRWLTAL

SEQ ID NO: 474 - protein, 642 aa, unidentified
  source 1..642: note = Related to NZ_CP017754.1; note = Cupriavidus sp.
MNTPNTILIQALVENQDLMDAWERMDVHVFSTGVLGVPYEQVQKILYPHPPYRAFLMAKRSGGFRLIREPRRRLKVLQEKVLAHLYERAGTPKPCAHAFIKDRSIVTNARRHLERRPTFVLNLDLEAFFPSISFYRVRGVLKKPPFNYSHEVATVLAQMCVVGNELPQGAPTSPFLSNQVCRSMDRDLMALAKRHRATYTRYADDITFSFSAPTRAALPSNICTFDSGVVTLGQELVGIINQHNFQINPSKTRMSTRRRRMEVTGIVINEFANVKRIFIDKIRGALHAWDRYGYAAAQAAWEQRVTNGTTLAYEKRPWKRQTRTGQTPALKNVLWGKLLYVRMVRGDSDAIYTRLAEKYNRLVARERDGNADFAASTLPVEAIVRNVEDAERAVFVVEWAADYQPPVPGQPTMVGGQGTAFAYKQRNRLITCDHVFRAEGEYQLGDGPNAQEIPFTTDINEAAVQGLNVTAIDPVSGQRWPLRVVHRHAHRDLALLEFEGAPPDHRHFSGMEAPINRHAPTHLIGFPNWNNGRRANIEPAIVTARFPRTGLQRFEINQLIRKGNSGGPVVDELFRVAGVAQQGAQQDAGNNECLCVLELDAWLAEYDADVAAPADVPAAEPAAPAAAAEAPAAPVAPAEPAA

SEQ ID NO: 475 - protein, 628 aa, unidentified
  source 1..628: note = Related to NZ_CABPRY010000003.1; note = Pandoraea cepalis
MTTPLLTAKDAAEAAKWAEIWARTDVHLFAADVFDLAYEEIQNIIYPTPPYKAYLLAKRSGGQRVIREPRRRLKDLQVKLLKYLIERAGTPKPCAHAFTEGRSIVTNARKHLERRPHFVLNLDLEGFFPSISFYRIRGVLRKAPFNLAHPVATMLAHMCTVNNELPQGAPTSPFFSNQVCRSLDRDLMALAKRHQATYTRYVDDITFSFSTPNQIALPANICTFDSGVVTLGQELVGIIGQHNFRINPAKTRMSTRRRRMEVTGIVINQFPNVKRAFIDKIRGALHAWDRHGYKAAEENWQARVSNGARLAYEKRPWKRQARLGQPPELKTVLWGKLLFLRMVRGADDTIYTRLAEKYNRLVERERAGDAPFVSATLPVEAIVRNAEDAERAVFVVQWLADYHPPNAGTQEAVGGQGTAFAYKRHNRLITCDHLFRADGEYRRGEDPQAPRVPFTTDLTSPQVRGAMVSVTDPVTGQEWAVRVVHRDAHRDLAILEFDEEPPAHRHFSGMDAPITRHAPGHLVGFPNWNNGRRANIEHAIVSARFPRTGLQRFEINQLIRKGNSGGPFVDELFRVAGVAQQGAQQDAGNNECLCVAELDAWIEAYEATRVRPPPAPPAPAAVERGPAA

SEQ ID NO: 476 - protein, 606 aa, unidentified
  source 1..606: note = Related to NZ_CDQJ01000001.1; note = Ralstonia solanacearum
MLQKTQVNSFSSAILGAPYATVQGILYPRPPYRSFELAKRSGGIRVIREPRKRLKLLQLKALEDLEQRAGRPKPCAHGFVKDRSIVTNARKHLERKPHFLLNLDLEKFFPSINFFRVRGVLKKPPFGFSHEVATVLAQMCVLDNELPQGAPTSPFLSNEICRGLDRDLMALARRHRATYTRYADDITFSFSTPNATSLPANICTFDGGLVTLGQELISIITSHSFQIHPTKTRMSTRRRRMEVTGVVINEFPNVKRVFIDRIRGALHAWDRYGYDLAQKAWANRVQAGASTAYEKRPWKRQTRSGNPPELKNVLWGKLLFVRMVRGADDAIYTRLAEKYNHLIQRERGTKPDFAASSLPVEAIVRNAEDAERAVFVVEWSGDYLPTGTTEATMAYGQGTAFAYKKKDRLITCDHVFTARCEIAGASVDVDIQSKDLREVSLEAHDPATGNRWPLRIVHRDAPRDLAILQFEGEPAAQRFFSGMDAPINRHAPGHLIGFPNWSPGRRANVEPAIVTNRFRRSALQRVEINQLIRKGNSGGPYVDELFRVAGVAQKGATQDDGNNECLCVAELDAWINASGEAPPPAASTASAGGGRAGEPLRRRPTR

SEQ ID NO: 477 - protein, 557 aa, unidentified
  source 1..557: note = Related to NZ_CP090000.1; note = Xanthomonas translucens
MHVFGVQYSELEKLLYPRPSYRAFLIPKKDGGLRAIHSPRLHLKIIQKKLLEYLERVGNPPKASAHGFCKDRSIVTNAAKHSLARTRFILNIDLENFFPSINFFRVRGLLLAPPFGLSYPVASLVAHICTYQNELPQGAPTSPYISNQIARSLDRDLMNLAMRHRATYTRYVDDITFSFSVRSEAALPANICSFDSGILSLGAELQALIAKNGFKLNEKKSRISSSRRRMEVTGLKINRFPNVRRNFIDEIRGALKACETHGYLNADAHWKRSFRSDFGVKRANTYRALRDDKYQPELKDFLRGKILFVKMVRGEDDLIYNRLAERFNAVMPSTTVRPLKVYPVVKTEDDLRRACFVIYWQAAIMDTASGERKMLSGQGTGFLYGDGNLITCDHIFYDTTALEGVQKDVHITDRELEDIKCVAIDHQHMEHDLTLMRWDVPRDLALLHFDRNAPHNKHLTPALSSAKRHDRGWLAGYPDWTSGRPANVVEAQVDNSYVRSGLARLELNQTIRSGYSGGPYVDKSYRLIGIAHRGATQSSGTNECLASHELDKWIASP

SEQ ID NO: 478 - protein, 568 aa, unidentified
  source 1..568: note = Related to RBIT01000001.1; note = Acidovorax sp.
MADAFDEMVLAIDVRYFASTVLLEDYKKIAALIYPKPRYREFNIPKKSGGKRAIAAPRKKLKILQQRLLSYLVAKIDPPKACVHGFVPGRNVVTNASKHSERNPRFILNVDLENFFPTITFYRVRGVFLKRPFNLSYSVASMLAHLCCHNGVLAQGSPTSPILSNLVCRKLDNDLSALARKYRAVYTRYCDDITMSFVAKMADNLPANICSFNGEAVNIGDELKAVIAANGFALNDEKSRLSSSSHRQEITGLTVNDFPNVRRQYIDSIRGALHSWEVHGYKLAEARWQETPYKRIRVSNTVPKLCFNLKGRLLYLKMVRGGDDEIYGRLASKFNKLVAIGVVGEVPPCKPLPIDYSVTTANGARHAVFVLQAQWFEKNELIFERQGTAFFVGQGYLLTCEHVVSNELSSDEKDDAMGELEQARHTVLIPGGKEYPVELVAVHEHYDVALLKFSGDGPEYIRRFKLSQASATVGQKSCLLGFPNWSNGRPVTVVNGEVTSVYSRSATQKLETSQQIRKGNSGGPLLNAELEVVGMATDGATYEKGNNECLTSGQIRQWLIDIKAEVQL

SEQ ID NO: 479 - protein, 553 aa, unidentified
  source 1..553: note = Related to NZ_FMZC01000029.1; note = Acidovorax valerianellae
MEYEKVGSVIYPSPLYTQFTLPKKSGGVRIIDAPFQELKELQHKLLVFLKTLVDPPKSCVHGFVSGRSIVTNALAHSERSPKFVLNIDLKNFFPTISFYRVRGIFLKRPFSFSHQIASLIAHMCCKDGFLVQGASTSPLISNLICRNLDNQLRGLSLRHNSVYTRYCDDLTFSFPRERAESLPGSICSFAGEIVTLGAMSLEIIASNGFEINSDKTRISSSKRRLEVTGLVINKFPNVSRDYVDRLRGALHAWDVHGYPRALRSWKNKIPYERAGRRPRPPLAGIVRGRLLFLKMVRGADDDLYVRLATKFNILRQRDSIYRKIRALKSLSVDSVAKTATAARKAVYVIEVVWTDAADDMPLVDRRGTVFVTEYDLLISCHHVIDPDFSDDERKEISGKILNRSVKLIVPETNDTYSIDVIKFDSHLDIALLKFSEAKPAGLRKLLFSERSPVQSSGTTLLGFPNWKQGRPLTSASGEITSIYPRSNTNRLEASQAIRQGNSGGPLVDPDFRVIGMAIEGATYDRGNNECLAANEIINWIQPEVDKLKSQLKF

SEQ ID NO: 480 - protein, 575 aa, unidentified
  source 1..575: note = Related to NZ_AP025556.1; note = Delftia lacustris
MASLEFDIRKIDVELMAQDIFGRPYAEISKIVYPRPKYKYFVLPKKSGEYRSIVAPSLKLKNIQESLLDFLQREFPLAKSCVHGFHRGRSVVTNAQAHCNRDTSFVLNIDLEDFFPSISYYRVRGVFENSPFGYARNTASALAHICCNNGILAQGAPTSPIISNLICRGLDKDLSALARKHRAIYTRYCDDITFSFKSGRVDRLPASICKFDGDVLGIGDELTEIISSHGFRIKHTKNRISSRQRRMEVTGIVINKFPNVRRLYVDKIRGALHAWETYGYEMASKIWEEKKYSRSLRTGAIPRLYKNLYGKLLYLKMVKGDSDDVYRLLAMKYNRVFLKSQSLGELGDGKLLSLGSRVVNASHVKSAVFVIHARWGLDELGLPEEEVQGTIFCLVGKILITCSHVIEKPEHIKTDTVEYYLVEPTSGKEHRLNLICNDSHKDIAVLRFVEQGVPDARELVLSEQPISQNADVMLYGFPNWTRGRALNSLPGTVTSTFIRSNIDCLEVDCSIRQGNSGGPLLNVGMRLVGMATQGADVKSGNNECVTVSEIRDFILRCSTSHPLHFDKSFNISNLF

SEQ ID NO: 481 - protein, 566 aa, Nitrosomonas sp.
  source 1..566: note = Related to NZ_FOUB01000063.1
MAIHKNIFSKISTLDELAYKLAGIPYNLLAKLIYPTPRYKCFDLIKKSGGVRTINAPRRKIKKIQRETLELIKEYYQSVKSPVHSFVKDKSIVTNAQQHIGKSFIFNIDLENFFTSIHFGRIRGIFLKKPFEFSYDISTVLAHICSKDGILPQGAPTSPIISNLICRSLDSDLQKLARKYRATYTRYCDDITFSFTVRRISDLPKQIVDLSVAPANIGTELLAIIDKHELKVNSRKVRLEGRSNRMQVTGLTVNEQPNVPRTFVHEIRGMLHAWERYGLKKAQDQLKTKYSRQLRTTEIPPFYNVLRGKLLFLKMVIGETSLVYARLAMRYNKLIDRDNLKQNSKLPLSREIANDIDAKRAVLAIECCEDIPRLKESPLVSMGTAFIYRKKYIITCWHVISQKVESLGEDITFHETSIELYDYKKKKLEVTILAGCPRRDVAILAPKFDITVYPYFSPATTPPLSGDSLQMLGFPNYQVNKKISYTKTKLLTEEYTKSCVQYIEIRDTIRKGNSGGPVFNSNWEIVGIAVEGATQADGDNGVVVTSEIDRVIDSSEFKYQQKDKNH

SEQ ID NO: 482 - protein, 559 aa, unidentified
  source 1..559: note = Betaproteobacteria bacterium; note = Related to JAJFTF010000030.1
MAIHTPLSTIPDLEKLADRLVGNSYSVLADLIYPKPRYKTFSIAKKSGGIRTIDAPKKKIKAIQWKTLALIKEYYQCVKTPVHGFAKGKSIVTNAQQHLEKTFVFNVDLEDFFPSIHFGRVRGIFLKKPFEFSYDIASVLAHICCKDGKLPQGAPTSPVISNLACRRLDSDLQELARKYRATYTRYCDDITFSFSVKRITDLPKQIVDQRAFPVNPGTELLAIIEKHSFRVNSGKVRLEGRSKRMQVTGLTVNEQPNVPRIFVHEIRGMIHAWERYGRNGAETYLASKYSRQLRNPVSPPFHNVLRGKLLFLKMVRGASSPVYARLAARYNSLIDHDKLQPNSKLPISRTVANDIDAVRATFAIECVQDFPELAGLELSPLVSSGTAFIYREKYIVTCWHVISPRIEKLGKSFTFDEASIEIYDYKKKKLQVTVLAKCKDRDVVILAPKFDVTEYPYFSPAQLSPSSGDILQILGFPNYQMSKKVSRTKTELITEQYAKHGVQYIEVKDTIRKGNSGGPVLDSNRGVVGLAVEGATQAEGDNGVAVTLEIDHVIDSIVV

SEQ ID NO: 483 - protein, 561 aa, unidentified
  source 1..561: note = Planctomycetes bacterium UTPLA1; note = Related to MWTD01000011.1
MPAPLSKEATQLLTLKTHEDVARFFGYPNYVSLQSLIYPRPLYTSFVIPKRTGSIRIISAPRRRIKDVQRLLSTALLDLYGHGRKPVHSFMKGRSVVTNARQHAQSRFVLRVDLRDFFGSIHFGRVRGVLLNRPFALPEPVATVLAHICCLDGKLPQGAPTSPIISNLVCRGLDTALMKLAGECRATYTRYCDDLVFSFSIRQAGKLSARIVASEGGVVGVGHELETAIKREGFEINVAKTRLYHYGARQTVTGLVVNEFPNVSKKYYRSLRTALYAWEKHGYESASLNVPGTIQHRRYRSGKPRCLHRLLWGKLQYMRMVKGERDASLISLVHRFNRLLARDAAVVEKPVPPAIHVKPTVARAKDARAGTWMLEAITHRDTPDELLNEGTAFYVRGVGFITCAHCLLNTYVSPPTAHNEFFLHSHDRRYKYQVTPHQFDYGLDLAVLAPDSSFVENEHLAFEIDPALPAVGTAVVLCGYPGNSPSRPPVIYQSDVSRTVTVSGVSRIEIDKPVHPGSSGGPLLSALTGKVLGVVATFKKGDAGADAAIAIAEISRLGAPK

SEQ ID NO: 484 - protein, 547 aa, unidentified
  source 1..547: note = Related to NZ_CP038033.1; note = Nitrosococcus sp.
MNKEDFLKITTHNELASMFGMSYAKLTKIIYKTDGVYKYHQFQIPKKNGGHREIASPSKKLKKIQSELKELFYEIYPSKPSAHGFAKNKSIVTNAERHLDKRFIFNIDLSNFFGSIHFGRIRNLFKSSPFNFNNSIATILAQICCFDNSLPQGAPTSPILSNMIAWKLDTQLQSLAKMTNGTYTRYADDISFSFTTTKGRLPEEIVILRGGEAAPGHALTHIIEENGFFINYDKVRLCSRLSRMEVTGLTVNELTNVRRKYVRQLSSMLHAWRKHGYELAEKDFNEKYDTRYRASGKPKSFLHVVKGKLAFLRSVKTERDPIYIKLATQFNDLVTDEHKFKIKVPSDPEKNAINALWVIEACYDNEEGEAMVPQGSGFQLEDIGIVTCAHVVSEKGKIFEDLEAFKHDDSTVKYKLRVERICSHRDIAICSLLVEEGKEPPKHSVSRSANNVEMGQDVKLLGFPAYAPGHSYFMVDTKVAKIYTQSLVRKFEINALIREGNSGGPIIDSKSSVVGIALEGARKEAGNNGCLTIPELEDVLSDDKYKI

SEQ ID NO: 485 - protein, 547 aa, unidentified
  source 1..547: note = Gammaproteobacteria bacterium; note = Related to QNFF01000108.1
MNKDDFLKITRHNELASYFGITYPVLTKIIYKTDDAYKYHQFQIPKKNGGYRKIASPSKKLKLIQEQLKDVFYEIYPTKPSAHGFAKDKSIVTNAERHLDKRFIFNIDLSDFFGSIHFGRVRNLFKSSPFYFNNTVSTILAQICCFNNSLPQGAPTSPILSNMIAWKLDSQLQHLAKLTNSTYTRYADDISFSFTSKKRRLPEEIIILRDDEGSPGHALTHIIEENGFNINYEKVRLCSAFSRMEVTGLTVNEFLNVRRQYVRQISSMLYAWRKHGYVLAANEFNEKYDKRYRASKKPKSFLYVVKGKLAFLRSVRTGRDAIFNKLAKQFNDLVEDEYKFKIIEVTDPEINAISALWIIEACYDDEKGEAVITQGSAFQLKGIGIVTCAHVVSEKGKVFGSLEAFKHSDPTVRYELKVERICAHRDVAICSILVKEGIEPPEYGIEKSLNPIEMQQSVKLLGFPAYAPGQSHYIVDSKVAKVYKQSAVNKFEIDSLIREGNSGGPIIDAESNAVGIALEGARKESGNNGCLVISEIDDVIGTDEYKI

SEQ ID NO: 486 - protein, 547 aa, unidentified
  source 1..547: note = Related to NZ_SOQX01000007.1; note = Thiohalophilus thiocyanatoxydans
MKDAFLNIKTHQELAKYFGLSYADLSKIIYKTDFEYKYHHFVIPKKSGGERHINAPSKKLKLIQITLKDVLYDIYPTKPAAHGFVKNKSIVTNAEKHLDKRYIFNIDIENFFGEIHFGRVRNLFKSSPFNFNNTVATILAQICCFENALPQGAPTSPIISNMIAWKLDSQLQQLAKITNCTYTRYADDISFSFTCNKNRLPEEIVSVSEGDARPGRTLTGIIEDNGFRINYSKVRLRGKYSRMEVTGLTVNEFINVKRKFIRQLSSMLHAWRKFGYDKAEEEYNNKYNRKHRASGKETSYLHVVKGKLAFLNNIRSKRDPVYIKYAKQFNELVGNEHKFIIVEITEPEQNAINSIWVVEACYDYNDEVRVSQGTGFHLSDVGIITCAHVVSNDDGEIYEEIEVFKYSETTKRYTIKVDRICRHRDIAICSLVVDEDENPPNNELQKSQSIPYIQQQVKLLGFPGYAPGHSYSIVDANITMTFVESGVNKVEINQLIRSGDSGGPIVDADSNVIGMAQKGVDEKYKRNSCVVLQEIEAVYNSDGYKTE

SEQ ID NO: 487 - protein, 543 aa, unidentified
  source 1..543: note = Related to JAHBUO010000087.1; note = Ignavibacteriaceae bacterium
MKLKEFQKIETSEDLAKIFGMSYKELSKIIYKLPFEYRYTYFEISKKNGTKRLISKPNKKLKQIQNKLSETLYSIYKPRPSVHGFVKQRSVISGAEKHLNKQSILNIDLENFFDSIHYGRIKYLFMAHPFNCNETIATILAHIFCHENKLPQGASSSPILTNMICYKLDKELQNLAKHCNATYTRYADDITFSFTTNKKKISKQIVEDTEVLTISPVLQQIIENNGFKINYNKVHLYKKNQRMLVTGIKVNEFTNVQRKYISKIRSMLYSWEEHGYINAKKEFESKYLTERHRVFSSLPEYRNVIRGKLNYLKMVRSKRDVLYIKYAKWFNKLVDEFSEPHLEYLEITPEEKLLMQSVLVIEILYDNSEGECVCNQGTGFYLKDVGIVTCAHVVTDDKNNPLDNIDVFRYDKITEKFRCTIQKIDSILDLAILQPVDPESLKDIQPLEQSSETIDSLHTVKMIGYPAYKIGQTPYIVDAKIASIYCQSTINKFEIDSLIREGNSGGPILNSNNKVVGIAAEGAEKSGGNNAVLRIDMLERIKS

SEQ ID NO: 488 - protein, 545 aa, unidentified
  source 1..545: note = Deltaproteobacteria bacterium; note = Related to JABHWU010000021.1
MPEKSFLSVKSPKELSLYFNLEYAAFSKIFYKTASDYKYKKFYLSKKTGGKRIISSPNRKIKEIQRCLAYTLKNIYQVRPSVHGFVEKHSIVTNAMPHLDKKFVLNLDIKNFFDSIHFGRVKHLFMSQPFNFVHSVATVLAQICCFENKLPQGAPTSPILTNMICWKMDAQLQHLAKINHCTYTRYVDDITFSFTCNKKQIPKSILIQPESELVVGQDLKIIIEKNGFEINLAKLRLYGRNQRMEVTGLTTNEFPNVRRKYIKQIQSMLHAWRKYGYGLAEKDFKEKYYKKHRASQKIPSFENVIIGKLAFLKSVRGLRSQVFIKLAKQFNDLTESGKMKFNYIEKTKDETDISNSLWVIEVLYNDKNGILKAGQGTGFYFENKGLITCAHVVSENDENFEKINAFQFDKPSKKYLLKIKKIDNHRDIALCEFSDCTMNDIQINKLDSITVSNDQISQFLEVKLFGFPAYKIGQTPYIADAKIATIYTQSAVSKFEIDHQIREGNSGGPILNKDNKLIGVALEGAEKGSGSNGCLQLDEIVKFIN

SEQ ID NO: 489 - protein, 560 aa, unidentified
  source 1..560: note = Related to JAGROM010000229.1; note = Simkania sp.
MTSLETLQALTTSQDVATLFGKSYTELSKIIYRTPEKYRYRVFTIPKKTGGLRTIASPRRKILEIQRRISILLQDTYQPPPSSHGFVRTKSIVSNAERHLNKRFIFNVDLEGFFDSLTFGRVKRFFMAQPFNIPNEPATVLAHICCFQKRLPQGAPTSPIITNLICRKMDRQLQALANQNHATYTRYADDLTFSFTRGMSKLPSAIVSHKDGLPGSGLMEIIKENGFKINPQKTRLNSKHQRLEVTGLIVNKFINVHRKFIRRTTSMLYAWEKFGLEMAEKEYLSVYSNLIRPYASGHHPKFHEVVKGRLAFLHMVRGKRDPLYIKLAKRFNAVLDDKTSSLPYIETSSYELSLSEAIYVIEILYDKKVKKGKNVSEEAVVMQGTGFFLKDIGFVTAAHVLLDNKGVEHPEIEVFSPKNSGVRYKLSIQTLDIHRDLAVGILFGPDKKKHTSSNQLTAQKSLPVQRDAITLVGFPGHKVGHTKPYIDDGKIGNVYTHQGVQVYDITTQIREGNSGGPVLLGSTYEVIGVASRGAEGKTGSNTVIAVSELFNLLSKSNSKK

SEQ ID NO: 490 - protein, 595 aa, unidentified
  source 1..595: note = Related to NESO01000004.1; note = Limnohabitans sp.
MHLNPLSKALSSVSYSDLTASFLQVKTPEDLALWFGFSKYAALGFLIFPRPKYTAFLIKKKNGSERLIQVPNKKLKEIQKRLLHVLNELDNSRPSAHGFRKKLSVVSNAEQHSGHKKHYVFNLDLKDFFPSITFPRVRGVFLSEPFKFPANVATVLARICTCNGALPQGAPTSPPLSNYICRGLDGSLQQIAKASYSTYTRYADDLTFSFTNKKRHRLSPNLINTAVENATVSLKLKEIIEDHGFKINFEKVRLRSRHARMEVTGLTVNEFPNVKRKFVDEIRGMLHAWETYGLEKAQEGFLSRLYKRQLRSGGVPAFENVLRGKLLYLRQVKGADDKVYNTLARRFNACSNLIGKNFQMAVPMIDVALSEQDLEKAIYVISCVHEEYDFEIKGTCFFLKGVGVVTCEHVMRYPLNVDEKGNKIHNFPRELTESYFGLSHGRIFIQDTIENPLCELEIVWLDRNADVVVLRPKDEIKIEHLTLIGATAETKTKEVRLVGFPFHTPGKSLSVAEGKIRSRYRHFGYENYDITSLIRQGNSGGPVLNSDFHVVGVAKEGERQDGGNNGVLMLAELIKLHAHYKNVQGPLPKNKVWSS

SEQ ID NO: 491 - protein, 550 aa, Chromobacterium sp.
  source 1..550: note = Related to NZ_JAJNRU010000001.1; note = Chromobacterium piscinae
MPLVDNIHQILIKSDVQPFSRYYFDLSYEELSKIIYPTPKYQTFHIKKKNGTDRVIHSPSYKVKQLQYIVIEKILKETIVPRPSVHGFVKDRSIVSNAKLHVGKRHVFNVDLKDFFPSINFHRVKGLFRGKPFNFANNIAVCLAQICCYKTKLPQGAPTSPILSNIICRGLDGELQVLAKNSHATYTRYCDDITFSFTKPNPSKIPRHIVQVDSNVASAGEKLNDIVVAHGFEINCEKTRMYDWKRRMEVTGLTVNKFPNVKRKNIDRIRMILHCWEKFGYKKAQENYIEFTKIEKSDFRGKCFLSYTRGYLNFIKSVKGMDDPVYRKLAKKFNTLIDFEFDGKRKDLPVGSVVKIREELDKAIFLIQCENAAGQCQQGTAFFLKDVGFVTCDHVRWLNEENIPTDEYIGYFFEREIKILNSEEQEVCKVRIKKYDARKDFLILEPTEQVIVNMALLPQVNIPQQGDPLILCGYPSPFIHRQTLTIINTTLITNYNTFGADHIEISTQIRKGNSGGPVLNSSFEVVGIAKTGSEQHGGKDSVLCIREIFN

SEQ ID NO: 492 - protein, 523 aa, unidentified
  source 1..523: note = Related to PHET01000006.1; note = Actinobacteria bacterium HGW-Actinobacteria-7
MTQRFIEIQSTDELAAFFGLDYKRLAAALYRTDASHRYHEFRIPKRSGGARTIHAPNRRIKALQRRLAGELDALYVPPPCVYGFVNGRGIRKNADVHAGRTFVFNVDLKEFFPSIHFGRVRGVFEKAPFHFTREVATVLAQLCCHQNGLPQGAPTSPVISNWICRGMDRELMALAKSSLATYTRYADDLTFSFTCSYRRLPGALVDVRGRKAETGDALQKIIENHRFKVNTDKVRLAGKSTRMEVTGLTVNEFPNVQRKYVRQVRSMLYAWREHGLPDAEREFNEKYDRGHRPSGRPKSFTAVVAGKLAYLLDVRGAENPTYNRLAAEYNRLVGEQGDHLPLAPPGPLERDLMGLQAMRKGKAHAKQYENIVESLLTQLLSPSLENPQNQVRINGGRKIVDITLDNHATSGFFHYIALNYNAPHIIVECKNYSGDPANPELDQLVGRFAQNRGRVGILVCRSFGSAAKKKRFLERCRDTANAGNGFVIALDDTDMALLVEERLRYGEKQSYRLLMERFKALVM

SEQ ID NO: 493 - protein, 541 aa, unidentified
  source 1..541: note = Related to JAIEMN010000007.1; note = Gemmatimonadaceae bacterium
MATLTTRRSIAELIEMSPTLLDGLANSLNRRAYHRFHVPKKSGGSRVITAPTARLKEVQRRLYRVLSALTVPPTCAFGFIERRSTVHNAQSHTRSRWVLNIDLEEFFPSIHFGRVHGMLMAPPYHIPELGAQRIAALCCHESVLPQGAPTSPILANMIARGLDFALRDFANQNRCHYTRYADDLTFSQFRKRFPSALVTRGVDNVTRVSDELRQIVESHGFRLNAKKTRLAHYSERQEVTGLIVNSKRPNVPREFIRNLRAMLHAWERYGEEAAEATYRRTFAPRDASDHVGLFRETLLGRLSYLAMVKGRSDPVYVELIRRARERVDRKHGTNYFDTMPIPEDGVAVLMTTEGRDRAGEQGTGFVLRNIGVVTCYHVVRRAVTVEAFPWHAPLRATNLFMDRFNVDWDLAILRGNYGAKYQFEAGDDAQLRIGMPVRIVGFPNWAPDRPMSITETVIQGMNSDYFGARRFTVRDAIFGGNSGGPVLNGAGKVIGVAMTGMFQTGGGTENMITPISYVRRLAEQPAYDPFSNVASKTREHS

SEQ ID NO: 494 - protein, 570 aa, unidentified
  source 1..570: note = Related to JAIOJS010000294.1; note = Thermoanaerobaculia bacterium
MNLDTAQRLLECETRADLAEWLGEDPRRLAFYAYVLPEHRRYSHFTIEKRAGGSRHIHAPIAPIKEHLRLISAALSHFYNPRNVVMGFVKERNIVDNANKHSRQEWILRVDLKDFFPTIHFGRVVGVLQAAPFQLRSEVAQTIAQLACHQGVLAQGAPTSPIFSNLVCRGLDHELLNLARRGRCRFTRYADDLNFSTSRKRFPDLLAARQLGSEGHTCEVSAALLQVISKHGFTLNDSKTRLVHRSQRQTVTGLVCNETATVSRRYYRGLRAVLHVWRKYGEDSAAEWFLANHYKRNKPSGSDFSFKKVVIGRVQFIGYVCGWSAPKYQKLANLLSQLDPTFRKKTAKTPPPEKPSGLVIWGEGETDYLHFFMAWNSLHQDYPNLTIEFPHPAKRTKGAPMLEKMLAVLEKTPPLEATVCVFDTDEPKITSRFEPVEGSAYLKLGTNLFVVLLPTPSFRSGRDPLCVELLYEDPASLRDERGRRLYLKDEFQAEEPYHKKEPGVMRLKPRSNSLVVEDVHNGTTQQNVALSKMGFANLVQSKSTSFEGFRALFDVLNGIVETELTLSNGS

SEQ ID NO: 495 - protein, 569 aa, Pseudomonas sp.
  source 1..569: note = Related to CP074412.1; note = Pseudomonas viridiflava
MDASLFPFPIAPKCKVANNKELAALLGITTAKLTYYAYHLADDEKYKEFTIKKRNGGDRLIEAPIKGLKDIQESIADILEENYKPRACVFAYVKDRGIVEHAATHIGQRWLLRLDLKDFFHTISFIRIAGILRRSPYNFAETPAKTSALLCTKGQRLPQGSPASPVISNILCKGLDYKLKELAALNKCYYTRYADDIFISNNGSKFPPSIAIRDEDGSAELSDTLKKIIIDAGFEVNLDKTILRKRSERQLVTGVVVNRKSNVPKELIKSIRAALYAWEQHGLEAAEDYWKRKIDKSNRFDGESPQMKLVLRGKITHVGHVKGYSDGTFLTLVKRLQALDSDYHIDEQKISRTITGEIHIYTEGVTDTKHFQAALRAFQRSGEFAGLNLIFRNSKKTGSSGLKALCENLCETLQRHLTICIFDRDERPIINEMSGSPGNYRDHTNNVFSLIIPTPEFRDPSDLICIEHLYQDAQIYTPDSQGRRLYSKDEFDSLGCHKDNPQLFCRVSKQSLIYDDQVINLQEKKNIALPKNKFADYIFNGAPPFSNVDFSGFRGTFTQIVAIAASYSR

SEQ ID NO: 496 - protein, 568 aa, Pseudomonas sp.
  source 1..568: note = Related to NZ_CP083988.1; note = Pseudomonas putida
MDAFFPFDPSPKYKISNNKELAALLGISTAKLTYYAYYLADDDKYKSFKIKKRAGGERLIEAPNKGLKEIQKNISVFLAQSYKPRACVFAYIQDRGIVEHAATHIGQRWLLRLDLKDFFHSISLARVSGVLRRAPYNFAESPANTTARLCTLGRRLPQGSPASPIISNILCRGLDYKLKELAASNKCYYTRYADDIFISNNGSAFPASIAIRSEDGSAELSDTIKKIITDAGFNINFEKTILRKRSERQLVTGVVVNRISNVPKDFIKSIRAALYAWEKHGLEAAEEYWKRSIAQTNRFDGESPQMKLVVRGKVTHVGHVKGYSDGTFLTLAKRLQALDSEYRIDEQKVLRNITGEIHIYTEGVTDTKHFQTALRALQRRGEFVGLNLSFRNSRKPGSSGLKLLCESLSETLQRHLTICIFDRDERQIINEMGGSPGNYRDHANNVFSLIIPTPEFRDSGDLICIEHLYRDAQIYLTDNQGRRLYSKEEFDSLGCHKSEPDLFCRTTKQSLIYDDQVINLQEKKNVALPKNKFADYIAAGAPPFSNIDFEGFRGTFTQIVEIASSYSR

SEQ ID NO: 497 - protein, 568 aa, unidentified
  source 1..568: note = Related to NZ_LR607350.1; note = Klebsiella oxytoca
MDTFFPFNTSPKYKIENNKELAELLGVTTAKLTYYAYYLRDDDKYHSFKIRKRINGERLIEAPNRGLKDIQKTISHFLERNYTPRSCVFAYVKERDIVEHASIHVGQRWLLRLDLKDFFHSISSARVSGVLRRAPFCFAKSPANTVARLCTKDGRLPQGSPASPVISNILCKGLDYKLKQLASSNKCYYTRYADDIFISNNGSVFPSAIAIRGDDGNVELSEEIKNIIINSGFEVNAGKTTLRKKSERQLVTGVVVNKKTNIPKEYIKSIRAGLYAWEKFGLVAAEEYWKKEIERSNKFDGQPPQMKLVIRGKIIHVGHVKGYTDATFLTLVKRLQALDSEFKIDEQKFRREITDEIHIYTEGVTDTKHFQAALNAFQKRDEFLDLKIIFKNSSKPGSASLKTLCENLRETSQKHLTLCIFDRDEKNIVNEMSGSPGNYRDHGNNVFSLIIPIPEFRKGNDSICIEHLYRDSLLFTYDSEGRRLYFKDEFDSLNCHKTDPNLFCRISKSSLVYDDNVINLSERKNVALPKNKFADYVCSGQPPFNKVDYGGFYEVFKQILEIASTYNK

SEQ ID NO: 498 - protein, 568 aa, unidentified
  source 1..568: note = Related to FUXY01000001.1; note = Pantoea ananatis
MKEPKFMQNLPSYKISNNKDLALLFGVPTATLTYYAYHLSDERKYKSFKIIKRSGGERLIEAPIKGLKDLQKTFSNFLSENFKPRACVYAYVKDRGIVEHAATHIGQRWVLRIDLKDFFHSITSTRITGLLRKSPYNFAKSPAETVARLCTIDGRMPQGSPVSPIFSNIICRGLDYKLKELSSLNKCYYTRYADDIFISNNGSLFPSAIASRNDDGSVQLSDAIKDIITKAGFVINIEKVILRKRSERQLVTGVVVNKKSNVPKVFVKSIRSSLYAWEKFGLPAAEDYWKREIYKNNTHNGEIPSFNLVIRGKVTHVGHVKGYADPTYLSLAKRLQALDSEFHIDEEKIFNTITSEIHIYTEGVTDTKHFQAALNFFKSKGDFQALNLVFKNPRKTGSANLKALCENLSETQQKHLSICIFDRDEPAIIKEMSGSPVNYRDHNNNVFSLIISVPDFRRDLDYICIEHLYKDSDLYIADLEGRRLYSKDEFDNLGCHKYLDNLFCRSSKSSLIYDNMVIDLPTKTNVALPKNKFAEYIINAKAPFNDIDFEGFRPTFNQIFEIASTYRK

SEQ ID NO: 499 - protein, 572 aa, unidentified
  source 1..572: note = Pseudomonadaceae bacterium SI-3; note = Related to CP026511.1
MDSFYPFIPNPPYKISNNTELANLLKIPVARLTYYAYYLPDEQKYTSFNIRKRNGNPRLIEAPIKGLKDIQRAISVYLYEQYKPRSCVFAYVQGKGIVEHASIHIGQRWLLRFDLKDFFHTIKTSRISGLLRRPPYSLAKGPAETIARICSKDGRLTQGSPSSPVISNLLCKGLDYKIKELAAKNKCYYSRYADDIFISNNGSVFPSAIAIRTLEGTAELSLALQEIVSASGFQINKSKTTLRMRSERQIVTGIIVNRKSNIPKEFLNSVRAALYAWERFGLEAAENYWRKNIDPKNGFNQEDKEGPRLRWVIRGKINHIAHVKGYSDSTFLSLARRLQSLDSSYKIDEQKILHALTDEIHIYTEGITDTKHIESALKNFKKNQEFSNLNLVLKTPRKPGSASLKSLCESLSVAPQKQLTICIFDRDEPNIIKEMGGSSSNYRDHTNNVFSMIIPTPDFRDANEPLCIEHLYKDEAIYIKDSHGRRLYSKHEFDSLGCHTLEPGLFCRISKNTLIYDDNVIELSKKANIALSKNKFADYISNGAPPFCNIDFSGFRNMFSQITQIAGLYKSN

SEQ ID NO: 500 - protein, 568 aa, Pseudomonas sp.
  source 1..568: note = Related to CP023969.1
MDASLPFGQFPKISISSNKELAVLLGISVNKLTYYAYYLDEESKYKTFNISKRNGGVRVIEAPVKGLKDIQKNIVTLIEPNYKARSCVFAYVKGRGIVEHAAVHTNQRWLLRFDLKDFFHTISAVRVAGLFRHPPFNFSKNVAETIARLCTKAGRLTQGAPTSPIISNILCRGLDYKLKELASQNKCYYTRYSDDVFISNNGSLFPSAIAERGSNGVVKLSDDVLEIIGGAGFQLNLSKTILRNRAERQLATGVIVNRKLNVPKEYIKSVRAALYAWDKYDLKQAEEYWREHIDDRNRWGDSLPRLSWVIRGKINHIGHVKGYNDPVFLTLAKKLQSLDPTYRLDERKILRSLTDEIHVYAEGITDCKHLETALKFFKARGEFTNLNLNFRNTRKPGSSVLKALCEHLSEAPQKHLTICVFDRDERPIISEMGGSPGNYRDHTNNVFSLIIPVPDFRDSDIICIEHLYNDSQLYIPDNQGRRLYSKEEFDSLGCFKGEAHLFCRMNKQSLIYDDNVIDMVERRNVALPKNKFADYIVSGAPPFSNIDFSGFRGVFSQIVEIAGFYGKR

SEQ ID NO: 501 - protein, 578 aa, Pseudomonas sp.
  source 1..578: note = Related to JAHARZ010000001.1; note = Pseudomonas syringae
MVLLNFPLKEQAPEYTISNNKQMAQVLGIKPSTLPYYAYYLPDNKKYTSFNISKRGGGLRLIEAPNKRLKDLQRAIAEYLGEHYKPRACVFAYVGKRGIVEHASVHVCQRWLLRLDLKDFFHSITAPRLAGLLSAPPFLLAPNLARTLSFICTKDGRLTQGAPVSPVVSNIICRGLDYSLKAYAAKNKCYYTRYADDIFFSNNGAIFPSSLARKDEAGTVILGDELQEIIKASGFIINESKTFLRSRAERQIVTGVVVNKKLNVPREYVRQIKAALHSWRKFGLEAAEKYWNEKIDKRNRWSGASTSFKLAVRGQINHVGHVKGYSDSVYLLLARKLSQLDNTFNFDESAIAESIAEEIHVFCEGESDILHLGHAFRCLKPRYPSLNLIFKLPGIGKGDGSSVLKSFCDTVRNHPQRHLTICLFDRDEPSIIREMAGSAVSYKDYGGNVFSLVMPPPSFRKNDNICIEFLYQDIDLLRRDTQGRRLYLGEEFDQNSCFKGEEMLFKKFPKNSLILDSDIIDARTGNNVALSKIKFAEYISSKVDPFSSVDVSGFAIIFDEIAAIRETYMRPFHDVDGD

SEQ ID NO: 502 - protein, 572 aa, Pseudomonas sp.
  source 1..572: note = Related to NZ_AZVL01000013.1
MVSLNFYLKEQAAEYKVLSNKHMAQILGVKTSVLAYYAYYLPDNKKYNSFNIAKRGGGFRLIEAPNKRLKDLQRIIAEYLGGYYKPRACVFAYVGKRGIVEHASVHVCQRWLLRLDLKDFFHSITAPRLAGLLSAPPFLLAPGVARTISFICTKDGRLTQGAPVSPVISNIICRGLDYSLKTYAAKNKCYYTRYADDIFFSNNGAVFPSSLARKDEAGTVILGDELKDIIKASGFLINDNKTFLRSRAERQIVTGVVVNKKSNVPREYIRQIKSALHSWKKFGLESAENYWSEKIDKRNRWNGASISFKLALRGQINHVGHVKGYSDSVYLMLARKLSQLDNTFNFDERSIAESIAEEVHVFCEGESDILHLRHAFQCLKSEYPSLNLIFKLPGIGKGDGSSVLKNFCDMVKNHTQRHLTICLFDRDEPNIIREMSGSAVPYKDYGGNVFSLVMPSPDFRNENICIEFLYKDVDLLRQDTQGRRLYLGEEFDQNSRFKGQGTIFKKIPKSSLILDSDIIDYQTGNNVALSKVKFAEYISNGVAPFDSVDVSAFSVIFNQIAAIRDSYMSLGV

SEQ ID NO: 503 - protein, 577 aa, Pseudomonas fluorescens
  source 1..577: note = Related to MSDE01000014.1
MSAQDAIDENLNIYSISTNRELAKILKTKTSTLSFYAHYLPDKKKYKTHTISKRGGGARIIDAPNKNLKTLQKSIASFLNEHYKARACVFAYVANRGIVEHGEVHVNQRWLLRLDIKDFFHSITTARLVGLLIAPPFCIAPNVARTISFICTKDGRLPQGSPASPVISNIICRGLDYKLKTIASKNKCYYTRYADDIFLSNNGAIFPPSLALKNDTGIVALGPEISEIITSSGFSINEEKTFLRSRGERQIVTGLVVNKKLNVPKEFVRNIKSALHSWRKFGFEAAQKYWRDKIDKRNRWLVEHADYKLSVRGQINHVGFVKGYSDPIYLSLARKLSELDSTFSFDEEALANSIAEEIHVFCEGDTDLLHLEHAFQKLKNEYPTLNLTFKLPNTGKGDGSSILKNFCNSVRTIPQKHLTICLFDRDEPTIIREMAGSALPYRDFGSNIFSLVIPQPDFRDHECICIEHLYKNDDLLKKDSHGRRLYLNEEFDSNSRHTGGELLFKKIPKATLILDADVIDFKTGENVALSKSKFANYIYNETPPFTSIDVSGFKVIFDQIATIREAYSNGMHGQKTI

SEQ ID NO: 504 - protein, 578 aa, Pseudomonas sp.
  source 1..578: note = Related to NZ_CP014135.1; note = Pseudomonas agarici
MSVPEVSPLPASFLDLLAPAVKIKNNKELAAELGISLGRLTYYAYFLPDHKKYKTFTISKRGGGERIIEAPVKGLKDLQKTILGKFEPYYKPRACVFAYVQDRGIVENADVHDFQRWVLRVDLKDFFHSITQRRVIGIFSSPPFSLSRDAARTLSFLCTKDGRLTQGAPTSPLISNLVCKGLDYTLKELAAKNKCYYTRYADDIFFSNSGAMFPRIIAEKMEDGSVKIGEELKNLIEGAGFAINEEKAFLRSRAERQIVTGLVVNKKVNVPREFTREVRAALYSWEKHGLESAENFWKEKVDKKSRHSESDSRFKWVVRGKINHIGHVKGYSDPVFLSLARRLKALDDTYKLDERKITVAIAQEIHIYTEGVTDNKHLKNAYEHFKRSNQFDDLNILFKETKKSGSPALKALCENLSEALQRHLTICIFDRDEKDIISNMGGSPGSYKDHGNNVFSLVIPVPDFRDTQFVCIEHLYKDEQLFQEDIEGRRLFSKDEFDSLSCFKGEKPLFCRLPNKQSLIYDSEIIDMSKKVNVALSKNKFADYILSRVAPFDKIDLSGFTGTFEQIREIARSYGNKR

SEQ ID NO: 505 - protein, 578 aa, Pseudomonas sp.
  source 1..578: note = Related to AP017302.1; note = Pseudomonas aeruginosa
MLNIAGKPLFVPFLDAPLPEVKIKNNKELAGFLGISLGRLTYYAYYLPENKKYASFKIKKRGGGERLIEAPVKGLKDIQREVVRKFEDDFKPRACVYSYVKGRGIVENADIHDLQRWILRIDLKDFFHSITQKRVAGIFSSPPFMLSPDAARTLSFICTKDGRLTQGAPSSPFLSNLVCRGLDYRLKELAAKNKCYYTRYADDIFFSNSGAIFPRSLAERLEDNSLKLGEELTNIIQGAGFSINENKAFLRSRAERQIVTGLVVNKKVNVPKEFIRSVRASLYSWEKFGLELAEKHWREKVDKRSRHERESPRFKWVVRGQINHIGHVKGYSDPVFLSLARRLQALDSQYKLDEIKIINSIAEEIHIYSEGITDIKHLKNAYIELQRSGEINDLNIVFKETKKSGSPALKALCENLSEALQRHLTICIFDRDERDIITSMGGSPGSYKDHGNNVFSLVIPVPEFRETEFVCIEHLYRDEHLFLEDQDGRRLFARDEFDSVSCFKKERPLFCRYPNKQSLIYDSDVIDLAERKNVALPKNKFAEYVTSKTPPFDNMDISGFRCVFEQIRDIAKSYRSKR

SEQ ID NO: 506 - protein, 581 aa, Pseudomonas sp.
  source 1..581: note = Related to NZ_CP025263.1
MAKLPRKFSFSSFLNSPAPEVKIKNNKELAEVLGISVGRLTYYAYYLSADEKYSSFNISKRGGGERLIEAPVKGLKDLQKKIVEYLTTFFKPRSCVFAYVEGRGIVENADVHDLQRWILRVDLTDFFHSITQKRLVGVFSSQPFSMSHDAARTLSFLCTMNGRLAQGAPTSPILSNIICRGLDYKLKELSAKNKCYYTRYADDIFISNSGASFPRTIAEKLEDGSVELSESFCEVVSNAGFKVNLKKVFLRSRAERQIVTGLVVNKKINVPREFVRSIRAALYSWESFGLEDAEKFWARNIDKKSRHERSSPRFRWVLRGQINHVGHVKGYSDSVYLGLARRLAALDDSFKLDERKIRKAIAEEIQIYTEGPTDIKHLSNAFEVYQSRGEFQDLKLIFNRTKKAGSSVLKVLCENLSEAQQRHLTICIFDRDEREYIKSMGGSPGSYKDHGNNVFSLVIPVPDFRDTDLVCIEHLYRDEDLYREDVEGRRLFSKEDFDAVSCFKGDRPLFCRIPNKNSLIYDSDIIDMVEKKNVALSKNAFADNIVTKTAPFNNVDLSGFTETFEQIRIIAGSYRNRGVGV

SEQ ID NO: 507 - protein, 578 aa, Pseudomonas sp.
  source 1..578: note = Related to QRDL01000002.1; note = Pseudomonas oleovorans
MAKPDEFLDLPLQPPIKIKNNKELADFLEIKVNKLTYYAYHLDDRKKYTTFEIKKRSGGLRKIDAPIKGLKDIHRQVLLKLDPYYKPRSCVFAYIKKRGIVENADLHKGQRWILRIDLVDFFNTITFERLKGLFASQPFSMSENASRTLSMICTKDGHLTQGSPASPLLSNIICRGLDYKLKEISAKNKCYYSRYADDIFISNNGAIFPNAIAEKKSDGSVELNPQILSTIYDAGFSPNKEKITLRSRAERQIVAGVIVNRKTNTPREYIKSIRATLYSWRKYGLESAEEYWLKHIFRQSPHGDNQPRMRWVLRGQINHVGHVKGYSDPVYIGLAKKLKSLDPTFKFNEQNAIDFVREEIHIYSEGITDRKHLENALLSLKSQGLFTELNLVFRETSTDSKKQGSAALRSLCETLCAATQKHLTICLFDRDEKEITESMGGSTRTYKDHGNNVWSLIIPAPEFRTLTSFCIEHLYRDEQLYQYDQEGRRLYSNSEFDDNQCHRDPDKLVFQKHPNKKALILDDAVIDITTKTNVALPKNKFADYISSKTAPFDDMDFSGFIPTFDQIIEIAARYTSNK

SEQ ID NO: 508 - protein, 558 aa, Pseudomonas sp.
  source 1..558: note = Related to NZ_CP067024.1; note = Pseudomonas syringae
MAIPQIKNNQDLADFIGVKKGVVAYYAYYLDSAKAYTSFTIKKRSGGDRTIDAPVRGLKQLQRTILNKLSPEAAFRHCVYGYVPGRDILQNSAIHVRQRWVLRVDIKNFFPSITTLRVSGMFRSPPFDMEPKAARALALICTKDGLLPQGSPLSPWITNVICKGLDYNLKRLASKHKCYYSRYADDLFFSTSNGLFPTALARKSDTESNVIIGEELKSEILSAGFLPNEEKTSLKPISQRQVVTGIVVNSRTNVPREYIRNLRAALYSWDKFGLEAAEEHWRNKVDLKNRVGEQPRFRWVVRGQINFVKHVKGEADPVYLSLAKKLKKLDEKFTFDPKVSALSVTEEVQIFVEGITDKKHIEKAFRNAQGQGLYLDLNLTFPNQREYGSSNLKSLCETLSANAQRCLTICIFDRDEQPYVKSMGGSSGDYMDHNNNVFSLIIPRPEFRVEPDICIEHLYKDSDLFKHDLAGRRLYSKSEFDKHSCHCEDPNIFIRTPPKSLICDSGVINISTKASVALSKFDFATNIYDGVPPFDSISFEGFLPLFTKIQQIKNLFRK

SEQ ID NO: 509 - protein, 558 aa, Pseudomonas sp.
  source 1..558: note = Related to MSXU01000002.1
MAIPPINNNQDLANYIGVKKGVIAYYAYYLVSSKAYTSFAIKKRSGGERTIDAPIRGLKELQRTILDKLSPETNFRHCVYGYIPGRGILQNSAIHVRQKWVLRVDIKDFFPSITTARISGMLKSPPFNMAPKAARALALISTKDGVLPQGSPLSPWITNVICKGLDYNLKRLASKHKCYYSRYADDLFFSTSNSFFPTALARRGDAEKNVIIGEDLELEILRAGFLPNEEKTSLTPISQRQVITGVIVNSRTNVPREFVKNVRAALYSWEKFGLKAAEEHWRSKVDSRNRAGDPPRFRWVLRGQINFIKHVKGEADPVYISLAKKLKKLDDNFTFDAKASALSVIEEVQIFVEGITDKKHIEKAFIDAQKQGLYSDLNLTFPNQREYGSSNLKSLCETLSANVQRCLTICIFDRDEPAYVKNMGGSSGDYMDHNNNVFSLIIPRPTFRSEGDICIEHLYKDADLFKYDTAGRRLYSKSEFDKHSCHIKDPLIFIRTPPKSLICDSGVINISTKASVALSKADFATNIYEEIPPFNKVSFEGFLPLFTKIQEIKHLFKK

SEQ ID NO: 510 - protein, 559 aa, Pseudomonas sp.
  source 1..559: note = Related to LJRY01000136.1
MAIPPIVTLQDLANYLSIKRGKLAYYAYYIKPADAYNTFAIKKRSGKDRSIDAPIKGLKDIQKLVYENFSGEIEFRKCAFGYIPGRGILQNSERHVRQRWVLRVDLKDFFPSVTAVRVAGMFSSQPFNLSYKTARALALIATKHGTLPQGSPLSPWITNVICRGLDYNLQKLASRYKCYYSRYADDLYFSTSNSLFPLALAHKSENDSNVIIGEELKAVILTAGFTPNEEKTSLRPTSQRQMVTGIVINSKPNVPKEFIKQIRAALYAWENHGLVAAEEHWAKKSDFRNRFEKAKPRFRWVLRGKINHLRHIKGESDPVFLKLATRLKKLDPTYSFDPKLSAQSITQEVCLFVEGITDRKHIETAFKDAQNRGLYGDLNLKFNEPKENGSSNLQKLCHNLSATPQRCLTICLFDRDEPSYIKSMGGSSSDYLDHNNNVYSLILPYPKFRAEPDICIEHLYEDKDLFMPDSKGRRLFSRDEFDKHSCHIKEPNVFIKLPAKSLIVDSNVIDISTKESIALSKNDFASQIYTATPPFDNVSFSGFIPLFDKIQEIKNLFIR

SEQ ID NO: 511 - protein, 558 aa, Pseudomonas sp.
  source 1..558: note = Related to JADTFG010000022.1; note = Pseudomonas aeruginosa
MALPAINSLQDLANFLSVKRGLLAYYAFYVSPGDAYSNFSIKKRSGSDRSIDAPVKGLRDIQTIIYKKFSGEIEFRKCAFGYIPGRGIFQNSERHIRQRWVLRIDLKDFFPSITAVRVAGIFSAQPFNISYKAARTLALIATKNGVLPQGSPLSPWISNVVCRGLDYTLQKLASRHKCYYTRYADDLYFSTSNSVFPSALAHRSEKESIIVIGDELKAAIIAAGFTPNEEKTSLRPASQRQIVTGVVVNSKPNVPKEFVKGIRAALYAWEKHGLLSAEENWQKNVDVRNRWDSANPRFRWVLRGKINHLRHIKGEADPVYIKLASRLKSLDNTYSFDPKLSALSITQEVSVFSEGITDKKHLEIAFKHAQSKGLYPDLNLKFYVPNEAGSSNLQKLCYGLSSTPQRCLTICLFDRDESQYIKSMGGSSSDYLDHNNNVYSLILPHPAFRTEPDICIEHLYEDKYLYMPDSKGRRFYSKNEFDKHNCYIKEQNIFIKATSKSLIIDSNVIDISKKTSIALAKNEFASLIYTSTPPFDKISFDGFLPLFDKIREIKNLFK

SEQ ID NO: 512 - protein, 564 aa, Vibrio sp.
  source 1..564: note = Related to MSCI01000001.1; note = Vibrio chagasii
MEISSVKNLDDLAKCLGQSKKTLAYLAYHAPVDKKYKTFSIRKRSGGNRTITAPCSKLKSIQYSIYNQLNSFYQPKKSVHGYVKDKSIVSNASIHVGQRWLGKVDVKSYFPSITTKRVVGLLRNEPFNLPNKIAATVGLLVTYNGYLPLGSPCSPIISNLITRRLDAKLSALSRGYKCYFTRYADDIFFSTNRKVFPRELIHHNEDGVSTIGHKLNEVFEEEGFTVNTDKVSLKDKSQRQVVTGIVVNERMNVPKEYIRELRAMLYSWEKHGLEAAEKDWLKKYVNLNRNGQDIPSQPRYRWMVRGKLNHIAAVRGSNDEVYLKYAKRLARIDNTFKIDPKAITASIASEIKVHIEGKTDAIHMRAAMHALHGAGKYTSLKLSFPNEDTAKGDGELIKACKVMSSSNQTHLTIFLFDSDVDKTTREMKGSTLAYKDHGNNVYSVVMPNPSFRNDEKICIEHLYTDEDIMKKTENGLRIFKSDEFNKKNGLHIEEKGIIRLYPNNSTLIVDSNVIDVESGENVALSKAKFAELIESKRAPFDSVSFDGFEPLLDIFEKLHTDYIK

SEQ ID NO: 513 - protein, 463 aa, unidentified
  source 1..463: note = Related to SOEC01000021.1; note = Halomonas xianhensis
DAAGGLRGRSQEISRWTRHTSIVLLLELETTELCEVLGIKTSYLNYLLYKLNEGERYESFEIKKRGGGARRIDAPIKPLKVIQRKLGDLLKEIYSPRIGVYGYVEGRGIKENAEVHLGCNEVCRIDVKDFFPSIHIGRVIGLFKSKPFLFPEPLSVLLAQICCKDGALPQGAPTSPVISNMICWLMDKELYRYARISGCRYTRYADDIFFSTVRKRLSRRICSVEHSEFDFSIALSPAVISIIEKHGFKINVHKTYMADKSQKQVLSGVIVNEKLNVDREFVLKLRAMLHCWEMEGLEKAEKKFHSKFARNYIVPPLFMQVVRSKVEYLGYIKGYDDPVYLKYADKLSRLHPHYTYNKRKVVAHGGNLIRVYTEGPTDKIHFNAALEWFRGRGEYASLGVVFEHLPEANGGDSLMKHAKTISTEARADRKVFYSIKMCQKLIRKLIRSQERITDFLLTTFGWP

SEQ ID NO: 514 - protein, 565 aa, unidentified
  source 1..565: note = Related to nan
MDVNIQKFLNIESKAQLSAFLGISTEKLNYLLFKLPHEEKYNSFEISKKTGGKRIIDAPIKPLKLLQRQIATILFEVYKPKTGVYGYVKNGGVKRNAEVHLRSKVLFRADIKNFFPSIHIGRVIGLFSSKPFSFPRNIAVLLAQICCKEDVLPQGSPASPIISNFICRGLDRDLLEYARSVRCKYSRYADDIFISTYKKFMPGSICKLEHDDGVGFCNINDGLEDIFETHGFSLNKNKLSVAYKHNRQIAAGIKINEKLNVDREYVLNLRAMLHSWRKDGYDVAAAKYNELKPNPSYARAFKNAVRSKLEYLGYVKGYGDPVYLKYAMWLSRLDDGYTFNKRSYEMENNKKLVVYTEGVTDQLHIQAAKNYFREKGEFMHLDFRFDDKSEVNGAPDLEKYLIQDRKEPNQEFKVYLFDDDLKKVTSKLDIAPGESSRWFGNKIWAALTPKPQHRKDDELFCIEMYYFDADLERKDSSNRRIYLNSEFDAKGFHNTESVVKTKPGSGLIVDNDAYSMVSKEKVSLSKIAFAENILYKKQGFEDVNFEGFRPLFELLQNIYNQAYLH

SEQ ID NO: 515 - protein, 614 aa, unidentified
  source 1..614: note = Related to JACCAU010000001.1; note = Paraburkholderia bryophila
MSGEADQRGMSPGMQAAIDRLNLMGTNTQEALFSGFAQLTSKAQLCQFLGIKTAKLNFLLYKLKPAHRYKTETIKKRNGDDRLLRVPVPLLKQIQRIIASELAKEYRPRQHVYGYVKGKNIAQKARIHVAQKWVARVDLKDFFPSVNFGRVLGIFRGHPFHFNDELATVLTQIVMDGNELPQGAPTSPIISNLICRSLDFELKRMAKEHRCFYTRYADDLVFSTSLKRLSPQICSPAAPDGVSIQANVGDGLRTLIARQGFTINDAKTRIFDRSSRQQVTGLTVNEKVNVSREYVRGLRAVLHAWFKFGEESAASWFFANHYKRNRPDWKSTPADFREVIRGRLAFIRFVKGADDTTYLALAKKLAKLDDGFQLGVEEQIQVNSPRLMLYTEGVTDTIHLRHALQRFKADGQYSDLNIDWADHSDRPRGEGKLWQNCLNDAKRDEFRHQTQVYVFDRDSDFAKKAEDKYGKLKHHGNNTYSLVLPIPEHRQGRAQICIEHLYVDDFLWQQDVQGRRLFAREEFEHDGNHVGNVEVMYRHPKATTLIVDTDVVGYGSLRSKPVVMSKKQFADAVELGVKPFDAPSLVGFQGVFDMLRDLTKNLTGEVKADASAFV

SEQ ID NO: 516 - protein, 592 aa, unidentified
  source 1..592: note = Related to NZ_JAGIXD010000027.1; note = Paraburkholderia tropica
MSNTTQAALFNAFPFLTSKEQLCQYFGVPPRKLNFLLYKLAPADRYKTVVIKKRSGADRQLRVPVPLLKQIQKIIAAELAKEYRPRQHVYGYVKGKNIAQKARIHVAQKWVARIDLKDFFPSINFGRVHGLFKSHPFQFNDEVATILTQLVMDGNELPQGAPTSPIISNFICRSLDTELKQMAKEHRCLYTRYADDLVFSTNLKRLSPQICSPAAPDGVSIQANVGEGLRAVIQRHGFTVNDVKTRIFDNSARQQVTGLTVNEKVNVSREYVRGLRMVLHVWQKIGEASASAWFFEKHYKRNRPGWKRAEPDFREIVRGRLTFVRFIKGANDTTYLTLAKKLSKLDDGFRLGLDEEIQLSSPRLMVYTEGVTDTIHLRHALQQFKARGVYNDLNIDWADHADRPRGEGKLWQNCLSDAKRDEFRHQNQIYVFDRDSDYAKKAEDSYGKVKHHGNNVYSLVLPIPEHRRGRKQICIEHLYEDAFLWQSDAQGRRLFPREDFDQEGHHTKGLEVIYRHPKSATLIVDADVLGYGPLKSKPVVMSKKQFADAIDQGVKPFDSPSLEGFEGVFNILRELTNSLAGEVRSDVIDLVS

SEQ ID NO: 517 - protein, 607 aa, unidentified
  source 1..607: note = Related to JAJUBH010000003.1; note = Caballeronia sp.
MSRETEQPDRRVAGLSATIGRLNRMGTTNQTTLFGSFLEVGSKQDLCAFLGLSESKLNFLLYKLTSAERYKTEVIKKRNGSPRTLRIPIAPLKKIQKVIAGELSNLYRPRQHVYGYVKGKSIIQNAQVHLAQRWVARIDLKDFFPSINFGRTHGVFKGHPFHFNDEVATLLAQIATDQNELPQGAPTSPIISNFICRSLDLELKQMAKEHRCFYTRYADDLIFSTNLKRLSPQICVPAAPEGVSVQAHVGDGLRAIIEKQGFSVNDIKTRIFDRSGRQQVTGITVNEKLNVSREYIRGLRSVLHVWSKHGEPHAAAWFFSNEYHRNRPGWRPDPPDFREVIRGKLGFVRSVKGAEDTTYLTLARKLSLLDDNFKLSQAEQQQAESPRLMVYTEGVTDAMHLRHALHQFKADGLFTDLNIDWADHTDRATGEGKLWQTCLSDAKREEFRHQTQIFLFDRDSDFAKKAESKPGKLKHHGNNVYSFCLPVPAHRVDRTQICIEHLYHDEFLFQKDTQGRRLFAREEFEQDGNHVRHEDVFCRYSKATLIVDSNVSGIGSLRGKPVVLSKKQFADYVEQAVAPFQSPSLDGFQGVFEVLQQFVHNQIQGDA

SEQ ID NO: 518 - protein, 591 aa, unidentified
  source 1..591: note = Related to NZ_CADFFT010000001.1; note = Caballeronia sp.
MGTDNQQSMFNSFTSLTSKVQLCQFLGITTTRLNFLLYGLPCERRYKTHAIKKRNGGERRIREPIPPLKKIQKIIAGELAKQYRPRQHVYGYTKNKNIVQKARVHVAQKWVARVDLKDFFPSVNFGRVKGLFRGHPFDFNHEIATLLAQLVMDGNELPQGAPTSPIISNFICRSLDYELKRMAKAHRCFYTRYADDLVFSTSQKRLSPQVCSPLAADGISVQAVVGDGLRAVVERQGFVVNDAKTRIFSKSSRQQVTGITVNEKVNVSREYIRGLRAVLHAWRKHGEEAAASWFFANHYKRNRPHWKSQPADFREVIRGRMTFVRFVKGGDDTTYLTLAKKLAQLDDGFQLDAAEQLQAMSPRLMVYTEGVTDTIHLRHALSRMKGDGRYVDLNVDWADHSDRPRGEGKLWQNCVNDSRREEFRHQIQVYLFDRDSDFAKKAEDKYGKLKHHGNNVYSLVLPIPEHRHGRQQVCIEHLYRDEFLWQKDAQGRRLFPREDFDLDGHHIGGLEVLYRHPKAGTLIVDSDVVGYGGLRGKPVVMSKKQFADAVDLRVEPFHAPSFAGFEAIFDTLSELSRSLGGGHRPEASDLL

SEQ ID NO: 519 - protein, 617 aa, unidentified
  source 1..617: note = Related to NZ_CP014579.1; note = Paraburkholderia phytofirmans
MGTLNITSLLDESVQPPLISPFLLLRSVEDLCSFLDISHRRLNFLLYVLTPGDRYRSYELKKKKSSGTRTIKSPIKPLKEIQRRLANELSAVYKTPLNVYGYVKHRDVVDKAKQHVGQRWVARIDLENFFGTFNFGRVRGMFRAKPFNFPDSLATVLAQICVDTNELPQGAPTSPIISNILFWRLDARLRRLAREHRCVYTRYADDLVFSTNKRHMSSGICTVLDELSETPTIRVGETLRKEIEGEGFKVSDSKTRLFGRTARQQVTGLTVNEKVNLGREYVKELRAILYACRKFGVEAAKERFMASHYGKNVPPGKAAPAFAEIIRGRVMYVGRIKGYSSRAFLALARGMPILDPNFRVPEEHAAPRAYLFTEGVTDYLHLDAALKRFRKAGEFADVTVEWDDHTKREQMGDKRLLQICDDIAKGPKQDRLCIFVFDRDVPDTITKAEAPDGSPKLRGNGVVSMCLPVPKHRDQSSPMCIEHLYSDEFLYQYDADGRRLFARDEFLPSGFHKSEDFLSRQPKTSLIVDSDVVLSAGERRGTSVALSKRQFAMFVNLQTAPFSEPDLSGFRPFFEALRQLMEAHEAIQAMPVTPPANDRGQRVPPPGTGAGATQIEA

SEQ ID NO: 520 - protein, 607 aa, unidentified
  source 1..607: note = Related to FUZX01000002.1; note = Paraburkholderia hospita
MGTPNLKSLNFEPEQAALIHPFLLLRSVDALCQHLGVSKRRLSFLLYVLPAAQRYRSFELKKRKSKATRTIKNPVKPLKEIQQHLAKDLLDIYRAPLNVYGYVKDRDIVDKAERHVGQRWVARIDLENFFGSFNFGRVRGMFRAKPFYFPDALATVLAQLCVDSNELPQGAPTSPVISNILMWRLDARLRRMAREHRCVYTRYADDLVFSTNTRRMSSGICNVLNADSDAPIVRPGDALLKEIRDEGLAVNDSKTRLYGRTERQQVTGLTVNEKVNLDRDYVKQLRAVLYACSKVGVEAAAERFFASHYPKNVPPGKRVPQFADVIMGRVMYVGRIKGYSSGAFLALASRLKILVPDFRVPEMPVTPRVYIHTEGATDYLHLHAALKKLQSGGEFTDLSVGWDDHSKREQLGDKRLLQLCEDTANGPRQDRLNVFVFDRDIADTVTKAEREGEPRVRGNGVVSLCLPVPAHRPASSLMCIEHLYTDEFLYQQDTAGRRLFSREEFRPDGFHNTEDYLYRQPKTTLIVDSDVLVTSGENRGKSIALSKKQFARYVSEQVEPFAAPDLSGFRPFFERLRHIIEAHEFLHDVPKRGGEGSDISRVAVDTP

SEQ ID NO: 521 - protein, 542 aa, unidentified
  source 1..542: note = Actinomycetia bacterium; note = Related to JAFDWE010000089.1
MAKVELRILTWLAWGLNEQRKYTTFSIARRNGSVRQISAPIKPLKEFQQALAESLLEGYRAPAHVHGFTTGRGPRTNAEVHVDKFHVFRADLADFFPSITYRRVRGLFRRWPFEHPDDLAKVLARLCCHQDALPQGAPTSPIISNFICRRMDRELAQLAAAERCHFSRYADDLVFSTNQHLFPPAIGLVEEGTAVAGDRLKGIVTTNGFSINADKTTLTRETQRQRVTGIVVNEKINPPREYVRSLRSLLYIWKTYGQPAAEAALAKHDPPSGNRPPGKSLPRFEQVVRGRVQYVGSLKEFRNPTYYRLAKQLSEVDEGFSPPPMPIIEANLYTEGPSDWRHVLAAQRHFNELGEFTDFHLVKGKEASREGESQLRKFAERLGEREQSEFSVCLFDSDVKPALEAVGPDGWRRYGPRVVAVGLAVPAAMDRREPLFIEKLYSEEVLKTKLANGRRVYLGTEFNPKSGHHLEEDCSIVGEGKEFIQQSVHAFDTHSVISLTKVDFSKAVYDDPEHFGTEIFEGFRPTFERIDEALRDSWEVLQ

SEQ ID NO: 522 - protein, 552 aa, unidentified
  source 1..552: note = Xanthobacteraceae bacterium; note = Related to JAHBZD010000017.1
MLTHQLRARRRETMRCPAQYQERQKRHDRADYYFMTLNSAYSFSSLAAVLGITPKQLGYYLHKRPLASQYKQFKIPKKSGDYRVISAPATNLKLIQKSIAKQLNEIRLFKPCVNGFVPKRNIRRNASMHVGRRFILNIDLEDFFGSITFARVYGMLQKEPYFLAQPVAAAIAKACTLDGVLPQGAPSSPVITNLICAKMDAELTRFAESNRCKYSRYADDITFSTTRPTMPFASALKDAEGTTVYELNPTLRDIIETNGFKINEKKVRLRDATARQEVTGLIVNKRVNVKRRAVREIRAMLHAWRTFGLPAAATMGKDKYGLKGNFEAVLRGKIEFVGHIRGRPDPLFRKLADQFNSLPVAGRIRTVLTPEEIARNATWIIESDGDVQGTAFFVDGVGLVSCSHCVGPNAYILHPTDPTKKHRVKIIKEDSHRDIAILECPNGFSVPGFQLHAASIVKDGTEIVLLGYPNHRAGSTIRVEAGKLLRRIVSSAVEHYEITPKIIGGNSGGPIVNSDYEVVGIAVRGLSGKAKFSDVEFIGINSSELKLVLSGK

SEQ ID NO: 523 - protein, 517 aa, unidentified
  source 1..517: note = Related to NZ_CP007440.1; note = Rhodoplanes sp.
MPLNKIHNLTGLAYLLGCRAQQLGYYIYKRPLITQYRTFEIPKRRGGTRTIAAPSTNLKIIQRNLAKELDALFTFKSCVNGFVTDRDIKRNATTHVGERFVLNIDLENFFGSINYGRVFGLLSKPPHSLNRTVAAAIAKACTLNDALPQGAPTSPVISNLICAKMDSELLRFAAANRCKYTRYADDLTFSTNRTSMPFATASKAADGKTYCEINASLRTIIESNGFQINTNKLRLRDNTARQEVTGLIVNERVNVKRRFIRETRAMLHAWRKFGLLAAAAEHKNKFGGGTAFESIVRGKIEFIGQIRGRPDLVFRRLAVQFNALTTSGKIRTALSPEEIVKQATWVIEHSGDGQGTAFFIEKYGLITCAHCLGSNPYIYHPENPAKKIAVTVLSQDNHRDLAALEIPAELKTISPIPLYKGPPLKDGASITLCGYPNHFLAKPIRIEQGKLIRTFPKSAVSYLEVTPKIIGGNSGGPLVTEDFSVAGVAVLGLSGSVTLSQAEFFAVNIAELVAWLK

SEQ ID NO: 524 - protein, 519 aa, unidentified
  source 1..519: note = Related to CP069300.1; note = Bradyrhizobium sp.
MDLSKAYDLTSLAILLDCSAKQLGYYVYKRDLATQYKQFQIKKRSGGARIIKAPATNLKIIQRSIVRELERLVRFKPCVTGFVKGRDIKRNAVLHVGQRHVLNVDLQDFFNTINYGRVYGLLTKKPYGIAPKVAAAIAKACTLDNALPQGAPTSPILSNLICAKMDAELSRYALANKCIYTRYADDLTFSTNRQFMPMAALNLNSDGTPITELARPLREIIEANGFVINERKVRLSTRGRRQVVTGLVVNERVNVRRSAIREARALLHAWRKFGLVKASSVFNEKFGGAGRDFEAVVRGKIGFIGQIRGRPDESFKKLALEFNKLTANGKIRTALSRSEIAAQAIWVIEHDGDSQGTAFFLDGVGIVTCAHCLGENPFIYHPSDHTKRFKLKVRAEDKHRDLAILYVPVELENVVPLSAYKGVALANGADVSLWGYPNHFAATPIRMERGKLIRSFVKSAVSYLEISPKIIGGNSGGPVLNDGYQVIGIAAVGFGGSTKFTGVEFMAVNGIELSALLSK

SEQ ID NO: 525 - protein, 534 aa, unidentified
  source 1..534: note = Related to NZ_QTTB01000004.1; note = Tsuneonella troitsensis
MRVNSKQDLACAIGIPLELLERRAFGIPQHILYSRHEYPKRDGSTRLIYSPHWPLRHIQSRLANLLDEIYEPSSRVSGFVKGRGIRYNASLHVGKRLLLNFDLSDFFPTIHFGRIRGRLRARPYQLNAVIATTIARLCTLDGNLPIGAPSSPVLANIICSHLDGLLTRLAREHGCFYSRYADDITFSTNRRSFPNSLATVDHENGLAAVGALISAAVTEAGFIVNPRKTRILDKSSRQEVSGVVINQFLNVPRSFMREIRGALNAWEKHGHIASEQYFKEKYNWRSSQSFENHLRGRIQHVIHIRGSDDLVVWRLVNRFNNLPDRAHSSISYDRPKDERDRLSLAVCRVESGNDELMEYNQGSGIKLPNGNVLTNFHNIEICGTVAPIIEIYLTDNAPVPVPMRVLKHDFAKDVAILEPIDPEWKMPIAAASAELSFSECKVGDDVKVGGFPSYQLGDSCQIATGEVRAFSKIEGITYFRVSVPIVKGNSGGPVFNIDGQVVGIASRGIDTHEITNAAFNGCLELFRFEKFLQS

SEQ ID NO: 526 - protein, 406 aa, Acinetobacter sp.
  source 1..406: note = Related to KB849143.1; note = Acinetobacter calcoaceticus
MKFPPTSPILSNLIVMKMDGQLSKLAKDNLCFYTRYCDDIYFSTNRKKFPQNIAFFDHSSDNRFCQIGGDLEKIIKSNDFIINEKKVYLSDKSNRQFVTGLVVNEKINVNRKFIKNIRPILKKLQKDENFKKEYFEKFNKNILSQLRGKIEFIGNIRGYDDPVYRKYALALSKLDPSYIFNKRNLSFGDGQLVEIYCEGITDYLFLKEYLRLFKNRGMFTDLEIRFREDSNFTGGDTQLLDAYKKIQQMNSSLNNHLTIFIFDKDNQNIIKYFENLENELDGLKHLFLPCPDGYSNSEYCIEHLFKFEDILKVIDNENRRIYLKSEFNSKGFHEEENLIYMRMNQKTLVADDEVLCLRTQKNVALSKANFADLATGKYLTLLDLSNFEKLFLEITYLKNEFYKSPQ

SEQ ID NO: 527 - protein, 511 aa, Acinetobacter sp.
  source 1..511: note = Related to NZ_KB849643.1; note = Acinetobacter soli
MPKKDGGIRQLYVPNQLIKKIQKQIFDDLQPIYSPRACAFAYVKGRNIKEHAKKHVNKRWILRVDLQDFFPNIHFGRVRGIFKLLGCNEEISTYLAQLCCYEGKLPQGTSTSPLISNILASKMDRQLSEMAKQNQCFYTRYCDDLYFSTNRKLFPQNLAFFDNSSGNRFCQLGEDLKNIIDSNDFIVNEKKVYLSDKSNRQFVTGLIVNEKLNINRKFVRSLRPDLKKLKDNPNYKNEYFEKYNKNLLAKIRGKIEFIGYIRGYEDTLYRKYALELSKLDSSYIFNKRNLSFGDGNLVEIYCEGVTDYLLLKEFLKFFKSNGMFTDLEIKFREDSNFTGGDSQLLDAYKKIQQMNSNLNSHLTIFIFDKDNQIIVKYFEALKNELKGLKYLFLPCPIGYEKKEYCIEHLFKFDDILKVVDEENRRIYLKDEFNAKGFHNNGECIYMRINQKTLIADDEVLSLSNQNNIALSKSKFAELATGKYLKELDLSNFEKLFIEITNLKNEFYTLSH

SEQ ID NO: 528 - protein, 529 aa, unidentified
  source 1..529: note = Related to JACCQO010000001.1; note = Desulfovibrionaceae bacterium
MKRIKNLTAFERQALTEKDICSYLGVYDSEVNKIIRLPTKYKYKVFTIPKKNGAQRTIQAPTYRLKEIQKRISILLCDLYPPKKSASAFIKKRGICYNANFHINNNLILNIDLENFFPSIHFGRIFGLLKSTPYNLSFIVSKIIANLCCVDGRLPQGAPSSPVIANMICGKLDAQLYKIARENQCLYTRYCDDITFSTKQNSFRGIATIHDDEFALVQLSDKLEDIIEDNGFYVNKDKVHFASKKSRQSITGIVVNEKMNVRRTYVRNLRSAIYKMEKDIDAAESEYIAKYKKSMNYASSSSIFDHISGKLSYLKMIKGDKDKTYKLLKHRFDLLLGKQSFFFSTQREQLTAAIWAIEDKNTIETGTGFMLKGVGIITCAHVIRDNPCAILDTRPGAPLRKIDMEIIKRDEALDIAILRPLGVDIRKYYALEKSDAEFHNTPEQLILAGYPGYRLGHTLSIKETYCISHRVEHAIQLIELSDQIHKGNSGGPVLDSELKVVGIAAKGGEPGQQDLAIHIGMLSSLVIRG

SEQ ID NO: 529 - protein, 557 aa, unidentified
  source 1..557: note = Related to NZ_JAEHFP010000009.1; note = Paracoccus sp.
MSLKPFANLRQIAFALRRNYRKRFVYIAYGLAPGARYKEFTIPKKSGGTRRICAPRIALLGLQRDILRLLESDYRPRAHVHGFVGGHQRSIVSNARQHVGKRWVLNIDLEDYFETIHFGRIRGRLMAPPYDYPEEIAQFIAHIACFQTEKEVEGSLRTTHVLMPGAALSPILANIVSDKLDAELARFCRQLGCTYTRYADDITISSNRRTFPAPIGRFANPDSHDDFILSDTFQQMIEDNGFRINHAKTRLLGAAFQQEVTGLVVNEKVNVKRKFVRDVRAMLHDWEFNGYAAASARHFNDKRPDRGRLPEQEATNFEWVLRGKIEFIRQVKGSTDQVFRGLAARFNALSSGGQFSIPLVEDSEVLNAAVWYLENDTDGGSVGTCFAVAENLFATCAHCLGPNLRIFPRQSPAFAMEADEVARDEHNDLALIRLRTPMPAFNPAATLQMASTAEAGALGIRSAVQAAGYPSNLDSTSLTIRDTEVTGFSRQTFDGTPATSDNVIALLSGTYEGMSGGPVLFSGKVVGVIVRGPNDDDRTIPFLAVRSEFVDALLATL

SEQ ID NO: 530 - protein, 534 aa, unidentified
  source 1..534: note = Related to JADOUJ010000023.1; note = Labrenzia sp.
MTYIAYGLAVGARYKEFNIPKKNGGTRRICAPRIALLELQRDILRLLEGDYKPRAPVHGFVGGHKRSIVSNAQQHVGKRWVLNIDLEDYFESIHFGRVRGRLMAPPYDYSEEIAQFVAHIGCFQTEKEVDGNVRTTHVLMPGGALSPLLANIVSDKLDAELSRFCRQLGCTYTRYADDISISSNRRTFPASIGRFANPDSQKEFVLSDTFQQMIEDNGFRINHSKTRLLGHAFQQEVTGLVVNESVNVKRKFVRDVRAMLHDWKLNGCEVASARHFNKKRPDRGRLPEQEATNFEWVVRGKIEFIRQVKGSTDQVFRGLAARFNELCLGRRFSIPLVEDTEVLDATVWYLENDTDAGSVGTCFAISENLFVTCAHCLGPNLRVFPRKNPEFQMEAEEVARDDHHDLALIRIREPLPAYNPATVLRIASTADASELGIRSAVQIAGYPSNLDNNSLTIRATEVTGFSRQTFDSTPTMSDNVVELLSGTFEGMSGGPVLFSGKVVGVIVRGPNKHDRTEPCLAVRSEFVDALLATL

SEQ ID NO: 531 - protein, 561 aa, unidentified
  source 1..561: note = Related to QOCE01000017.1; note = Phaeobacter gallaeciensis
MSLRRFANLRQVAFHLHRDYRRRMFHIAYGLPAGARYREFTIPKRSGGTRRICAPRKALLNLQRDMLRLIEPDYQPRAHVHGFVSGRQRSIVSNARQHVGKRWVLNIDLEDFFETIHFGRVRGRLVAPPYNYPEEIAQFVAHIACFETEKEVNGTRRTTSVLMPGGALSPLLANVVTDKLDAELARFCRQLGCTYTRYADDVTISSNRRTFPAPIGRFADPESFLEFTLSDSFQQIVEDNGFRINHDKTRLLGQAFQQDVTGLVVNEKVNVKRKFVREVRAMLHDWEFNGLAQASARHFDEKRPNRGRLPEQEASNFEWVVRGKIEFIRQVKGSTDQVFRALAARYNDQCSGQEFHIPLVEDQDVLNAAVCYLENDADGGAVGTCFAIEDDLYVTCAHCLGPNLRVYPRQNPAFPLEADVVAQDDHNDLALIRIRTPLPAFRPAAFLQLAEATEAASVDIRSAVQTAGYPSNLHSASLTMNSTEVTGFSRQSFDGTPPTSDNVISLLSGTFEGMSGGPVLHEGKVVGVIVRGPNEDDRTIPFLATRVSFLETLRAGVSSAS

SEQ ID NO: 532 - protein, 557 aa, unidentified
  source 1..557: note = Puniceicoccaceae bacterium; note = Related to REBV01000319.1
MSLKKFKNLRQVANALGRDYRKQVLNIAYGLPPKERHTEFAIPKKGGGTRRICAPRAALLGLQHDCLDLLQMDYRPKAQVHGFVSGRGRSIVSNARQHVGKRWVLNIDLEDYFESIHFGRVRGRLLASPYNYSSEIAQFVAHIACFQTTKEFDGVHRFNSVLMPGGALSPLLANIVSDRLDAEIGRLCRRLGCTYTRYADDISISTDRRTFPAPIGRCSDPERLRDFTLSDGFQEIIENNGFRVNNSKTRMLGREFRQEVTGLVVNDKVNVKRTFVREVRAMLHDWEFNGYDVAADRHFNEKRPDRGRLPAYEATNFEWVVRGKIEFIRQVKGAADQVFRALAARFNQLTSGQAFVIPLVEDREVLDAAVWYLENDVDAGSVGTCFAVGENLFVTCAHCLGPGLRVFSRRSPNFSLNAIEIARDEKNDLALIRVESLPSGLKPEAILRLATLAECGNVPTGAAVQAAGYPCNLHPDSLTVTPAQVAGFSRQTFDGSQHTEDNCIGLLSGTYAGMSGGPILHEGKVVGVIVRGPNDSDRTLQCLAVRSMYLERLLQGL

SEQ ID NO: 533 - protein, 554 aa, unidentified
  source 1..554: note = Related to JACJHV010000001.1; note = Rhizobium leguminosarum
MTLKSVPDLRFLAAALGRNLKRRLTYIAYKLPSSSKFREFTIPKRSGGTRNIQAPKVALLNLQKSIKPLIEKDYRPRVNVHGFVAGQGRSIVSNAEKHVLKKWVLNIDLENYFGSIHFGRIAGRLQSKPYNYAPEIARFVAHIACYPTQTVIAGQIQDSSVLMTGGAISPLLANIVTDKLDSEIARFCSQLGCTYTRYADDITISSNRNKFPGKIARFEDPDDQKSVVLSEEFLDLIEGNGFAVNHAKTRLLSRIFSQEVTGLIVNKKVNVPRTFIRQVRSMLHDWEANGYAAAQENHFTKYRPNRGRLPAYEAKDFQWVVRGKIEFIKQVKGATDQVFQTLARKYNSLTSGKKIAIPIVETNRIIEEAVWYLHTEKDIISTGTCFAVEGGAFITCAHCIGPNMTVFPKAAPKFPVATAALNVDGVNDLALLDLTALLPAHAPKGLLKLANVAEVSALQVGDKVQIAGFPGNLNPDAVTIAEATITRFSKTTLDGSIPASNNVMVLDGGTFSGMSGGPVLFKGKVVGVVVRGPNDNDPNEKCEAVFSTLVLPMF

SEQ ID NO: 534 - protein, 554 aa, unidentified
  source 1..554: note = Related to VITA01000024.1; note = Sinorhizobium medicae
MTLKSIPDLRFLAAALGRNLKRRVTYIAYKLPPSSKFRVFTIPKRSGGTRTIQAPRIALLSLQRSVRLLLERDYSPRVNVHGFVPGHGRSIVSNAEKHVLKKWVLNIDLENYFGSIHFGRIAGRLQSKPYGYTPEIAKFVAHIACYPTQALIDGKIQDSSVLMTGGALSPLLANIVSDKLDSEIARFCSQLGCTYTRYADDITISSNRNKFPGKIARLEDPEDHRSVVLSEAFLDLIEGNGFAVNHAKTRLLPRSFGQEVTGLVVNKKVNVPRSFIRQIRAMLHDWETNGYAAAQIRHFSKFRPNRGRLDAHEAKHFQWVVRGKIEFVRNVKGSTDQTFQTLARKYNSLTSGGKITIPIVETNRIIEEAVWYLVNENKVVTTGTCFAIEGSKYITCAHCIGPNMTVTPKSAPKFPVSVKALKQDRVNDLATLDLSALLPAHTPKGMLKLASIAEVGALKVGDKVQIAGFPGNLNEEAVTISEATITRFSKTTLDGSIPASNNVMVLDGGTFSGMSGGPVLFKGKVVGVVVRGPNDDDPNEKCEAVFSTLILPLI

SEQ ID NO: 535 - protein, 558 aa, unidentified
  source 1..558: note = Related to NZ_LFJD01000004.1; note = Bradyrhizobium sp.
MPAPTPLLNSIFLPRQLASVIGVGFRRFAYIVYVIQGSLKYRNFKLPKRRGGERLIEAPRWPLLRIQKELRPLVDELYRPRGVVHGFLKDRSVLTNARVHLKARWVLSLDLQDFFHAVTFGRIKGRLEANPFNLTPPIAHAIANAACVSGRLPQGGALSPVLSNMVADRLDGELSRLCRKFRCRYTRYADDITISTGAARFPHALAHLDDGEKRTLIIGEALRALIESNDFKLNESKSRLSGRGDRQEVTGLIVNEKLNVPRTFVRQIRAMMHAWEKFGRVAAEAEHLTKWRKSDGRLRKHDRDNFEHILRGKLEFLKCVQGENEPVCRKLLLRFNALPDRSTTSFRLLPASAIELLRESTYCLDITKYVGPSSEGSAHVREYFTGTAFFLKGVGLVTCEHCTGDEMQIYHPDRKHLKYRVHPLKVDALADVAILEVLDTMLPSPRVELEAAVSAVAIGDEVRVAGFPAKFPEGSISIARTEVIATYDRSRHPVIWKGDATVRYLIEKGVPDGVSGGPVLDARGMVIGLGVKGPSEDDPLVPCEVVPISAVQRLLRTS

SEQ ID NO: 536 - protein, 579 aa, unidentified
  source 1..579: note = Related to NZ_JXMS01000023.1; note = Halodesulfovibrio spirochaetisodalis
MKNKTTLPTPTKELLQASSNKDLARLLGFRTSSLCYILYKLPSRPYKKFGIPKKSKGVRIICAPRKPITTLQEKVYHLLLPLYRPKKSASAFIKNRSIVFGADKHSRKRHLVTFDLKDFFDSIHFGRVQGLLMATPFNIHPDVAQSLANIICYEDKLPQGGITSPLISNMICWKLDTQLTELAVNTGCTYTRYADDISISTWKKELPPEIGTLSKYDITLSEEVQKIVNDNGFEVNPSKTRYTHPSTRMEVTGLTVNRRPNIQRKKIRNLRALLHDWDINGYVEAEQRYRDKSSNPPREEATLEEIVCGKLAFLKMVRGENDPVYRKLKRKHLILSTGSIPTGLLDAVPTLNADSNYLFGEGQTDWKHLYAAFRYFRNQGLYNGLNLVISPPPAVWEGGFSNLKMMVERYKLLHNTNSKLFFLFDTDEQQAVKYARGRKDNSNLYHHQGSNVYTLLLSHTPNLCIEHLYPEEELKRANSAGRRLYLSNEFTEQGVLKDNSSITYCSEKKPFDKRWVHKKHILDADVIKTINGKKKNIACSKKDFSSQVLARPDTELVFTFDEFKPIFDAIEKALAAYKA

SEQ ID NO: 537 - protein, 537 aa, unidentified
  source 1..537: note = Related to NZ_CP009962.1; note = Collimonas arenae
MLITLSALTPPNFLDLKSFSDLALFFGIPSNKLGYLLYALQDSDKYKSFNVPKKTGGTRQISEPHPLLKKIQRKLADSLLELYKPKQSVHGYLKDKSIVSNAKMHLRKRYLLNFDLADFFTSINFGRVRGLFLNHPFNFPQEVATALARISTKENSLPQGAPSSPVISNFMCWGLDNYLRKFCYQLGCTYTRYADDISISTNRENFPTEIANVKHDPYSAVISEILTTKIEQNGFTINNAKTRFSTPRQSQVVTGLKVNEFANVSRKYVRNLRAMLHAWEKFGLDKAESEFREKYVSKHRAPFLPPVSFKQVLHGKLTFLRSVRGPNDDIYQKLLGRYSLVADLRRLTKFGFPKQINRALWILESDLFEDDYYQGTGFCLDGIGIVTCAHVLKPGTKARRIYNHLESLNIEIVERNDALDYAIIKVIGGVEEVSLIADLDFNHQLGGQVRTIGFPAHDGTASVAYEDGVIVQSRYNAAGQKWFRVNTNIVAGSSGGPVLNSEMKVIGIVAYGATNLSGGGDPINSGYIPIQCLNGPA

SEQ ID NO: 538 - protein, 504 aa, unidentified
  source 1..504: note = Fimbriimonadaceae bacterium; note = Related to JAHBTD010000003.1
MRIITSLWQLEEEWGYEAGTLAFVAYRTNIDSRYTTYNIRKRTQGYRQIDEPDELLKGVQRKIKEFLEDKYVPTTSAYAYVSNRSPVKNAALHTRKKWIVNIDIKDFFPSIHFGRICGVLQSKPFHLEASTAKVLATICTRNHALPQGAPSSPILSNIISYSLDIALIQFARSHGFYYTRYADDITFSTWQSKFPNQLLTVDHEGTRVADSLEQIISGNGFTVNGLKTRCLERRQRQSVTGLTVNKFVNVRRKYIRQVRGMIHAWQKYGEESAQKTFEEKHLNKHYVPSGRIPKFRWVLLGRLQYIGHVRGWQDPVYRKYFRQLSELWPDLSKRMRDRFDILAQNFLELSNMTDHRAKGYALEKFIYELCDDGTVGVSGQFRRQNNIEQIDGAISFNSNAVLIECKFYSERIGALLIDPFSMKLARSGAGTQGLLISMSGYTSEALETIKLNPGQNLMLLTDADLQVWLDRRLTTYEVIAAKLKALQVLREPALSLAESVEIEE

SEQ ID NO: 539 - protein, 546 aa, unidentified
  source 1..546: note = Hyphomonadaceae bacterium; note = Related to JADMJM010000027.1
MPSDTSTPTQRKAREPGPPAITINGRALQTPFDVAQYFKVAHSHMMWVLFKAPAASRYRTFEIPKRTGGMRLISAPNGLVRDLQTKLAPALAAAYEAHPSAHGFLKAKSVVTNAHEHIGQRLVVNIDLEDFFPTINFGRIRGLFMSRPFYMGAGAASVMAQIVTHRNGLPQGAPTSPALSNFIAATLDRRLTRLAKENRLRYTRYADDITFSTNQPTFPPSIVMTDVATGRVVPAETLERAIAAAGFAINRKKVRLQTRHQRQTVTGLVVNSSTNVHRARIRKIRAMIHAWEKFGLDAAASEHFAVHRGSSGKMPDHPAAAFRNIVYGQLSFVKMVRGKADPVFLKLCAKLIDLDPNPSKFIRQMVFGADDYDVFISHASEDKETIARPIFEACARRGVKAFLDEAHIGWGEDFTKKINTALGSARTVLCVISQVSVTKEWPLAEVNTALSMDVIGQKRVVPLIVGSPDLSKLPLIRGRDQLVWRGDAEIVAAELVKVVRPPKPEVTKGGAAVPVIAPNSPAEAKRAAQAKGAKKGGGFFGLFQKK

SEQ ID NO: 540 - protein, 545 aa, unidentified
  source 1..545: note = Hyphomonadaceae bacterium; note = Related to JAEUMP010000020.1
MPSEPGSEKPVRDPGPPAILWRGKPLETPFDVAGYFGVAHNHLMWALYKAPPQTRYRTFEIPKRTGGMRLISAPNGLVRDLQTKLAPVLAAAYDAHPAAHGFLSGKSVVSNAREHADQRLVLNIDLEDFFPTINFGRVRGLFMARPFFMGAGAAAVMAQIVTHRNGLPQGAPTSPVLSNFIAATLDRRLTRLAKENRLRYTRYADDITFSTNQPTFPPSIVITDQASGKIVPAETLERAIAAAGFAINRKKVRLQTRHQRQSVTGLVVNTAPNVHRARVRKVRAMIHAWEKFGLQSAAYEHFRKYRGASGAMPDDPSTAFRNIVYGQLSFVKMVRGRDDKVFLKLCAKLIDLDPNPSKFIKQMVFGADDFDVFISHASEDKETIARPIYEACARLGVKAFLDEAHIGWGEDFTKKINTALGAARTVLCVISQTAVTKEWPLAEINTALSMDVIGQKKVVPLIVGQPDLSKLPLLKARDQMVWRGDAEMVAREVAKIAKPPKPDVVKGGASLPVIAPNSTIEAKRAAQEAGGKKKGGGLFGWFGKK

SEQ ID NO: 541 - protein, 571 aa, unidentified
  source 1..571: note = Related to WGOB01000084.1; note = Alphaproteobacteria bacterium
MPPSTSDAPPEPPQAGAPVPPPPLGALAIDGAPLRNAYDVARYFGVAHGTMVWVLYTAPENQRYRTFEIPKRSGGMRRIDAPTGLVRQMQKKLAPILAGAYEAHPSAHGFIKERGVLSNAKGHAGQRLVLNIDLEDFFPSINFGRIRGLFMAAPFLCGPGAATVLAQICTLRNGLPQGAPTSPALSNFIAASLDRRLTRLAKDHNLRYSRYADDITFSTNQGVFPPAVAMKVQTEGASLGVRPGEALDRAIAAAGFAINLRKVRLQSRSVRQNVTGLTVNVAANVERSRIRKVRAMLHAWEKFGLDAAGSEHFLKHRGAKPKKGRGPVTPGAAFRNVVYGQLAYIKMVRGPADPVFLKLCGRVLDLDPNPSKFIKQMVFGAENFEVFISHASEDKELIARPIYEACERLGLKTFLDEPHIGWGENFTKKINTALGSARTVLAIVSSNSVAKDWPVLEINTALAMEVNGQKRVVPLIVGKPDLAKFPLLKGKNHVVWASDPDKVALRLLDAARPPPKPRAARPASRTAVPATGAYQPVPAGPNALPPLFAPYPPRAPKPKRSFLEWIFGRRG

SEQ ID NO: 542 - protein, 560 aa, unidentified
  source 1..560: note = Hyphomonadaceae bacterium; note = Related to JAEUMQ010000020.1
MQPPPTDGEASKPAAPAPSPLSIDGVPLRSAEEVARFLSVPYGRMIYTLYKSPDKARYRGFEIPKRSGGMRLIQSPNGLLREMQEKLGPVLQAAYEAHPAAHGFIKTRSVVSNARLHVAQRLVLNIDLEDFFPNVNFGRVRGIFMAPPFSCAPAAASVLAQICTHRNGLPQGAPTSPALSNLASATLDRRLTRLAKENGLRYSRYADDITFSSNHSQFPPAVAIFTEDGKKGLAVRPGEALERAIAAAGFSINLRKVRLQPRHVRQAVTGLTVNAAPNVERKRIRRVRAMLHAWAKFGAEAAGAEHLLKYRGAHSPGEQSARAFRNALYGELAYIKMVRGQEDRIFLNLCAKVLELDPNPSRFIRQMVFGADDYDVFISHASEDKDEIARPIFEACGRAGLKAFLDEAHIGWGQSFTQKINSALGAARTVLVIVSSTSVSKDWPVLEVNTALQFEAAGQKKVVPVIVGKPDLSRLPLLSGKDGMVWSGDADAVATRLQAAVKGDAPRRPERGAAKPPARAAPPQPPPRAAGRPGRTAVPVTAPRGPRRGFWSWLFGARPR

SEQ ID NO: 543 - protein, 563 aa, unidentified
  source 1..563: note = Related to WGNI01000003.1; note = Alphaproteobacteria bacterium
MPDPSTPSDRTRAPAFGELRLETVSDIARLLRTHPGQLSWTLYKAPETARYRAFEIPKRSGGMRQIHAPIAHVRDWQTRLAPILQAAYEAHPSAHGFLRERGIMTNARTHVGQRLVLNIDLEDFFPSVNFGRVRGLFMRSPFNCGPAAATVLAQICTHRNGLPQGAPTSPALSNFAAAALDRRLTRLARDNNLRYSRYADDITFSTNQPQFPPAVAEMRAGEGDALKVRAGEALERAVAAAGFSINHKKVRLQRRSQRQSVTGVVVNARTNLTRQCVRRVRAMLHAWKKYGLEAAGAEHFDRWRGAQANKRATTVGRAFRHIVYGELSFLKMVRGADDPVFLKLCAQLIELDPNPSKFVRQMAFGADDYDVFISHASEDKDAVARPIFEACSRLGVKAFLDEAHIGWGQSFTTKINTALGASRTVLAIVSSHSVTKDWPVLEVNTALALEANGFKKVVPLFVGAPDLSKLPLLQAKDAMVWKGDPDMVAKRVQAALKGEAPRRPAEVAPRPRWMGGRSATALPIVGVAPRGVAVRVDPPPILPPPRRTLWEWIFGRRGPPSSR

SEQ ID NO: 544 - protein, 556 aa, unidentified
  source 1..556: note = Related to JAEUMS010000023.1; note = Hyphomonadaceae bacterium
MPSSSQAETAETALLHNGRPILTAYDAAKFFGAPLGKLAGVLYRAPEEERYKSFEIPKRTGGMRPILAPIGLTRELQEKLAPVLLERYSAHPAAQGFLKERSILTNARVHAGQRLVLNIDLEDFFPSINFGRVRGLFMAEPFKLGPAAAALFAQLCTYRNGLPQGAPTSPALSNFIAADLDRRLARLARESNVRYTRYADDITFSSNQPTLPQTLIVTVAGEGRASVQVAEPLERAITASGFAINHKKVRLQTRHQRQSVTGLHVNAKPNVSRARIRRMRAMLHAWERFGLDAAAYEHFLKHRGMLKPPRDPSRAYRNVVYGQLSFIKMVRGGDDPVFLGLAAKLIKLDPNPSRFIRQMAFGGDDFDVFISHASEDKDEVARPIFEACARLGVKAFLDEAHIGWGQSFTQKINTALGSARTVLAIVSQTSVTKEWPVIEVNTALSLEASGQKKVVPLIVGKPDMSRLPLIHGKDAMAWNGDAANVARRLKAAVDGAAPRRPAAQPATTAVPVTTDKPLALRARSQAPLAIQERGPWRPPPKPKRGLFDWLGGRKRP

SEQ ID NO: 545 - protein, 487 aa, unidentified
  source 1..487: note = Hyphomonadaceae bacterium; note = Related to DPWD01000203.1
MLLHEGKPILTAYDAAKYFGVSVGKLARALYRSADEERYVRFEIAKRSGGMRPISAPVGLTRELQTRLAPVMQARYSAHPAAQGFIKERSILTNARVHVGQRLVLNVDLEDFFPSVNFGRVRGLFMAEPFKLGPAAASVFAQLCTYKNGLPQGAPTSPALSNFIAADLDRRLARLARESNVRYTRYADDITFSSNQQSLPQTLIVHAQGGDGHGVAVAETLERAITASGFNINHKKVRLQTRHQRQSVTGLQVNSRANVSRERIRRVRGMLHAWEKFGLPAAARDHFLKHRGMLRPPKDPPRAFRNVVYGQLAFIKMVRGADDPVFLNLAAKLIKIDPNPSRFVRQMAFGGDDFDIFISHASEDKDAIARPIFEACAKLGMKAFLDEAHIGWGQSFTQKINTALGSARTVLAIVSQVSVTKEWPVTEVNTALSLEVSGQKKVVPLLVGRPDLSRLPLVQGKDCMAWNGDAAAVARRLKAAVEGAAPR

SEQ ID NO: 546 - protein, 556 aa, unidentified
  source 1..556: note = Related to NZ_SBJL01000001.1; note = Vitreimonas flagellata
MPLTSIEDAEGLRLPDGRLVLSARDAAIYFGVSFGKLTHALYRADDEQRYRAFEIPKRTGGMRQIYAPHGIIRECQEKLAPVLQEFYAAHPAAHGFIKERSILSNAKLHTGQRYVLNVDLEDFFPSINFGRVRGLFMAAPFKLGPAAASVFAQLCTHRNGLPQGAPTSPPLSNFISAQLDRALSRLARENGVRYSRYADDITFSTNQGAFPPAIAVTSRGEDGGEGVRTGEALERAVIASGFAINHRKVRLQKRDQRQSVTGLNVNEKANVARKRIRRIRAMLHAWQKHGLEAAAAEHYLRHRGMLQLPQNFDRAYRNVVYGQLAFVKMVRGADDPVFLNLCAKVLEIDPNPSRFIRQMVFGADDYDVFISHASEDKHEIARPIFEACAKLGLKAFLDEAHIGWGQSFTQKINTALGSARTVLAVVSSTSVSKEWPIVEVNTALALEVSGQKKVVPLIVGKPDLSKLPLIRGKDAMVWNGDSAAVAKRLKAAVSGDAPRRPVITPSRTALPPVSAAPASATAPLRQAPVGTGPWAPPPPRKRKLSFFELLFGRRKR

SEQ ID NO: 547 - protein, 589 aa, unidentified
  source 1..589: note = Related to JAGWZE010000002.1; note = Alphaproteobacteria bacterium
MHADRRPDDAPPQAPAILVSGRAPQSASDVAALFDVSASWLTYVLYRADESQRYRAFEIPKRSGGVREINAPIGVVRDCQEKLAPLLLAAYRAHPGAHGFIPERSILTNAKAHAGQRLVFNVDLKDFFPTVNFGRVRGLFMASPFFMGPAAATIMAQVCTHKNGLPQGAPTSPVLSNFVATALDRRLTRLARENGVRYSRYADDITFSTNQTGFPAAIVAFEQDGEKRRAVVGDALAKAIADSGFAVNFGKVRLQTRHERQSVTGLVVNAMPNIERARVRRIRAMLHAWSKFGLEAAGEEHFRRWRRAKPKVKDGTAGTAFRNVVYGELAFVKMIRGREDPVFLKLCAQVLALDPNPSKFVREMAFGAADYDVFISHASEDKDTIARPIFEACEKLGLKAFLDEAHIAWGASFTEKINVALGSARTVLTIVSPASVAKDWPVLEVNTALALEVSGEKTVVPLIVGKPDLSKLPLIKTKDQLVWTGDAMFVAKNLKAAVEGRVGVKQRRTPDGGLAPAPAATGAPGPAVAARAESSRGAAQGWTPGWQSTAPKPFEIRRKSKSGGRWFVTALWAALAAALAAAAFLFGFG

SEQ ID NO: 548 - protein, 511 aa, unidentified
  source 1..511: note = Related to JAHQVS010000037.1; note = Rhodobacteraceae bacterium
MSEKFSAQELDQLLNLKLETANDVSKFLKISKPQLLFALYRASDEQKYDSWEIPKRSGGMRRIDSPRRVIRDGQKALLPYLEARQNAHPASHGFLSDRGIVTNADAHKGQRIVLNIDLANFFPSVNFGRVRGLLMKPPFEMGEAAATICAQLCTFRNGLPQGACTSPILSNFIATSLDRRLLRLARATRMRYSRYADDITFSTNAEAFPEQIVKVFSAAPLTDEALEAAMEGPASKAPKPAAPAPKIGPALERALTQCGFKVNPAKVRVQRRDERQTVTGLTVNQFPNVERRRIRRIRAMIHAWEKFGLQKAGHEHFHRYAPRQTSPGFDVARAFRNAVYGQLAFVKMVRGAEDPVFLKLCSKLTTLDPNPSKFIRRMVFGADDYDVFISHAAEDKDAVARPVFEACERMGLKAFLDEAHIGWGENYTTKINAAMGSARCVLLIISSHSASKPWPLAEINTALSLEVIGEKMAAPLVVGKPDLSKIPLIKGKDYIEWSDNPDLVARRLKDL

SEQ ID NO: 549 - protein, 558 aa, unidentified
  source 1..558: note = Related to JAHJSN010000196.1; note = Alphaproteobacteria bacterium
MPENPASTAGPPTPPTPPALPQHLRLRGRPLQTSQDVADYLGIRHRLMIDTLYNQPPNARYRHFEIPKRTGGMRPIHAPVGHTRAMQDRLLTDFKALYRPHPNAHGFIEKRSVTSNATCHTGQRWVLNIDLEGFFPSINFGRVRGLFMRPPFEMGQAAATVCAQIVTFRNGLPQGAPTSPVLSNFIAAQLDRTLSRLARQNRLVYSRYADDITFSTNLTQFPASVVVREMVVGGGYKVRAGDALELAIQKSGFEINEKKVRLQAHYFHQDVTGLCVNERVNVARERVRKLRAMLHAWRKFGLERAGQEHFAKHRGSRRLKPPSQPGAAFRNVVYGNLSFVKMVRGADDPVFLKLCAQVLALDPNPSKFLRQMVYGADDYDVFISHASEDKEAIARPLFEACNRLGLKAFLDEAHIGFGQSFAAKINTALGASRTILAVVTPHSTTKDWPLQEINTALALEISGEKKVVPVMVGSPDLTHLPLLRTKRWISWEGNADSVIRQMKQQVGPLREAKKAGSVPGIAGKKAARPVPQAKPMSGAQSQTTPRSDGWISRLFGKK

SEQ ID NO: 550 - protein, 561 aa, unidentified
  source 1..561: note = Related to JAGWZH010000139.1; note = Alphaproteobacteria bacterium
MLSSDTSNPAPETPKETLQEPPLEPHPFAWGALQTVADVAEFLGARRSDLAYWLYTASPDKRYTEFEIPKRTGGMRLISAPTDQIKTWQNRVAEKLAQSYRPHPSAHGFLEKRSVLTNARDHTGVRFVLNVDLKDFFPSINFGRVRGLFIKPPFAMAPPAATVLAQLCTFRNGLPQGAPTSPILSNFVASELDRRLTRLAKSNGVAYSRYADDISFSCNRAEFPPDLAHYEVDAGGLKTLRLGAALAKEISAAGFAPNLGKLRLQTRAMRQAVTGLTVNAKANVQRRRIRRVRAMLHAWEKFGLQAAGQEHFSRYRPSAAALRDPGPRFRHGVYGQLSFIKMVRGVDDPLFLRLCARVLDLDPNPSRFLKKMVFGDELYDVFISHASEDKDAIARPIAQALARQGLKAFLDEAHIGWGENFTKKINTALGASRYVLAIVSSHSVTKDWPILELNAALAMEANGLKTVIPVVVGKPDLGKLPLLQAKDWYVWKDDVEALALRVRQVVKGELRGAARRQAVEARGSSASAVPTEVAQEGTGPPVASSDINKKPGFFARLFRKQ

SEQ ID NO: 551 - protein, 502 aa, unidentified
  source 1..502: note = Related to JACQOS010000129.1; note = Chloroflexi bacterium
MFRAIVSVRDVADLLELDWSQLYYITSRAADRYSYRTFAIPKKGGGERVIQTPHPTVRILQHKLLEVLSLVYQPHPAAHGFVHERSIKTNATPHVNRRWVLNYDLQDFFPSITFPRVRGIFIKRFRLPPGPATVLARLCCNTGDTPDHLPQGAPTSPIISNMICHSLDHQFVQLAKRNGVFYTRYADDLTFSTNRTAFPLGIAETSGAQLIGVGNDVKEIIKHNHFDLNHRKARISGRASRQDVTGLTVNKRINVRRRLPREIRSMLHKWKAHGYEAAEVEFHTKFDVYGRGANYRNVVSGKLAFLRNVRGIDDRVFRRLYGWAKELDNDSFSELPPLATNAPSLAEAVRDFPTITASDNKQTRRGYLKRMFASARGTLWVVDPNLKADLLTDLVASIEPGRVSDIRLLSRDERLSSRQKVKYTTSRQSLLAKGVNLEWRVLPPPQRYFHDRWLADDSDCVSIGGPFSSIYDPRPPLGQNLLARRPEQFDTWWNRATPLTTG

SEQ ID NO: 552 - protein, 593 aa, unidentified
  source 1..593: note = Related to NZ_RAWI01000336.1; note = Corallococcus praedator
MASNHPEVPSDPRQLRASFVALKTPQEVAKLIGISYGQLCSIIYAKPGKFPYETFFIPKKNGTLRTISKPHPAVRSLQNKLLPFLTSAYRPKPSAHGFVVQRSIVSNARPHVGKRFILNIDLEDFFPSIHFGRVRGMLMAVPYQLPSSVASVLARICSNEGVLPQGAPTSPIISNMICARMDADLQRLAGKHRCTYSRYADDLTFSTTSRRFPEQLAVPRHGLVGENLQIGEPLIATITANGFRINTAKQRLQPRHHHQEVTGITVNRFLNPRKKLVRQARAMIFAWKKFGLQAAAAEFREKYDPKPRRASKPQPSFIRVVLGKVEHIRNVGGEGHPGYRKLLAALHQADPHHFEKPAEARTWNPRPADTSSWGYLAKRFRNSVFHLEVTNKEGDLQNGTSFLWDAGYLATAHHNLIGPVSVMINGISSPVGAGDQLHHPKANEGVDAALLKVAHTATAGKLAFKTRESAIEIGESVAALGFPTVPMYDSALIVRTGIVEGTAPQYSNQIDGIQVSIKLTGGFSGGPVIDSSGRLVGVVMEATFEKTAAGVPGGEFQHILPARYLTEISKDSAETSPQLPLQLKVVDSKQDTD

SEQ ID NO: 553 - protein, 472 aa, unidentified
  source 1..472: note = Related to VBNI01000253.1; note = Gammaproteobacteria bacterium
MLTEMYVPKAAAHGFVLTRSIASNARRHVRRELLLNVDVENFFGSIHFGRVRGMFGKPPFSFPGVVAATLAQLCTDTGTLPQGAPTSPMISNFICRRFDNDLLRLAGKHRCVYTRFADDISVSTQELAFHESIVKSFDSYGADVTLGAELVALFGKHKFTVNAKKTRVQSRHRRQEVTGLIVNRRLNVPRIYTRRLRSIIHSWRKFGKTGAETVFKTLDAGRKTRSGASPDIRSHLRGKIEFLRMVRGGGDLIYTKYALAASKLVGYDRPGRIEGAAAAIFEFYREALWVVVGRDALGSLISQGTAFFLDGVGFVSALHVLYPADSSITKWTLIRGCAPYDEFAVVGCTRHPALDLTILQTDARTHALLRGDEGQTLPGQAVVVLGFPNWHTSADKPLRADALIVQQKTISGCKLASVNYPLLSGASGGPVLNAEGWVVGVTVHNATSPVLPNSFLAIEHFASIVGSPFHAL

SEQ ID NO: 554 - protein, 557 aa, unidentified
  source 1..557: note = Related to MEDJ01000019.1; note = Acidobacteria bacterium SCN 69-37
MAKRDQVNDVEPLGTDAHLREAFPRLMTRWDVARLLRVDSKDLHYWCYRNGARYREFQLPKKSGGYRTISAPEGGIRLVQRKLCQILNAIYVPRHSVHGFVPIKGRGILTNAEPHVKQRWVLNVDLSDFFDSIHFGRVRGVFERFGAGPDAADLMARICCFRGRLPQGVPTSPVVTNLVCRSLDRALQAFAKTHRCAVTRYADDITLSTGRAGFDDAVVSVKHDEGRRVAEIGHGLRFLIESHNFSVNESKVRLSGTLDRQEVTGLIVNRKKNVPREYVRNVRAMIHAVERYGVGEAERVFHDRFSRSRRPDLPAADFLRALRGRLEFIRMVKGDHDATFVSLWNRAARFHQWLTPRIVDLSHVEQALWIVESEVATQGVSIRRHGTAFVLKDVGLVTAGHCVGERMRIWHPTRPAERFPARIRALCTASDLCVLEPPPRDRLPALDRGDAGTVAEGVEIGTAGFPDEPVKVAQLEGRVSMIRLRFGHRNLFPSFETRKGMSGAPLLDARLRVVGVVLYGPDRSPSGEEDRVPSSAVAIDLIDELPKFTGSSPALLT

SEQ ID NO: 555 - protein, 488 aa, unidentified
  source 1..488: note = Planctomycetaceae bacterium; note = Related to JAGQQN010000044.1
MVDRPVKSLLSVRTITNLADLLDVTPNQLKYLMRGLRSEERYLRFHIPKRNGGLRVIYSPRRELKAIQERFSRLLVGIYNPPGPAHGFTAARSILTNAIPHVRCRCVLNVDLEDFFPSINFGRIRGLFKSLGVPESGATVMAQLCCHDGILPQGAPTSPVLSNMVCLSLDRKLVKLAAVHRCRYTRYADDITFSHKHQILPSELAYVDDKGEPVVGHELYRAIKESGFEVNVKKVRLFDNRHRQEVTGLTVNEKPNVPRRLIRQIRAMIHAWRKHGEAAAEEEHFQCYYRRVGRRSPTNSFRDVLVGKMHFVRMIKGADDRTYRNLQRQLAHVYPEYLAVMQKENLTLKKRHLFICHASEDKESFVRPLVDQLLLRGVSVWYDEYELTVGDNLREKIDEGLKSSLYAAAVLSTSFFGDKKTWTTREIGGVTALEDADLRPRMLPIWYNLRQSEVANYAPTLAGIVALSSPRQTIEEIADELAKKVLKK

SEQ ID NO: 556 - protein, 472 aa, unidentified
  source 1..472: note = Planctomycetaceae bacterium; note = Related to JACCRE010000240.1
MASLLDVSSRQLNYLLYVRGESERYIAFSIPKRRGGIRQILAPHDDLRHVQHRLAEVLNSLYAPPDVAHGFVAGRSILSNADAHVRRRHVLNVDLEGFFPSINFGRVRGMLLSPPYSLTAQAATVFAQICCHNNELPQGAPTSPVVSNMICRRLDRQLSRLAGNHGCGYTRYVDDLTFSRRTGAFPPQLARWGESRRCIVSDELRCMIEENGFSINPRKTWLFSRCHRQEVTGLTVNTKRNVPRKYVRQIRAMIHAWSRYGIERAGQVHAAEFYRRQGRQGDVPPFALIVRGKLEFLRSVKGTTDPVYKNLQSQLVRLDPAYLQVMLRENAMLNRRDVFISHASEDKDVIARPLAEELIRLGLTVWFDEYEISIGDSLRQKIDDGLSQSAFGVVVLSHSFFAKRWTRRELDGLTAQEDATNRNRILPVWHEITHAEVSKHSPTLAGVRAARTSDQTVQQIAHEIAEVIRNAS

SEQ ID NO: 557 - protein, 571 aa, unidentified
  source 1..571: note = Gemmatimonadetes bacterium; note = Related to JACQVF010000034.1
MADLRLTSPPYVLVAAFRSLTSVGDLATLLQVRPDQLRHYTYGRGYRYRAFTIKKRRGGVRTLKEPHSGLKIVQQKLAQVLTTLYEAPDCVHGFVAGRSIATNAHLHIGSEWVFNVDLKDFFPSINFGRVRGLFIKRYGLPANVATVIARICTHKNELPQGAPSSPIVSNMVAERLDRDLQRLARRYRSAYTRYADDLTFSRNDRFPDAIGYWDPIALPVRQSRVGHLLEAAVMKNGFEINPAKVHLRLKDERQVVTGLVVNRKVNVRKLFVRRIRAMLHAWETHGEKEAEQEYFNRYDTKDRAPHAIFSFRRVVKGHIDFLGMIRGTDHSWYRRFVMQYAHLVPGYVARPEHCRRPNHLRTWKDAIWVLETEESQGTAFELTGYGLVTAAHVVRDTTLPGHPPYSNPHVFSPRNEALKHPVRIAAYDADLDLAILEFDAPTRCALRTRMAPAAVAGDPIRAAGFPSYAPGSQLWEESGWINHVRRHITAPRYVVTTPIIAGASGSPVMDLEGRVIGVATTGVLSFSAAAARSTGAAGLPDYGVVPIALLARVSVAATPASFSAPDAHGSP

SEQ ID NO: 558 - protein, 497 aa, unidentified
  source 1..497: note = Planctomycetaceae bacterium; note = Related to JAJFUI010000046.1
MAATEVVSALGGVRTRSDVANLLATSDAQLRYLLYGRHEDSRYCTFRVPKRKRGFRTIEAPREDLKLLQRRLVVILSAIYQPRAGVHGFTVGRSIVTNARQHCGRRYVLNVDLKDFFTSINFGRVFGLFRAPPISASYETATVLAQLCCHRNVLPQGAPTSPIVSNMICARLDRQLSKLAQRNWCRFTRYADDITFSKQRGEFPEEIGYLDREDVAQPGSELRRIIEANGFAINPSKVSLRTKKRSQSVTGLTVNEKCNVHRNFVRQVRAMIHSWQKFGFDAAHNEHTSRYYRRLGKLGNPPRLDQIIRGKLAFVRMVRGGLDPVYKNLQLQLCRVDPSYLDVMRKENDRMKRRDVFLSHASEDKETLVRPLADSLIAAGISVWYDEYEIQLGDSLREKIDEGLAKSRFGVVVLSRHFFSKRWPRRELDGLTAREDASHGNMILPVWHGLSKADVAGYSPTLAGLKALLTDGKPLAEVAVELVAQLRGRLKKTGGWS

SEQ ID NO: 559 - protein, 492 aa, unidentified
  source 1..492: note = Related to nan
MRIWTVSFEPTVFQEVTSIVDVANLLGTSVKQLIYLLYVRWETERYTSFAIAKRTGGTRTISAPKPELKRIQRRLADFLQDNLTPKTCAHGFARGRNIASNAEEHVHHRIVLNIDLSDFFPTINFGRVRGVFMAQPFGASPKVATLLAQICCHEGSLPQGAPTSPVVSNMICFRMDAQLMRLAKEHGCFYTRYADDISFSKRKGEFPAELATVGDNGKAVVGKSLRDIIEHNGFRVHPLKVHLHHNTTRQMVTGLTVNNRVNVPRAFIRNIRAMIHDWRVNGYEAAETRHHANYYSHPHRSVKPPLRKIIEGKLSFLKMISGVDDPVRQNLQRQFVNVCEEYKAVMEDEGIMHDFFICHASEDKDDLVRPLAEALRSWGVSVWYDEYMLTIGDDLREMIDAGLANSRYGIVVLSPRFFGVKKTWPKREVGALFAMEDADGKSRVLPIWHEVTQPDVAKRSPTLARILAWHSADFSPEELAAKFRDFIVTRRR

SEQ ID NO: 560 - protein, 558 aa, Vibrio sp.
  source 1..558: note = Related to NZ_ACFQ01000009.1; note = Vibrio cholerae
MFGIPAGLHECFTVSDLYQFLGVDPETTGGFLYGDATKYRVFSVPKKSGGEREIVAPTKRLKYLQNKVKAELESYYSPRKCVHGFVSGRSVISNAQSHVRKEYVLNIDLEDFFGSINFGRVSKLFQRPPLNLPHGVASVLAHICCHRGVLPQGAPTSPIISNMIAFKLDRQLRELAYKCSCTYTRYADDISFSFTNRKKSLPKAIAFFDSNDELVLGKELKDIIEDNWFKINDKKTRIQHRTQRQSVTNITVNEKVNVNRKFIRQTSSMLNALFKYGAVEAEREYFEKYHKGYIANRQRAKMSEQPGKLFTQKIRGRLNFIRSVRGSSCNVWRSLMYRYTVAIGNPNEIYNRSWWEIAAESTYILYDLSAEGNGQGSGFLLDGIGLVTNEHVIAGVEQNNIVDTLSIEWLPNTKKEFIGLNVAWKNAEKDLAVITSDFVFNDTVPLTLERNPNYSVGTEIFAIGYPAYETRGANKATILQAKITGEVVREGQDRVVIDQPIIHGHSGGVVLNTDGRVIGVVANGNAEGEVRTTPSAFIPISVLLEEHDRQTKASSVEA

SEQ ID NO: 561 - protein, 558 aa, unidentified
  source 1..558: note = Related to nan
MFGTPNGLHECMTVSDLYRFLGYDEKNTGGFLYGSAIKYRAFSVAKKGGGERKIYSPIKKLKNLQHIVKSELESYYVPRQCVHGFVSGKNIISNAQPHVRKEYVLNIDLEDFFGSINFGRVRKLFQSSPLSLPPSVASVLAHICCYRGALPQGAPTSPIVSNMIAFRLDRQLRELAYKNSCSYTRYADDISFSFTNRKKSLPKAIAFFNGEDELVLGKDLKDIIENNWFKVNDKKTRIQHRTQRQSVTNITVNEKVNVNRKFIRQTSSMLHAIIKYGAVKAEQEYFEKYHKGYIANKHQAKMREEPGKLFVQKVRGRLNYIGSVRGNSCDVWRKLMYKYTLAIGSPNEAYNRSWWEIAEESTYILYDLSEVGKGQGSGFLLEGIGLITNEHVVTGVEQSNIVDSLVIEWLPNQSKQFIDLNVAWKDVDKDLAVITSDSIFNDTEPLKVEPNPNYSRGTEVYAIGYPAYESRGDKSATTLKAKITGATKREGQDRIVIDKPIIHGHSGGAVFNLDGRVIGIVANGNAEGAIKATPSAFIPISTLLDEHDIRMKAQSTQT

SEQ ID NO: 562 - protein, 563 aa, Vibrio sp.
  source 1..563: note = Related to NZ_PDMZ01000012.1; note = Vibrio splendidus
MFGVPTKLHECLTVTDLYQFLGVDEDKTVGLLYGDNIRYRSFQIPKKGGGERTIFAPVKSLKNIQKKVQAELETYYKPRKSVHGFVAGRSVLTNAKPHVRKEFVLNIDLNDFFGSINFGRVSRLFQSPPLSLNQNVASVLAQICCYEGVLPQGAPTSPVISNMISFRLDRQLRNLAHRHSCTYTRYADDISFSFTNKKRSLPKEIAFFDSNDELALGHGLTSIIESNWFEINDKKTRIQHRTQRQSVTNVTVNEKVNVNRKFIRQTSSMLNALLKFGAIEAEREYFEKYHRGYIANRQHIKIAKSPGKIFLQKVRGRLNYIRSVRGKTCSVWRKLMFDYTVAIGKPDETYKKCFWEIAAESTYIVYDITAEGDGQGSGFLLEGVGLVTNEHVIEGVTNENIVDALVLRWLPNESKEFIGLELAWKNKAKDLAVITSDFIFKDNNPLEIEPEPDYSEGATVFAIGYPSFESEHGNRATILKAKIKRQMTRESQPRILIDEPIIHGHSGGVVLNEHGRVVGVVANGNAKGALRLAPDAFIPIQVLIEEHANRQSAKKAAVLQAVN

SEQ ID NO: 563 - protein, 557 aa, Vibrio parahaemolyticus
  source 1..557: note = Related to ABFKIQ010000002.1
MFVTPTGLHECKTVSDLYRFLGCDPATFGNYIYGNGIKYKEFTIPKKNGDSRTILAPVKKLKFLQQKIKAELESYYTPRQCTHGFIPKRSIISNAKSHVRKEFVLNIDLEGFFSSINFGRVSKLFQSPPMNLPPNVASVLAHICCYKGCLPQGAPTSPVISNMIAYRLDRQLRELAYKNSCSYSRYADDITFSFTNKKKSLPKSIVFFNGEDELTLGNDLTTVIEGNWFKVNEQKTRIQHRTQRQSVTSITVNEKVNVNRKYIRQTSAMLNALLKYGAEEAEREHFEKYHKGYIANRQYSKITERPGLLFTQKVRGRLNFILSVRGQSCETWRKLMYKYTLAIGEPKEQYNKSWWEIAAESTYVLYDISQDGDGQGSGFLLEGIGLITNEHVIEGVEQQNIIDTLNIEWLSNPSKTFLALELAWKDKQKDLAVITSSLAFNDVEPLKVEPNPDFSVGTEIVAIGYPAYEARGLNEATILKAKITGTQKRENQPRIVIDKPIVHGHSGGVVLNKDGRVIGVVANGNAEGSVRATPSAFIPITVLIDEHEHQKIKKTEP

SEQ ID NO: 564 - protein, 565 aa, Proteus sp.
  source 1..565: note = Related to NZ_CP041391.1; note = Proteus mirabilis
MIKPPPIFFSWDILNMFCSVTKLHECKNVEQLYYFLGCEAAEISKFLYSGVIKYRSFSILKKNGNLRNIRAPVKYLKEIQYKIKDELEKYYTPKSCAHGFITGRNIITNARPHVRKEFILNVDLKNFFDSINFGRVSRLFQSQPLNLPENVAHVLAHICCYNKALPQGAPTSPIISNMISYRLDRQLKELARNNACTYTRYADDITFSFTKTKKYLPKSIVSLSKDNNIILGHEFKKVIEDNWFEINEEKIRLQHKTQRQSVTNITVNTKINISRKFKKQTSAMVNALFKYGAAEAEREYFSKYHKGYIAERQYNKIKEKPGLLFTQKVRGRLNYIRLVCGKNNESWRKLMYKYTLAIGQPNEEYNRTLWDIAGDSTFILWANSSQGSGFFLENIGLVTNEHVIKGIEDSNINNDLIILWLPNERKEYIELHLAWKDDNTDLAVITSNISFLDIKPLQVEPVPIYDIGTEVYAVGYPNYDARGSIGKPTIITAKITSIITRERQKRIVIDQPIVHGHSGGVVLNADGRVIGIVANGNAEGELRVVPNAFIPIETLLNEHKSRTKL

SEQ ID NO: 565 - protein, 535 aa, unidentified
  source 1..535: note = Related to NZ_RKKD01000014.1; note = Shewanella vesiculosa
MLSYLYSKDIKYRNFEIDKKNGKKRKIVAPVKKLKFLQYKVKAALEPYYKPKKCNHGFVKDRDIVTNAQAHLRKEFVLNIDLVDYFGNITFGRVKRLFESNPLNLSHSVATVLAQICCHNGCLPQGAPSSPIVSNMVTFKLDNQLRALAIKSSCSYSRYADDITFSFTNRERSLPKMIAFYKNEKLQLGSSLEKVIEENGFSINDDKTRMQHRTQRQSVTNITVNEKINVNRRFIRSTSAMINALIKYGPAAAEKEHFEKYLKGYIPARHHMKMAKYPGKMFIQKVRGRLNFIRMVRGNTCDVWRKMMYLYTVAIGAPNEDYNMSWLELAAESTLVIHTYTDSNMAQGSGFIVEDIGIITNEHVVRGITSKNIKDGLEMHRWNNETAKFSFVELIGMDEDIDLAIFEPSIHLATFTPLKIENNPDYSNGTIVHTIGYPNYQSGEEPTYITAKIIGKTKRMLQPRIKIDENIRHGNSGGVVMNTDGKVIGVVSNGNAIGATSQNDSSFIPIQTLLEYHEKLRNLVARPFLDEVDSL

SEQ ID NO: 566 - protein, 565 aa, unidentified
  source 1..565: note = Related to PIQA01000014.1; note = Idiomarina piscisalsi
MRQNPPAFLRELRYLMDSQTVLPPRAKLANCSTLDQLASLLNTEVDKLLKLIYPHNRQYISFSIPKKDGSRRLISTPKPTLKNYQMIIASELHHHYIPRASAHAFIEQKSVLTNASPHVNKRYVLNLDLEDFFGTITFGRVKRLLQSPPLSLTHNVATVVAHICCYKGRLPQGAPSSPIISNMIAFKLDNQLLKLAKQYRFTYTRYADDITLSFNQKRKTSLPTDIVKFDEDSLALGRLLLRTIESNGFSVNDDKTRLATKNDRQAVTNLTVNQFVNVNRLFLRQTSAMINALNVYGAQDAEIEYLKKYHKGYLSPRKQLKHKNEPGKFFKQMVRGRLNFIRMVKGKDSLVWRKLMYRYTVAIGEPNARYALSPAELAKRSLFVIHNLTDDSEGVGTGFKLNTFGMVTNQHVIAYLDNSNLADFCVIEWIEKMDQQFPSVQLILSDEKSDIAIVEGASMNIVPALDASTSPDYTPGTTCTLLGFPNYKTEDSPTVIECRIVREIEVDNEPRIVVDEKVTHGMSGGPVIDSDGLVIGIISNGSKYNSTDDRVNAFIPIKTLLLTKN

SEQ ID NO: 567 - protein, 573 aa, unidentified
  source 1..573: note = Related to JAFIFP010000014.1; note = Idiomarina sp.
MFTLEDHINPTRLEHCSDLHILSRLLGVRRDYLLKLLYSENRLYYHFDISKKNGDKRTIHAPIEPLKNLQRKIKVELEKYYIPRGSTHGFVKKRNIITNATPHLRKRHVFNIDLADFFGTITFGRVQRVLQSSPFNMPYNVATVVAQICCHEGALPQGAPTSPIVSNIIAFKLDNQLLKLAQKYRCTYTRYADDISFSFRQQRNKLPEAIVSFNGDKVIPGAKLTDVISKNGFKINSSKTRLQSKQNRQAVTNITVNEKLNVNRRFLRRTSSMLNAALRYGFPKAESVHFEHFHSDYIPPRHSKKMHEEPGLLFRQKLRGRLNFIREVRGKSCPVWRKLMYMYTVATEEPNEDYNLSIDAITARSTVVIWDLSNSCGETFSGSGFMLKGAGLVTNQHVVKGIISGREATELQIDWLEKKCLNFLDARIVIADGCADVALITSSIADRHMEPLDIEPYPDYSVGRAVKLIGYPDYREGDTFSVTDTVIVREYGQADSRRIEVREQIFHGMSGGVVLNEDGRVIGIVSNGIKYGTTSQLPSSFIPISTLTAKVTNFRKVKIEQLLSIFASSINST

SEQ ID NO: 568 - protein, 553 aa, unidentified
  source 1..553: note = Related to NZ_JAKGAS010000007.1; note = Paraglaciecola aquimarina
MFDIIDPKTLNECFTVELLAKFLNTDYPNLSKLIYGKKSPYRTFYIPKKSGGTREIKAPIKTLKLIQQKLKVEFEDYSSPRVASHGFVKGRSILTNAKLHINRNYVLNVDLESFFNSINFGRIKKLFESTPFKFTSPVATVLAQICCHENSLPQGAPTSPILSNMIAFKLDGELMRLAKKINFRYTRYVDDLTISCQSLAQLEKHKIIYRSKEAKYEAGFTLSRLIEKNGFKINNEKTRLQQRTEHQGVTGLTVNVKLNVSRTFIRQTSSMINALIIHGAEKSEHEHFTKYFDGYVPNRQQQRISKKPGDLFIKKVKGRVNYIKMIRGAACPVYRKLAYQLTCGLGCPNEDYNKDWLDWISDSVLVLDNNLDILQGTAFYADGLGIVTNQHNLESITEDNIAGNITLVEPLNYSKKYQLLGLNKTSEKYDIALIDFGVHAKSKRALEIADSPLYKTGTTVYAIGYPNHSEGTKPTILECKIVNKTKWQGECRYKIDQNIHHGFSGGPVIDTDGKVIGIVSNGNAVGASKSTEDMFIPVETVMKFANDAKPEDC

SEQ ID NO: 569 - protein, 548 aa, unidentified
  source 1..548: note = Related to NZ_JAESDJ010000002.1; note = Alteromonas lipotrueae
MFGITEPKTLNECFTVESLAKFLGTDYSSLAKLLYSKRSNYRTFYIPKKTGGTREIKAPTKRLRFIQQKLKVIFEEYSSPRAASHGFVKKRSIVTNAQHHVGRAFVLNVDLEDFFGSINFGRIKRLFESQPFNLAHPIATVLAQICCHEGCLPQGAPTSPLLSNMIAFKLDGALMKMAKGVNFRYTRYVDDLTISCQSLTQLIKHKIVQCDKDGKYSVGFILNQLIEQNGFKTKSDKTRLQKRGEHQGVTGLTVNEKINVSRTFIRQTSSMIHALIKFGAEKAEKEHFTKYFDGYIPIRQQQRLSKFPGDLFIKKLKGRVNYIKMIRGSACPVYRKLAYQLTIGLGCPNEDYNKDWLNWISESVLVLDNNLDSLQGTAFFAKDIGFVTNQHNLKSITKDNFSGKIKLTEPLNYSKSYPLISFLKSSEELDIALIDFNIHEKSKRPLEIAESFVCRAGQTVYAIGYPNHAEGSPPTILECKIIDRAKWDNQLRIKIDQNIHHGFSGGAVIDTDGKLVGIVSNGNAVGAPHSTDNMFIPIETLLTFASED

SEQ ID NO: 570 - protein, 545 aa, unidentified
  source 1..545: note = Related to MDHN01000015.1; note = Alteromonas confluentis
MLFGTTPKDLKSCNTVEGLAHLLGTDYNSLGKLLYGKKTLYRAFDIVKKSGGVREITTPIPSLKVLQRKLKDLIEPFTSHREAAHGFIRKRGVLTNATRHVGKKHVLNTDLEDFFGTINFGRVKRLFESSPFELSSQVATVLAQIVCYKNRLPQGAPTSPIISNMIAFKLDGNLTSLARKAKSTYTRYADDLTFSCHSSMLLEKNGIIKFDKDNKAIAGKELVAIIKSNGFEINHQKTRLQSRGSHQGVTGITVNEKPNVSRTFIRKTSSILYAINRWGAEQAEEEHFAKYRRGYSPPRAQLRRKKKPGDLILKMVKGQVNYNRMIRGESCPVYRKLAYQLTIALGCPNEDLNKDWRSWIAESTFIVDNVEDICQGSCVLIKDIGFVSNQHVLNSITKSNFTANVTICDPYDYSRKYPLISLLKMSIEKDIALIDAGVHALSLRGLEVAESPNYKIGTKVIAIGFPNHTEGTPPTILDCKIIGRTKWHHEPRIKVDSNIHHGFSGGAVVDLDGKVIGIVANGTAVGAPKAADNLFIPIETVAQYA

SEQ ID NO: 571 - protein, 549 aa, unidentified
  source 1..549: note = Related to QJST01000027.1; note = Idiomarina fontislapidosi
MIDFFPKKLSDCANVEMLAYLLDTNYEALGSFLYSKRKLYRSFEIPKKSGGMREITTPIKPLKEIQRKLKPLIEPYTSHREAAHGFIEGKSIVSNASRHVRKNFVFNLDLLDFFGSINFGRVKRLFESAPFNLPAKVATVVAQIVCFDNQLPQGAPTSPLISNLIAFKLDGNLTALARRAGVNYSRYADDLTFSSNSLNLLKNHGILTIDESAQVKVGKDLKNIIKANGFDINVNKTRLQGRGQHQGVTGITVNRKVNVTRSFVRKTASILYSICKWGSANAEREHLKKYRTKSLSPRARQRTFLNEGDLILKIVKGRVNYIRMVKGEASPVYRRLAYRLTVALGCPNEDYNKDWETLLAESVYVLHNYYDSTQGSCVLIENLGFVTNKHVLKCVTTSNFEGHVVITGPFDYAKDLPLISFLGASDTNDVALICPSVHQHSQPSLKIASSPDYRKGTKVVAIGFPNHTEGTPPEILYCTIQGKTKFQKNDRYLLSCNIHHGFSGGAVLNLDGDVIGIVSNGNEVGARKSVGNMFIPIQDVAEALSHISK

SEQ ID NO: 572 - protein, 601 aa, unidentified
  source 1..601: note = Related to NZ_CGBL01000001.1; note = Yersinia aleksiciae
MAAFEFNFPTTICVGHFSTAVLHSKFADKFVAQLAIEKTWPPLFHIRIFMPSFSLKECNDVWKLCDLLGVNFENLSKKVYPSNNRLYRCFFIPKKSGGLREIYCPIKSLKNLQKKIKIELEKEIKYRSPAHGFIKGKSIITNAEQHIGKTIVLNLDLEDFFKNIHFGRIKKLFESSPLNLKHSVSTFLAHICCRGGVLIAGSPTSPIISNMICYKLDGQLQRLAKKNHCTYTRYADDITFSFTCSERKLPRGIVHIDESSLLGFKLGDELSEIISSNNFTLNESKIRLSRKSQRQEVTGLIVNSKVNVKRDFIRRTSSMIHALKIHGAEDAEKEHYLKYKKTYIPERQNKRQKDKPGDLYTKVIKGRLNYLRMVRGEDCNLWRKLMYDFTVAMKNPDESYKRTWLDDAAESTVIFNTYDGCGSGFLINHDIKKYPNGLIITNYHVIPEINSDNISNIEVHTWMNPSKGFLLLKFVASSKDLDIAILTADIPFPVSKFLVVNSCPNYRPGIKIHTIGYPDYSSGEDPTFISTKIKGKTTYHGQLRYQIIDEIKHGNSGGPVFDSDRKVIGIVSNGNEKGAPKNNKSSFIPIETLLDFINCQK

SEQ ID NO: 573 - protein, 548 aa, Vibrio sp.
  source 1..548: note = Related to JTKH01000003.1; note = Vibrio renipiscarius
MQVPLPNNLKDCSCVEGLAQYLGFTNYDDLKTLIYPSVDHLYKGFSIPKKNGEFRLIDAPKKELKKIQRFLANELAQVYTPRNATHGFVKERSIVTNASKHVDKKYVLNLDLEDFFGSIHFGRVRNLFQSHPLNLHHSVATVLSHLCCHNGKLPQGAPTSPIISNMIAYRLDKQLQTLASKNRCTYTRYADDITFSFTQTRGRLPKPIAVLTRDLQLSLGNELKELITENGFVINSDKTRIAARSNRQEVTGVIVNERMNVSRKYIKQTRSMLYAWKKFGLEDTEETYLRQFHGKTVFEKHQRRIDEKKGQFFKKIVKGRINFIKMVRGADDLIYRKVAYEFSVLIGKPKPELVQTPLDKACDSIFVVENLLDDSQGTAFLLKGIGIVTNEHVVRGIDEDLSELLELFRHHEQETKRPVKFQKSCRSRDLAILKPTTSFNGIKRLQVGDDSQIGIGSVVTVLGFPQYSPGETPYINTGKIIQSKVLFGERVWLLDIPVIHGNSGGPVLNDRQEVIGVAAIGSPTHDLSTKLHGFIPISTLLAYVEECN

SEQ ID NO: 574 - protein, 571 aa, unidentified
  source 1..571: note = Related to NZ_CP045857.1; note = Shewanella chilikensis
MVDIAKIAAIAASSSFTSVPVPVQLKDCTCVEGLAKYLGFKDYDELKGIVYPSTSHHYKSFRIPKKNGDFRTIEAPRKQLKKLLKRISTSLEEVYSPRNATHGFVKGRSIVTNASKHADKKYVLNLDLNDFFGTIHFGRLRNLFQSHPLNLSHSVATVLSHICCHNGKLPQGSPASPIISNMIAYRLDKQLQTLASKNRSTFTRYADDLTFSFTQTRGRLPKQIVSLSRDLQLKLGHELTDIVNENGFSINSSKTRISARSHRQDVTGIIVNERMNVTRKYIKQTKSMIYAWKKFGIENAEDEYLKNYHGKKIFEKHQRRINEKKGQFFRKIVKGRVNFIKMVRGSDDLIYRKLAYDFSALIGKPKPDLIRTPLDKACDSIFIIENMLDQSQGTGFLLKGIGIVTNEHVVSDIDEDLSDLLELFRHHEQDIKRPVKFQKSCKSRDLAILKPTTSYNGIKRLPVGDDSQLGVGSKVTVLGFPQYSPGETPYINTGKIIQSKLLYNEKIWLLDIPVIHGNSGGPVLNERQEVVGVAAIGSPKHDNSTKLHGFIPISTLINYAQENNKSNNNNN

SEQ ID NO: 575 - protein, 559 aa, unidentified
  source 1..559: note = Related to NZ_LSNH01000001.1; note = Photobacterium sp.
MTSAISIFSLISPITTPTTLNQCVCVERLARFLGFASYSELQNLFYPSTSIHYRGFHIPKKNGEYRLIEAPKKKLKEIQKLISKELSALYSPRKSTHGFVPERSIVSNASCHVDKKYVLNLDLLDFFGSIHFGRVRNLFQSHPVNLPLPVATVLAHLCCHNGKLPQGAPTSPIISNMIAYRLDKQLQTLAANNRCSYTRYADDITFSFTQTRGRLPNQIVTVTRELQLYLGTELKNVISENGFTINSQKTRIASRSQKQAVTGIIVNERMNVSRKFIRQTRSMLYAWKRFGLEQAESEYLQSYHGKTVFEKHQRRINEKAGQFFRKIVKGRINFIKMVRGADDLIYRKIAYDYSVRIGKPKHDLIKTPLDKACESIFIIESELDYAQGTAFLLKDIGLITNEHVVDGIDEELSELLNVYRYFEQDKKRLVNFEKSCKSRDLAILKPTTDFNGIKRLKVGDDSMLNIGSKVTVLGFPQYSPGETPYINTGKIIQSKMLYGEKLWLLDIPVIHGNSGGPVLNDKYEVIGIAAIGSPKHDNSTKLHGFIPISTLLAYAKEKS

SEQ ID NO: 576 - protein, 555 aa, unidentified
  source 1..555: note = Related to NZ_CP013139.1; note = Pseudoalteromonas sp.
MLNFSTSLIIKTPTCLKECKCVEGLARFLGFTSYSQLDELVYPSINHLYYSFKIPKKNGHKRIIKAPRKSLKSIQELINIELGNYFSPRNSTHGFIKNRSIVSNAAKHVDKKYVLNLDLENFFDSIHFGRVRNLFCSYPLVLSKPVATVLSHLCCYQGKLPQGAPTSPIISNMIAYRLDKEIQYLASNNRCTYTRYADDLTFSFTQKRRKLPRSIVKVSSDLDITIGHDLKEIISKNGFTINDSKTRISSKCQRQEVTGITVNERMNVPRSFIKQTRSMLYAWKTFGLENAEFHYLDKYHKKTLFEKHKRKIDKKEGVFFQKIVKGRINFIKMVRGSEDIIYRKIAYDYSVLTGKPNSDLIKTPLDKVCDSIFIIENMLDTAQGTAFLLKDIGMITNEHVVDGIDEDNPELLEFFRHFEQTNKKNVTFKKSCKSRDLAILKPTKDFNGIKRLDVGDDSSLDIGSEVTVLGFPQYSPDETPYINTGKIIQSKILYDQKIWLLDIPIIHGNSGGPVLDKDQKVIGIASRGSAKHDQSTKLHGFIPISTLLKYFKEKY

SEQ ID NO: 577 - protein, 565 aa, Aeromonas sp.
  source 1..565: note = Related to NZ_CP077209.1
MTLPNTILLSLKTAKLQLNPTKPTCITGCHSTDSLALFLGFQNYNELQKLIYPSVKNLYRAFYIDKKNGDKRLISAPKKKLKSIQRIISQSLSNVYSPRKSAHGFIQGKSILTNASMHVDKKFVLNIDLLGFFDCLHFGRVRNLFQSYPLNLTPSVATVLAHICCLNGKLPQGAPTSPIISNMIAYKLDKDLHQLALANRSTYTRYVDDITFSFTQSRRRLPRDIVTVLKGNNLKLGEKITSIIEKNGFKINTDKTRCFSQNFRQVVTGLVVNERANVSRNFIRQTRSMIYAWKKFGLVNAALEYLSKYHDKSILEKHEFFIKKNKDKGVFFSKIVLGRIYFIGMVRGKSDRLFREILYSYTECIGKPNRALINTPLDKIGESIFIIDNLLDDSQGTGFLLDGVGLITNQHVVDGIEKENSELLEIYRYYEQDKKRKSNFEKACRARDLAILKPTTEFNGIKRLKVGDDSILKIGSKVTVMGFPQYSPGETPYINSGKIVQSKKLFENNVWLVDIPVIHGNSGGPVLNDKLEVIGIASIGSARHDQSTKLHGFIPISTLINYVNE

SEQ ID NO: 578 - protein, 566 aa, Vibrio parahaemolyticus
  source 1..566: note = Related to ABBBER010000002.1
MIYINYFVSQLSTQLPKITLRPWVRSLKHCTSVDDLAHFLGFNSYGELNSLVYPHTKNLYKSFSISKKSGGERNIKAPKSKLKSIQRWIGQDLENYYRPRSASHGFINGKSIITNAKGHVDKRFVLNIDLEDFFTTIHFGRVKSLFQAHPLNLSHSVATVLAHICCNEGVLPQGAPTSPIISNMIAYKLDKELTNLAIKNRCTYTRYVDDITFSFTQKLGRLPRSIIKVTKQNKQILGNDLLGVISTNGFRINSKKTRLLSRDQRQEVTGLTVNDKLNIPRTFIRETRSMLYAWKKHGLIEAEEEYIKKYHKKTLTYNQQRMLKHNKGNFFRKIVHGKVNYIKMVRGEDDPIYRKIAYQYLSRIGKPDKDLLKTPHDLIADSTFIIECYLDQGQGTGFLLENIGLVTNEHVIEGIDASDADLLEIYRYYEMDNKRKVSFGKSDKSLDLGILKPTTDFNGIKRLKIGDDSTLSVGQKVTVIGFPQYSPNDTPYINTGKIIQSKVLFGQQIWLLDIPVIHGNSGGPVVNENNEVIGVATRGAEKHDQSTKFHGFIPISRLVEYHTTDT

SEQ ID NO: 579 - protein, 551 aa, unidentified
  source 1..551: note = Related to CHYZ01000002.1; note = Yersinia bercovieri
MFDPFKVAPPKLKLHQCVDVHELSAILGTNYNQLSKLIYPTTQNSYYCFSIDKMNGNKRVINAPKNKLKSIQRRLAYLLNEYYPVRDVAHGFIKNKSIVSNAEQHVLKNCVFNIDLENFFGQIHFGRIRNLLFSPPFNFSTSVSTVISHICCSDGFLPQGAPTSPIISNLICYKLDNELRRLAVYHKCTYTRYVDDITFSFTCKANRIPSQIVVSSGNTVTPGNEINAIITRNGFSINDKKTRLQQKNERQIVTGIVVNKRTNVQRSFVRKTNSMLYAWEKFGAILAEKDYFDKYNSKIKTIKLKDFIDNPGELFKSIVKGRINYIKMVRGKDDVIYRKFAHRISCLFGKFDNRYLKTPYDFAIESTFVLENRCDDSQGTAFLLERIGLVTNHHVVEDICDITDEFIDLFLWNEIGNIRKTKFIMSNKLFDIAVFERTSDFDNITPLKIGDDSGIKNGTVITVIGFPQYSPGESAYVNTGKVIQSKTMYGNKFWLIDIPVIHGNSGGPVLNDKFEVIGIASIGTAKNDSSSKLHGFIPISTLLRYTGEDKP

SEQ ID NO: 580 - protein, 549 aa, unidentified
  source 1..549: note = Related to NZ_CABHZI010000111.1; note = Yersinia proxima
MFNPSNILPPKIKLNKCGDVHILAALFNLTYEELSKLIYPTPNRSYYQFAIDKKNGSKRVISAPKKKLKIVQKKIADELLTLYPIRDVSHGFIKGKSIVSNAEKHVLKSCVLNIDLEDFFGSIHFGRVRNLLTSPSFNIPLPVATVISNICCYNGSIPQGAPTSPIISNLICYKLDNELRQLAGKYNCTYTRYVDDITFSFTYKAKRIPHQLVTSDANIINIGVELEEIITRNGFSINKNKTRLQSKNERQTVTGIVVNKKTNLQRKFIRQTSSMLYAWEKHGVVAAENEHFVKYNEKKKLIKLRDFVDKPGELFKRIVKGRINYIKMVRGEDDIIYRKFAHRISCLFGNVNNRYLKTPSDFAIDSIFILENEVDISQGTAFLLEDVGIVTNYHVVPSIDEYNDIDLSLFRYNELDNKRKVKFIMSNKLYDLAIFDTNGNFDDIKKFSIGDDSNLKVGSEISVIGFPQYTTGEYPYINTGKIVQSKALFNNKIWLVDIPIIHGNSGGPVFNEKFEIIGVASNGTERNDQSSKLHGFIPISTLIKFISSK

SEQ ID NO: 581 - protein, 598 aa, Pseudomonas sp.
  source 1..598: note = Related to NZ_AWSQ01000001.1; note = Pseudomonas taeanensis
MDIDEIFKDLFGPGFKSLDGFCQLLKVDQDKLLNFLYKRKGSHYVSFSILKKNKTHRTIKAPKRVMKKIQHALLPHLEKYYSPKPSSHGFVKGRNVKTNAQIHSRKRYVFNIDLKDFFESIHFGRVRNLFMAHPFSAPHNVATVMAQICCSDGKLAQGAPTSPLISNMICRKLDSQLQALAKSGKCHFTRYADDITFSFTSTAKYLPKDIVEVSEDGRAIPGRELEEIIKSNGFIINSEKTRLQHRTQRQMVTGLVVNEMPNVTREFIRLTSSMINALKRYGPELAEAKYLEILKGENQRLQPRQILRTKDSAGDFFIKVVKGRLNYIQMVRGRGDNIYRRLAYEFTVAIGKENPEFKKSPEEILGNSIFVVNNIIEECQGTAFLLEGVGIVTNEHVVTGVSKTIARHSISFSRAGDTREYSAELILSDKKADLAIFHPNEEFRNIPALRKSDKTIVRPTDPVLSIGFPKHRDGTTHYIAKGHTTQRRRQVDLDLWLVDFTLMEGNSGGPIFNDSMEVIGVTARGAKNNIDAALYGFIPLDSLNSFTSRADFLLLKRLYDYLGNGSLSLLPGILGKGIFSSAYQTKLHKERLQKAKAA

SEQ ID NO: 582 - protein, 598 aa, Pseudomonas sp.
  source 1..598: note = Related to CP026558.1; note = Pseudomonas amygdali
MDIDSIFKDLFGPGFQSLDGFCRLLEVDQNKLLNFLYNRKGSHYVSFSILKKNKTHRSIKAPKRVMKKIQHALLPHLEKFYSPKSSSHGFVKGRNVKTNAQIHSRKRYVFNIDLKDFFESIHFGRVRNLFMAHPFNAPHNVATVIAQICCSYGKLAQGAPTSPLISNMICRKLDSQLQALAKTSKCHFTRYADDITFSFTSTEKHLPKDIVEVSEDGRAIPGRELEEIIRAAGFAINSEKTRLQHRTQRQMVTGLVVNEMPNVTREFIRLTSSMINALKSYGPELAEAKYLEILKAKNHTLQPRQLLRTNDGNGDFFIKVVKGRLNYIQMIRGRGDKIYRRLAYEFTVALGKENPEFKKSPEEILGNSIFVVNNIISESQGAAFLLEGVGIVTNEHVVSGVSKTIARHSISFHRAGDTKEYSAELILSDKKADLAVFRPNEEFRNIPVLKKSDKTIVRAMDAVLSIGFPKYRDGTAHYIARGHTTQRRRQVDLDLWLVDFMLLEGNSGGPMFNDSMEVIGVTARGAKNNIDAALYGFIPLESLNSFTSRSDFILLNRLHDYIGNGSLSLLPQTLGKGVLSITYQAMLRKQHLLPLTEN

SEQ ID NO: 583 - protein, 598 aa, Pseudomonas fluorescens
  source 1..598: note = Related to CABVIC010000001.1
MNIEEIFKNLFIPGFSSLDNLCRLLKVEQDKLLAFLYKKKSSHYVSFFIPKKNGTRRTIKAPKRVMKRLQRELLVHLEKFYSPKSSSHGFVKGRSIKTNAQVHAGKRYVFNIDLKDFFENVHFGRVRNLFMAEPFKAPHNVATVMAQICCSEGRLAQGAPTSPLISNMICRKLDAQLQALAKSGKCHFTRYADDISFSFTSTLRHLPKDIVEISEDRRAIPGRMLEEIIKANGFTINSEKTRLQHRSQRQMVTGLVVNEVPNVTRDFVRLTSSMINALKRYGAELAEAKYLEILKGDSQPLQVRQNVRVRENAGDFFIKVVKGRLNYIQMVRGRSDRVYRRLAYDFTVAIGRENPEFKKSPEEILGNSIFVVKNITDDSQGTAFLLDGVGIVTNEHVVSGVSKTMAPHMISFQRVGENKEYAAELILSDKKADLAIFQPNGEFRNIPPLRKANRTTIRPMESVLSIGFPKYRDGSAHYIARGHTTQRRRQVDLDLWLVDFTLIEGNSGGPFFNDSMEVIGVAARGASNNIESALYGFIPLESLNRFIARKDFVFLKKIHELSGSKLLGPLTMRSGNGVFSEVYLAGKYGGCRLKPAKI

SEQ ID NO: 584 - protein, 596 aa, Pseudomonas sp.
  source 1..596: note = Related to NZ_CP054866.1; note = Pseudomonas chlororaphis
MNIEEIFKNLFRPGFSDLDNLCRLLKVDQKKLLSFLYKKNSSHYVSFSIPKRNGTPRAIVAPKRVLKRLQRELLEHLEKFYTPKSSTHGFVEGRSIKTNAQIHSGKKYVFNIDLKDFFGSIHFGRVRNLFMAQPFNAPRNVATVIAHICCSDGRLAQGSPTSPLISNMICRKLDAQLQALAKTGKCHFTRYADDITFSFTTPLKYLPKDIIEVSEDRRAIPGRELEEIIKANGFMINPEKTRLQHRSQRQMVTGLIVNERPNVTREFVRLTSSMINALKRHGCELAEAKYLELLKGESHPLQPRQIIRTKDNAGDFFIKVVKGRLNYIQMIRGRGDKVYRRLAYDFTVAIGKANPEFKKTPEEILGNSIFVVNNMTDDSQGTAFLLDGVGIVTNEHVVRGVSKSMAPHMISFQRANEEKEYTAELILSDKKADLAIFHPSAEFRSIPSLRKAERSIIRPMESVLSIGFPRHRDGAAHYIARGHTTQRRRQVDLDLWLVDFTLFEGNSGGPFFNDSMEVIGVAARGAKNNIESALFGFIPLESLNTFIARKDFVFYKKLHDLLGGCLLKALPKRSGDGVFTEIHHQRTERVTARLQE

SEQ ID NO: 585 - protein, 594 aa, Pseudomonas sp.
  source 1..594: note = Related to MOAT01000002.1; note = Pseudomonas protegens
MNIDKILQDLFMPGFGSLEGFCQLLEVDQKKLLNFLYKRRTNHYVSFSISKKNGTHRSIKAPKRTLKFLQRKLLAHIEKFYSPKPSSHGFVPGRSIKTNAQTHSGKRYVFNIDLKEFFDSIHFGRVRNLFMAQPFNAPHNVATVMAHICCSDGRLAQGAPTSPLISNMICRKLDTQLQTLAKSGKCHITRYADDITFSFTSTLRHLPKNIVEVSEDGRPIPGRELENIIEANGFVINSEKTRLQHCSQRQMVTGLVVNETPNVPRDFVRLTSSMINAMRRYGPQLAEARYLEILKSESQVIPTRQTNRARDNAGDFFIKVVKGRLNYIQMIRGRSDNVYRKLAYAFTVALGKENLEFKKSPEEILGNSIFVVNNILDDSQGTAFLLDGVGIVTNEHVVSGITKTTAPHVISFKRADDPKEYTAELILSDKIADLAVFYPNAEFKNIPGLRKADKETIRAMDPILSIGFPKHREGAAHYITRGNTTQLRYQVDLPLWLVDVPLIEGNSGGPIFNDSMEVIGVASRGSSNNIQAALYGFIPLECLNRFAKRKDFAFYRKLHEILAGGKLVRAASVRGGGVLSTRLQILLISHLNSP

SEQ ID NO: 586 - protein, 584 aa, Pseudomonas sp.
  source 1..584: note = Related to NZ_FNBM01000007.1; note = Pseudomonas seleniipraecipitans
MTLDFLSKDLAFSKFQSLSSFCKLLQVDQDKLLKFLYKKSSSHYVSFTISKKDGSLRSIKAPKKVTKMLQHRLLSHLEEFYTPKSSSHGFIKGRSIKTNGQMHVGKNYVFNIDLKNFFESIHFGRVRNLFMAAPFNAAYNVATVMAQICCCENKLAQGAPTSPLISNMICRRLDAQLQTLAKAQKCHMTRYADDISFSFTSRLRHLPKEIVEISEDGRVIPGQALETLIKTNGFAINSDKTRLQHRSQRQMVTGLVVNKLPNVPREFVRLTSSMINAMKRYGPAQAEARYLEILAQTKQIVPERQLARVKSNAGDFFIKVVKGRLNYIQMIRGRSDNVYRKLAYDFTVALGKENIEFKKTPEEILGNSIFVVTNILDDSQGTAFLLEGVGLVTNQHVVSGATHALASHVISFKRAGDERSYTAELIFSDLKSDLAVFYPGPEFKNIPHLQKADKHIIRAMDPVLSIGFPKYRDGSAHYITKGSTTQLRRQVDIDLWLVDMPLIEGNSGGPIFNDSMEVIGIASRGSVNNLQAALYGFIPIDSLTRFISRPAFGLARRVHDLLAGDKFKPLSKTGHTRLLLKCAP

SEQ ID NO: 587 - protein, 588 aa, Pseudomonas sp.
  source 1..588: note = Related to AJXE01000010.1; note = Pseudomonas stutzeri
MNLDDLLKAMFAPSLGSLPSFCNLLGVEQDKLLSFLYKRTSSHYISFHIPKKNGATRVIKAPKKALKELQKRLASHLDKFHSPKPSSHGFIKGRSIKSNALPHINKTFVFNVDLKDFFETIHFGRVKNLFMSEPFSAPHNVATVMAHICCHDGKLVQGAPTSPLISNMICRKLDSQLQSLAKAQKCHVTRYADDITFSFTSSIKHLPTDIVEVTQDGMAIPGRELEQIVRVNGFTINAEKTRLQHRSQRQMVTGLVVNKFPNVPRAFIRKTSSMINALRRYGPVLAEEKYLQILKGDKQALPARQHRRIKDNAGDFFIKVIKGRLNYIQMVRGRSDSTYRRLAYDFTVAIGKENPEFRKSPEEILGNSIFIVSNLTDDSQGTAFLLGGVGLVTNQHVISGVSKTMAPHMISFTRVGDDTEFSADLIISDAKEDLAVFYPNEQFDRIPMLKKASKESIRPMEPILSIGFPRHRDGAAHYITKGTTTQLRRQVDLDLWLVDVPLIEGNSGGPIFNDSMEVIGVAARGATQNNINAALYGFIPIASLNRFVAKPEFKLANSLHMSLRGKPCRPLCEATGKYIRKMTICSFG

SEQ ID NO: 588 - protein, 587 aa, Pseudomonas sp.
  source 1..587: note = Related to NZ_QJUN01000007.1; note = Pseudomonas dryadis
MIIDDILKALFTPGLGNLSGFCDLLGVEQEKLLDFLYKRKSSHYAAFHIPKKNGATRVVKAPKKAMKELQKSLALHLNKFYYPKPSSHGFVKGRSIKSNALPHVNKNLVFNIDLKDFFETIHFGRVKNLFMSAPFNAPHNVATVIAHICCHDGKLVQGAPTSPLISNMICWKLDSQLQALAKSKKCHVTRFVDDITFSFTSSLKHLPAGVVEVTQDGMAIPGRELEQIVKANGFLINAEKTRLQHRSQRQMVTGLVVNKFPNVPREFIRKTSSMINALRRYGPELAEEKYLQILAGNKQVVPARQHRRIKDNAGDFFIKVLKGRLNYIQMIRGRSDNMYRRLAYDFTVAIGKENLEFRKSPEEILGNSIFVVKNLTDDSQGTAFLLDGVGLITNQHVISGVSKTLAPHMISFLRAGDEAEFSAELILSDVKEDLAIFYPGEKFDQIPRLRKANKEAIRPMEPILSIGFPKHRDGAAHYITKGNTTQLRRQVDLDLWLVDVPLIEGNSGGPIFNDSMEVIGVAARGAAQSNINTALYGFIPIASLNRFVARSEFKFTSSLYAVLDGKAFRPLCEVAGKYARRGCFFIF

SEQ ID NO: 589 - protein, 588 aa, Pseudomonas fluorescens
  source 1..588: note = Related to NZ_CP075566.1
MILYNFLAAIYAPGLSSLPAFCKLLGVDQNKLLHFLYKRKQSNYVSFHIPKKSGATRVINAPKKTLKVLQRSLAEHLEKFYYPKSSSHGFVRARSIKTNAQPHVDKNYVFNIDLKDFFDTIHFGRVRNLFMSEPFNAPHNVATVMAHICCHDGRLAQGAPTSPLISNMICRKLDSQLQALAKSKKCHVTRYADDITFSFTSSLRHLPPDVVEVTGDGVVIPGRELEHIIKANGFLINSEKTRLQHRSQRQMVTGLVVNEFPNLPRAFLRKTSSMINALRRYGPVLAESKYLEILNGDKQSIPARQHIRVKDNAGDFFIKVVKGRLNYIQMIRGRGDNVYRKLAYDFTVAIGKENREFRKSPEEILGNSIFVVKNISDDSQGTAFLLDGVGLVTNQHVVSGISRLTAPHMISFIRAGLDEAEISAELILSDEKADLAIFYPGPEFDKVPRLKKSKKELIRPMDPVLSIGFPKYRDGAAHYITRGNTTQLRRQVDLDLWLIDVPLIEGNSGGPVFNDSLEVIGVAARGAAQNNIQAAMYGFIPISSLNKFVQQSEFKVTRSILDILGGKLFQPLANAKGKFVRRKILIPF

SEQ ID NO: 590 - protein, 605 aa, Pseudomonas sp.
  source 1..605: note = Related to NZ_KE695189.1; note = Pseudomonas syringae
MSSVPFSFADIFKPGLSGLPNLARLLGTNQNALLELLYPNNVRNYKNFQIKKKNGNSRSIHAPKKVLKALQRNMADYLTTLHTPKPSSHGFLIERSIKSNSIPHAGKEYVFNIDLEDFFESIHFGRVKNLFMSRPFNAPHNVAVVLAQLCCYDGKLAMGAPTSPIISNMICRKLDSQLQLLAAGKNCYYTRYADDITFSFTSSKKLLPSDIVQITEGGVGVPGGALLSIIERNGFRVNPTKTRLRHRSQRQIVTGLTVNKFPNVSRSFIRRTASMIHALKKFGAVDAEQRYLEILSRQEIDLAPRQAKRTTDSKGDFFPKVINGRLNFIQMVRGKNDSIYRKLAYAFSVAVNEEDKDLLKSAQEILGESVFSVLNLADANSEGSAFLLSGVGIVTNQHVIDGIDFDSPLELLEFSTTENPSRKLNPQLIYKSKVPDIAIFYPGEEFDRIRPLVISKQKHIRPLDPILAVGFPGGFDSCPSPYINGGKVVQGRHIYEQQHWLVDIPLLQGNSGGPIFDTSMEVIGVASRGSKKNNLESILHAFIPIDTVVKAIRKPEFLYRQRYIELRLNRKTGKVVYTRCVFAEDCIFKSAIELYWPLSKSFSYS

SEQ ID NO: 591 - protein, 617 aa, Pseudomonas sp.
  source 1..617: note = Related to NZ_UUIZ01000014.1; note = Pseudomonas viridiflava
MDNRNILEKTFEGLFSTAPFTPGFHNLDGLALLLDTDLTRLLYILYKSDSPKYNHFKIQKRNGNSRSIHAPIPEIKKLQKKLATLLQALHVPKLSSHGFLADRSVKTNALPHTKKKFVFNIDLKDFFETVHFGRVKNLFMSRAVGAPHNVATVMAHLCCFNGRLAQGAPTSPIISNMICLKLDAQLQALAHKEKCHYTRYADDITFSFTCSKNKLPKDILVYSELDAISAGKGLEIIIEANGFKINPDKTRVRHKSQRQLVTGLTVNDFPNVSREYIRRTSAMINALRKYGEVLAERKYVEINKINAVPLAARQLKRLERKEGDFFIKVVKGRLNYIQMIRGRGDPIYRKLAYYFSVAVKKENKEFLKTAEELLGEALFIVKNSLDEDSQGTAFLLDGVGIVTNHHVIDGVDLITAPHCIEFITTEKIPRVLSAELIFTSKSMDLAVFHPSSDFETLRPLQMSRRKRLKALDPILAMGFPSHIRGATPYINTGKIVQSREAYRSTFWLVDIPLLRGNSGGPVFNSSMEVIGVATMGSKNHDRTTIMHGFLPNDGISTILKNPDFLYRREILKTKKTGIRSISTRLKGVQTLAFYEHKHVGPYPLIHASWPFLSGAGG

SEQ ID NO: 592 - protein, 585 aa, Pseudomonas sp.
  source 1..585: note = Related to JAEIKZ010000029.1; note = Pseudomonas corrugata
MTTIPNFAFSLIKVKPGFGSIESLALLLGTTQDALLGLLYPQTKINYVTFTIPKKNGDIRTIHAPKNHLKHFQRLLAKYLLTTHNAKSCTHGFVENKSIKTNAQPHIGKEYVFNIDLKDFFQTIHYGRVKRLFMAYPFNAPENVATVIAQLCCFNGHLAQGAPTSPIISNMIALKLDGQILSVASKNQCHYTRYVDDLTFSFTCKKHRLPKDIVKISNEDEATPGDTLTNIILKNGFTVNPEKTRLKHRSQRQVAAGVTVNEFTNLPRSYIRLTGSLIYALEKFGPINAEIKYVEGLNEIHQLTPYQLDKIKRSNGEFFKTVVKGRLDFLKMIRGKSDSIYRKLAYRFSKAIGKEDKNLMKSAQDILGESVFVVEEMMSESQGTAFLLDGVGVVTNFHVVGGITQELAPDCVSFITNEATSRTLSAQLIFSCKERDLAVFYPDHSFDTIRPLKTRKKNGLTRVLDPILSMGYPNHSAGTPPYFNTGKIVQQRNVLGRNYWLVDIPLLKGNSGGPIFNSSMEVIGIATIGTTRNDLASILHGFLPVEKLKEIIKLPEFIYRKRYLALKNNQPNLSCLLPKSRPYYY

SEQ ID NO: 593 - protein, 610 aa, unidentified
  source 1..610: note = Related to SMFU01000008.1; note = Marinobacterium mangrovicola
MTLPLGENFFSTAQTIANELGMSYKQLSSFIYPTTNKSYRTFTIKKKGGGERTISVPKKNLKKIQRMIVDKIMKYYNPKLSCHGFTESRSIVTNAYRHVGKQFVFNVDLKDFFGTIHFGRVRNLFISKPFLYSHSAATVLAQICCKDGVLPQGAPTSPIISNLICWKLDAQLQTLAAKNNCHYTRYADDITFSFSCNKKYIPKSILDFDNDGVVVVGSSLERIIKENGFNINYEKVRLKGRSQRQEVTGITVNEFTNVERKFIRKTRSMIHAWRKFGSIKAQEHYISNYLEKDILPRQAKSIAKNDGEFFIDVVKGRVNYIQMVRGRADPIYRKLAYQMTLAMGKPNHLFLRKAEEVISDSVFIVENNLLCEQGSAFLLDDIGIVTNQHVVEGIDHENHELVDFYREDDVKNKMNSSFVYSSASKDIAIFLATANFNNIPPLPIGNDKNLRVGDSIIVVGYPDYSEGETAYINRGKIVQSILRFGKRFWLIDIPVIHGNSGGPVLNEKLEVVGIATLGSAINDGKNKFNGFVPISTLTGILNTPQYNKIYRYSLLHSKKPKVEIEKDLFYVDGLTYCKKCFLDKKQAITVYKTKSNVFFNCKICGKTYRK

SEQ ID NO: 594 - protein, 557 aa, unidentified
  source 1..557: note = Related to DUBU01000004.1; note = Micavibrio sp.
MIDFSDTILPSQEAIAKKFGYTYDQLSSLIYPKVNKSYHSFTISKKNGELREINAPKILLLKVQQTLAEELSSCYTPKNATHGFIKERSIVTNAKKHIGKRNVFNIDLKDFYGSIHFGRVRNLLMSKPFMYSQSEATILAQICCYNGALPQGAPTSPIISNLICWKMDALLQNLASENRCTYTRYADDITFSFNVKKSKLPSSIVRFDLKKDRAIVGYELSKIIEESGFVINEEKVRLAGKNQRQEVTGITVNKKPNVSRKFIRQTASMLYAWKKFGAEQAEHDYLDKYRVKKLTNWQSEKFKGAKGEFFIKVVKGRVNYIQMVRGRDDKIYRKLAFKLTDALGKPNIHFTKSREELATYVIEWMEAQGTGFLLDGVGIVTNEHVISGITSDNYAMCNVYRCYEEDKKQKCPLIFADKAIDLAVLDPTSYLSDVKPYKIGEDKYLEIGDTVKVIGFPKFGPGSTPNISEGIITSKKKIHGIDAFIVNTPITDGASGGPVLDNNNEVIGVAFWGPEHNDGSNPINGFIPISTLKNALEQHSLTNSFGAKKPVKQQKEK

SEQ ID NO: 595 - protein, 543 aa, unidentified
  source 1..543: note = Related to NZ_LN614827.1; note = Legionella fallonii
MDNIDFKDCRTVKDLSHFLGMNYKKLSSLIYPNTNRLYVTFIIPKKSGEDRTIDAPKPILKAIQRKLSIEFNKIYNPRKNTHGFICGKSIVTNANQHINKRYIFNIDFKDFFHSIHFGRIRNLFMSDLFAFTYEVATVLAHICCHNNRLPQGAPTSPVLTNIISFKLDNDLFKLSFDNKCSVTRYADDVSFSFSCNKRNFPKDILYFNKAKEIVPGIKLREVIEKNGFEINNNKVRLQNKTQRQQVTGITVNQKLNIHRSYIIKTRSMLHAWDKYGLEQAAKEYLSKYIEKDYSNNDKNRINSNESLFFKQVISGRINYIGMVRGINDEIYRKIRYKYSCLIGVPDENLKKSLDDILSESVFILENNIGIAQGTAFLVEQLGLVTAYHVIEDINEENSCLIDFFRCNEVDKKRKATLFKTSQKNDIAIFTLNNNFQDITPLKLGDASKLKRGVEIKLFGFPGYNTGDECHCDNGKITQKKKLYGFDVWLVDIPITHGISGGPVLNANNEVIGIAIVGSEKNDKSTISQGFIPITKALAMLQDQ

SEQ ID NO: 596 - protein, 541 aa, unidentified
  source 1..541: note = Related to CP016868.1; note = Legionella pneumophila
MEQTINKNFNSLDTLVSLFGINYSNLAKLIYPTTNNLYHSFSIPKKSGELREINAPNRILKEIQYKLLNELQSYYSKRNCTHGFINERNVVTNARPHVKKNIILNLDLKEFFQSIHFGRVRNLFMSNPFNFNKNVATVLAQICCHKGHLPQGAPTSPLITNLICYKLDKELSKLAFNNNCTVTRYVDDITFSFNCSHDKIPRDILDGISGESISISKKLVNIINKNGFEINYKKVRLSSSNQRQQVTGIVTNVKVNLPRKYIKKTQSMLYAWKNFSLPNAEQAHINNYLEKPYKYQRFIRYNKDKSYFNLMIKGRINYIGMVRGQSDCIYRKLLYQYTELIGNPNKELLKSVDDCLADSVFITEYPIESKQGTAFFLKDIGLVTAAHVVEGIHETNSCFLDFFRHYEVKIKRKATLFKKSEEKDIAIFYVGDDFKNLPSLKVGDDSKLAIGDQIKLIGFPDYNYHDSYLSNLGKIIQKKTMYNLDVWIVDLPINFGVSGGPVFNNKNEVIGVALQGSKKHDQSTYSHYFVPISKVIEMAQN

SEQ ID NO: 597 - protein, 538 aa, Acinetobacter sp.
  source 1..538: note = Related to NZ_NHRP01000030.1
MNFLQLQTTQDLANFFEIDLKHLMYLVHVMPGHIKYKSFKIITKKKERLISSPFFRLKKIQYRLKEEFEKIYKPRKSVYGFIKDKSIKENAINHLNKRYIFNIDLQDFFGSITAIRIKYLLQSYPFNFPSIVAEIISKLICYQGVLPQGSPCSPIISNMIAHRMDGELSFLAKKNNATYTRYVDDITFSFTKRFKALPKDILTFENGDLNVGAKLDQIINSNGFIVNQKKVRLGKRSTRMEVTGITVNEKLNVPRKYIRKIRTLLHLVEKYGEQEADRIFSTYKRTRVSKYPPRIEKAIFGMLTYLAQIVGYNNMVYYNLAKKYNSLEFKSKLLIIKPVDLQIIDALWVILLPTCEEGTAFSISNNLVVTAAHVVINEDTNQPFEEIQIYKSFAQDQIYHLEVLKYNIDADVAICKIMENYKDDSFFELGGNIENKLKLLGFPQFQPNQHKPHSADCDLMFKTTIKEYKYFSINTPIIGGNSGGPVIDSCKRVVGVASKGYFGQGIIDQGSLVNKSIHVTIMGHNLCSDIQNVKDLID

SEQ ID NO: 598 - protein, 564 aa, Pseudomonas sp.
  source 1..564: note = Related to NZ_MOBC01000433.1; note = Pseudomonas brassicacearum
MNGGFFLKFSPTLSPSTTPIELAELLGTDYAKIKRLYYHGDMQRHYLAFDIPKKSGGKRRILAPSDKLKTLQGRLASLLKKIYKPRDPVMAFRDGSSIVTNAHAHCRKKYVFNIDLENFFGTITFARVRGMLISKPYSLTAETATVIAHLATINGALPQGAPSSPILSNMICASLDRDLYSLAKSYRAVYTRYADDITLSFYCLAEFLPTEIVEYSLSNGKPNHYFSKVGNELGSLVRRHGFIINEQKVRLQGPGERRTVTGLVTNQKPNVPRPYIRKTAALIHSFEKLGEQAANILYKQKNPNSSGILESHLQGRLLFIKQVAGLESVVYRRLAQRYNMLPLKSKVPNTPIATTEDSDNFKVGEFIKNKCWVTEISENVEDELVHIQGTAFMIQGSLLVTCEHNLSYQTKQKRHEYGECLVYRVGEGQAVYEAKVIIRDKDLDIAVLRISDAPAGLEHFTLEETREPNIGDRVAILGFPNHKTGPYVGILKCRVTNKYPLHNVQHSEVDKTLYAGNSGGPVINSSYHVVGIAAKGAEGNPNGKNSFIRVTELVKYLEKSGFEM

SEQ ID NO: 599 - protein, 563 aa, Pseudomonas sp.
  source 1..563: note = Related to NZ_LJRZ01000537.1
MNGGFFLNFLSLSPSTSPAELAQLLGTDYGKIKRLYYRGDRQRHYLAFDIPKKNGGKRRILAPSDKLKTLQSRLASLLKKIYKPREPVKAFLDGGSIVSNAYPHCRKPYVFNIDLENFFGTITFARIRGMLISKPYSLTPETATVIAHLATINGILPQGAPSSPILSNMLCASLDRDLYSLAKRNRAVYTRYADDITLSFYCPAEFLPPGVVEYSISNGKPNHYYSRTGQELQSLVRQHGFTINFDKVRLQGPGERRTVTGLVTNQKPNVPRPYIRKTAALIHSLEKNGVEAANAIYKQKNPNSSGVLESHLQGRLLFIKQVVGESSVVYRRLAQRYNMLPIRSKVPNAPIATTEDSDNFKVGEFIKTKCWVTEISERIEDNLVQIQGTAFMIQGGLIVTCEHNLSYQTKERRHEYDECLVYRVGEDEGVYEAQVIIRNKYLDLAVLKIKNAPDDLEHFTLEVTKEPNIGDRVAVLGFPNHKTGFHVGILKCRITNKYPLHDVQHSEVDKTLYAGNSGGAVINSSYHVVGVAAKGAEGNPNGKNTFIRVSELIGYLQKSGFDM

SEQ ID NO: 600 - protein, 564 aa, Pseudomonas sp.
  source 1..564: note = Related to NZ_BCBD01000043.1
MNGGFFLSLFQLSSSTTPGELAQLLGTDYGKIKRLYYTGDMHRHYLAFDIPKKSGGKRRILAPSEKLKTLQARLATLLNKIYTPREPVKAFREGSSIVANAYPHCRKKYVFNIDLENFFGTITFRRIRGMLISEPYSLSAETASVIAHLATVNGILPQGAPSSPILSNMLCASLDRDLYSLAKRNRAVYTRYADDITFSFYSPAEFLPQNVVEYSLSNGKPNHYYSKVGQELETIVRQHGFTINLTKVRLQGPSERRIVTGLVTNQKPNVPRTYVRKTAALIHSIEKNGEEAANAIYKKKNPNSSGILESHLQGRLLYIKQVVGEDSEVYRRLAQRYNMLPIKSKVPNTPITTTEDSDNFKVGEFIKSKCWVTEVSENINGKLEQIQGTAFMIQGGLLVTCEHNLTYRDKDNKRHEFNQCCVYRVGEGEGLYEANVIIRCEKLDLAVLSIKEAPTGLEHFTLEVTREPNIGERVAVLGFPNHKTGSHVGILKCRVTNKYPLYEIQHSEVDKTLYAGNSGGPVINSSYHVVGVAAKGAEGNPNGKNTFIRISELIKYLQKKGFEM

SEQ ID NO: 601 - protein, 564 aa, Pseudomonas sp.
  source 1..564: note = Related to PVUL01000002.1; note = Pseudomonas simiae
MNGGFFLNFVALNPSTTPIELAEHLGTDYGKIKHLYYRGGMLRHYLEFEIPKKNGEKRKILAPSDKLKTLQSRLAGLLKKIYNPREPVKAFREGSSIVANAWPHCRKKFVFNIDLENFFGTITFSRIRGMLIAKPYSLTPETATVIAHLTTVNGILPQGAPSSPILSNMLCASMDRVLYSLAKHNRAVYTRYADDITFSFYCPIEFIPSSMVESSVSNDRPNHYYSKVGYELQSVIDQHGFTINTRKVRLQGPGERRTVTGLVTNQKPNVPRPYIRKTAALIHSIEKHGEQAANAIYKEKNPNTSGVLESHLQGRLLFIKQVVGESSVVYRRLAQRYNMLPTKSKVPNTPQATDEDSDNFKVGEFIKDKCWITEVEQKLDNDLVQIQGSAFMIQGGLLITCEHNLSHKIGDKWFEFNECLVYRVGEGESMYEAKVIIRDKKLDLAVLKIQEPPLGLKHFTLEVSKEPNIGERVAVLGFPNHKSGSHHVGILKCRLTNKYPLHDVQHSEVDKNLYSGNSGGPVINSSYHVVGVAAKGAEGNPHGKNTFIRVSELIKYLEKSGVIL

SEQ ID NO: 602 - protein, 563 aa, Pseudomonas sp.
  source 1..563: note = Related to NZ_LMGK01000001.1
MNGGFFLNFVALNPNTSPDELAALLGTDYGKIKHFYYRGEMQRHYLAFDIPKKNGAKRRILAPTDKLKTIQARIANLLSKLYTPREPVKAFLEGTSIVANARPHCRKKYVFNVDLENFFGTITFARVRGMLIAKPYSLSPETATVIAHLTTVNSILPQGAPSSPILSNMLCASLDRDLYSLAKRHRSVYTRYADDITFSFYCPIDFVPAELVDWSESNGRANHYFSQVGYELGSAIERHGFKVNQSKVRLQGPHERRIVTGLVTNQKPNVPRTYIRKTAALIHSIEKYGVEAANIVFREKNPNSTATVESHLQGRLLYIKQVVSEDSEVYRRLAQRYNMLPIKSKVPNAPQATREDSDNFRVGKFVRDKCWITNIEEYRNGKLVMIQGSAFLMKGGLLVTCEHVLSAIVDDSREEFNECLVSRIGDDESIYEAKVIIRNKELDIAVLKIKDAPADLETFTLEEVKEPNIGDRVAVLGFPNFKEGSKDVGILKCRITNKYPLFGVSHSEVDKTLYSGNSGGPVINSSYHVVGIAAKGAAGNPQGKNSFIRVSELRKYLEKSGAI

SEQ ID NO: 603 - protein, 563 aa, Pseudomonas fluorescens
  source 1..563: note = Related to SMCJ01000008.1
MNGGFFLNFTTLNPYTAPEDLATLLGTDYGKIKHFYYRGEMKRHYLAFEISKKSGGKRKILAPTDKLKTIQGRIAGLLSKLYKPRAPVKAFLVGQSIVANARPHCRKKYVFNIDLENFFGTITFRRVRGMLMAKPYSLSPETASVIAHLTTVDGLLPQGAPSSPVISNMICASLDRELYSLAKRHRAVYTRYADDMTFSFYTPIQYVPRELVEWCELDGRPNHYSSKVGHELAAVIATQGFKINEDKVRLQGGRERQLVTGLVTNQKPNVPRPYIRKTAALVHSVEKFGLEVSTSIFKEKNPNSTANIETHLQGRLLYIKQVVGEESKVYRRLAQRYNMLPIKSKVPNTPIATPEDSDNFKIGKFIKDKCWVIEINEEINGKLVSSQGSAFLIGGRLLVTCEHVLAENFIDGERIEVNECLIRRMGDENIYEAKVIIRSKDLDIAVLKIVDPPAGLEVFSLEDIKEPNIGDRVAVLGFPNFKEGSNDVGVLKCRLTNKYPLSGVMHSEVDKTLYSGNSGGPVINTSYHVVGIAAQGAAGNPEGKNSFIRVSELKRYLDKSGAI

SEQ ID NO: 604 - protein, 559 aa, Pseudomonas sp.
  source 1..559: note = Related to NZ_BQIA01000029.1; note = Pseudomonas otitidis
MEAFLNLIGLTPHTTPQELAQLLGTDYSKIKRLYYRSPITRHYHEFNIPKKNGDKRKILAPSEKLKTLQLRISALLNKLYDPRAPAKAFIQGRSIVDNAAPHCRKSFVFNIDLNNFFPSITFGRVRGLLMAKPYSLSSETATVIAHLSTVNGSLPQGSPCSPVISNMICAGLDRELYSLAREHRAFYTRYADDITFSFYCPLGFISRKIVIPSLSNQHTNHYDSKVGELLNEIIISHGFTINQGKVRLQGSNERQVVTGLTTNQKPNVPRTFIRKTAALIHSIEKTGLEQANLIFREKNPNSKGTLDSHIRGRLLYIKQVVSEESVVYRRLAHRYNMLPISAKVPNPAISAIENNENFKIGEFIKNKCWIVNLCEDIDGDVVVLQGTAFTIKNRLLVTCAHVLQYSGKDFDDCEIFRVHEAQKTLKAKVIIRDNQSDIAILKILEPPSNLEPFTLEEEKEPNIGERVAILGFPNFKEGATSVGILRSRITNKYPLFAPPVMHSEVDKTLYAGNSGGPVINSSYHVVGIASKGAAGSPTGQNSFIRISELIKILERYETN

SEQ ID NO: 605 - protein, 559 aa, Pseudomonas sp.
  source 1..559: note = Related to NZ_NEIR01000012.1
MDGGTFLLGTLGPTTTPDELARMLGTSYSKIKHFYYSRDMGSNYRQFTIPKKNGEKRVILAPENWLKTLQLRLAKRLQLLYKPRKGVTGFVKNSGIADNANLHKRSRYLFNIDLKDFFPSIKFHRIRGLLIAKPYSLMPETASVIAHLCTFRGSLPQGAPTSPILSNMFCASLDRELYTLAVRHNATYSRYADDISFSFYCPLRSLPPEIVVTSERQGELNHYKATIGDKLREAILRFGFEENERKVRLLSRTEKQLVTGLVSNCKANIDRRYVRSTAAMIHSLEKDGETVANERRKAKHPDSTTPVAAHVQGRLLFMHQILGKNSPVYARLANRFNVLPLKFKVPPPSLSTSEREASIAVNRFVRAKCWVVEVAIDVPGDCIISQGSGFMIEGGLLVTCAHVLEEKGVLVDECEIYHVDDDAQRYNATVLHRDRNADIALLKIEDCSENEYFHLESDEEPNIGDRVVILGFPNVKNGAKVGVLQAQVSNKYPLYDPEIMHSEVDKLLYPGNSGGPVINARQRVVGIAAKGAAGSAEGQNSFIRVSELFKVLKAADGLN

SEQ ID NO: 606 - protein, 559 aa, Pseudomonas sp.
  source 1..559: note = Related to NZ_JABWRZ020000002.1; note = Pseudomonas oryzicola
MDGGILINDCLNPSTTPEDLAFMLGTSYNKIKRFYYDRDMSANYRHFTIPKKNGEPRHILAPENWLKTLQIRLARRLTLLYTPRKGVTGFIKESGIVVNADKHKRSSYVFNVDLQDFFPSINFHRLRGMLIAKPYSLLPQTASVIAHLCTYRGSLPQGAPTSPVLSNMFCASMDRKLYELAIRHKATYSRYADDITFSFYCPLRYVSSAIVKASGRQGELSHYKATLGDELKSIINNFGFVENERKVRLLSRTEQQLVTGLLANAKANIDRRYIRKTAAMIHSLERDGETVANERRKEQNADSSTPLAAHVQGRLLFLHQVLGKTSPVYARLANRFNVLPLKFKVPPPQLTTSEREAIIAVSKFVRAKCWVVQVAIDVNDDCIIAQGSGFMIESGILVTCAHVLEEKGVTVDECEIYQVDDDGQKLTAEVIYRNRAIDIAILKVHDCGTQEFFHLETDEEPNIGDQVVILGFPNVKDGARVGVIQARISNKYPLYKPEVMHSEVDKMLYPGNSGGPVINSRQRVVGIAAKGAAGSSEGQNSFIRVSELIKILPALKERL

SEQ ID NO: 607 - protein, 558 aa, Pseudomonas sp.
  source 1..558: note = Related to JAAFOZ010000019.1; note = Pseudomonas savastanoi
MGGVFLLSDRLGPTTTANELAVMLGTSYAKIKYFYYSRPIGDCYKQFSIPKKSGGKRLILAPDDKLKTLQTRLAIRLAEIYTPRKGVTGFIPGSNITKNAKLHSRSKYVFNIDLENFFPSIKFYRIRGLLTAQPYSLMPETATVIAHLCTLNGALPQGAPTSPILSNMFCASMDRMLYSLAVKFKATYSRYADDISFSFKCPLRFIPEDIVKVFSRQGELSNYKAELGSVLSVIIADFGFSENKKKTRLLSRSEKQIVTGLVVNTKANVDRRYVRKTAAMIHSLEQVGEEVSNERRAEKTPGSTTPLAAHVQGRLLFIHQVLGKTSPVYARLSNRFNVLPLKYKVPSSMVLTSEREASIAVNKFVRSKCWVVEVAIDIPGDCIISQGSGFMISKNMLVTCAHVLEEKGVRVNECEIYQVDNDAVRHQAEVLFQDFNTDIAVLKLLDFQVDEFFHLEEGEEPSIGDPVVVLGFPNVKNGAKVGVMRAQVTNKYPLSKPPVMHSEVDKMLYPGNSGGPVINARQHVVGIAAKGAAGSAEGQNSFIRVSELSKLLAANKPA

SEQ ID NO: 608 - protein, 561 aa, Pseudomonas sp.
  source 1..561: note = Related to NZ_CP081943.1
MNGGFFLSSDHLGPTTTPDQLATMLGTDYAKLKYFYYRSGMQQHYREFKIPKKSGGVRTILAPGDKLKTLQLRLAKRLTRMYRPRKSVKAFVEGTSITHNAAAHCGKKFVFNIDLKDFFTSITFARVRGLLIAKPYSLMPETATVIAHLTTVGGVLPQGAPSSPVLSNMLCASLDRDLYSLAVKNHAAYTRYADDISFSFYCQISYLPSELVVTTGSSDNSNHYNSLAGEELSRLISRHGFRVNEKKVRLQAYTERQVVTGLIVNRKPNVDRRYIRKTSALIHALEKLGAEEANAVRKVKQPDSTTPLEAHIQGRLLFIKQVVGLESEVYKRLADRFNMLPIQYKVPKPVSEKLEKDLNFRIGKYVLDRCWVVDVCIDVPGGCVVSQGSAFMMKGQLLITCAHVLAEKKITVNECEVFRVDSPDERYEAKVIYRNDHVDIAILKIQDGLENYESFNLEEAEEPNIGDRVVVLGFPNFKEGSTSVGVIRTKISNKYPLDKPGVMHSEVDKLLYPGNSGGPVLDSANHVVGIAARGAAGNAEGQNSFIRVSELLKILKARQVV

SEQ ID NO: 609 - protein, 565 aa, Pseudomonas sp.
  source 1..565: note = Related to NZ_QYYB01000004.1
MDGDISSPKPTLDSSTTPELLATILGTSYGKIKYFYYGRSGSRTASFYTRFEINKKNGGVREIYAPNKQLKVLQGRIASLLSNLYKPKKYVTAFVKGTSLYDNAINHTRKSFVFNIDLKDFFPTITFARVRGLLISKPYSLDPSTASVIAHLTTVNGHLPQGAPSSPVISNMICASLDRQLNSLAKQHRAQYTRYADDITFSFYCPLKYLPLEIVNTQANPEKINHYNARTGSKLREIISTNGFIVNPGKVRLQFKHERQVVTGLTVNKKVNVDRRYIRKTSAMIHSIESLGIEGAKFLNIALNPSKENPDEAAFELEPHIQGRLLFIKQIKGESCPVYRNMAIKFNSLSEEYKVPLSSHESKDNISINANVVDKCWILEIEETISQGSGFIVEGGLLVTCAHVVASKDDADKPVESCTVFRVSNKSDQYKAIVVHYDKHRDIALLKIDHDTHKFPFFRIEEKIPVKQNDKVSVYGFPDYKPASTYVGCVWARVVNGFIASAVTYYEVDKVLYSGNSGGPVLNSNLHIVGIAAKGAVDGHELNAFLCKSELEKVITTYSALHNDA

SEQ ID NO: 610 - protein, 580 aa, Pseudomonas sp.
  source 1..580: note = Related to NZ_LGLH01000057.1; note = Pseudomonas syringae
MDEGSLPEESLKLTSESSVDDLAAILGTTYPKIKYFYYSSSVAGHYSKFSIAKKGGGKREILAPDNHLKVLQKRLAHQLSFLYKPNPRATAFLSNSSIVRNASFHTRKRFVFNIDLKDFFPSITFARVRAMLMSKPYSLTPQTATVIAHLATVKGKLPQGSPCSPVISNMICSSLDMQLRTLAKRHKASYTRYADDITFSFYVPMQYLPEDIVVLGGDDGEKTHHAVSVGTALSEIITKKGFVIHPGKVRLQRRDEKQVVTGLVVNQMANVDRRYIRKTSAMIHSLSTLGLETANLIHKSKSPDLTSKLSAHVFGRLLFIHQVKGVDSPVYRRLGMRFNQLESQYKVPLAKLLESYSDAGMKHNQLNIRRCWVLENEKWGTQATGFMLENNLMITCAHAFNYVLNPEIDSDVECCIEHDCKEVWFDDCTAYRVNDRSIKYTVKVLFLDKHRDLAVVSFSETNEKFEYFRLEYDLQAEIGDKVSILGFPNFKVGSTDVFRFWAAVSGRYVRSTIECGSIDKVVYSGNSGGPLINSNQHVVGVIRRGAAGDPEGTNEFVCASEVANVLTQYLSTLVVAPERV

SEQ ID NO: 611 - protein, 576 aa, Pseudomonas sp.
  source 1..576: note = Related to NZ_UWFG01000172.1; note = Pseudomonas viridiflava
MDEGSSVDESLRLTSESDVDDLANILGTTYPKIKYFYYSRRVASHYSTFSIPKKSGGKRQILAPDNHLKVLQKRLARQLSFLYKPNPRATAFLSNSSIVRNASFHTRKKFVFNIDLKDFFPSITFARVRAMLISKPYSLTPETATVIAHLATVDGKLPQGSPCSPVISNMICASLDTQLRTLAKKHKASYTRYADDITFSFYVPMLYLPEDIVVLDDNEGGKTHHVVSVGPVLSEIISKKGFKINSKKVRLQRRDEKQVVTGLVVNQKVNVDRRYIRKTSAMIHSLFTIGVDKANIIHKAKSPESSSELSAHVFGRLLFIHQVKGVDSPVYRRLAMRFNQLETPYKAPLAKFVEVHEDAGMKHNQLNIRRCWVIENEQWGTQATGFMLENNLMITCAHAFNYKLSDKIDSDIEYAIENNCDEVLFKDCVVYRVNERAKKYSAKAIFLDKHRDLAIVSIDQTDERFEFFRLEENLEVEIGDKVSVLGFPNFKIGSTDVCRFWAAVSGKYIRSTIECGSIDKVVYSGNSGGPLINSNQHVVGVIRRGAAGDPEGTNEFVCTSEVFKVLKEYQSTLVVG

SEQ ID NO: 612 - protein, 576 aa, Pseudomonas sp.
  source 1..576: note = Related to NZ_CM001514.1; note = Pseudomonas synxantha
MDEGSSVDESLRLTSESDVDDLANILGTTYPKIKYFYYSRRVASHYSTFSIPKKNGGKRQISAPDNHLKVLQKRLARQLSFLYKPNPRATAFLSNSSIVRNATFHTRKKFVFNIDLKDFFPSITFARVRAMLISKPYSLTPETATVIAHLATVDGKLPQGSPCSPVISNMICASLDTQLRTLAKKHKASYTRYADDITFSFYVPMLYLPEDIVVLDDKEGGKTHHVVSVGTVLSEIISKKGFKINSKKVRLQRRDEKQVVTGLVVNQKVNVDRRYIRKTSAMIHSLFIIGVDKANIIHKAKSPESSSELSAHVFGRLLFIHQVKGVDSPVYRRLAMRFNQLETPYKAPLAKFVEVHEDAGMKHNQLNIRRCWVIENEQWGTQATGFMLENNLMITCAHAFNYKLSEKIDSDIEYAIENNCDEVLFKDCVVHRVNERAKKYSAKAIFLDKHRDLAIVSIDQTDERFEFFRLEENLEVEIGDKVSVLGFPNFKIGSTDVCRFWAAVSGKYIRSTIECGSIDKVVYSGNSGGPLVNSNQHVVGVIRRGAAGDPEGTNEFVCTSEVFKVLKEYQSTLVVG

SEQ ID NO: 613 - protein, 531 aa, Pseudomonas sp.
  source 1..531: note = Related to NZ_RWIM01000011.1
MSAYYRSFSIPKKSGGVRTIFAPSNRLKVLQARLKVQLSNLYLPSPCAKAFLKDTSIVSNANAHIRKKFVFNLDLKDFFPTISFARVRGLLISKPYCLKPETASVIAHLATINGNLPQGAPCSPVISNMMCSSLDRELRALAIKHRANYTRYADDITFSFYTPMEYLPADIVIVNAGTLTSHHLATVGPELLKIISGKGFQVNFSKVRLQRQDEKQVVTGLLVNKKVNVERRYIRKVAAQIHSMMCIGLDAANAIHKANDPDANTTLEGHVFGKLLFIKQVKGVDSSVYRRLAMKFNQLDAPYKVPLAKLEEFSGDAGLKHNQLNIRKCWVLENEDWGTQATGFMLENNIMVTCAHAFNYKLNEDNDSDADYMFEHNVTEVWFEECVAYRANERSKKYAAKVLYMDRHRDVAIISIVDADRRFEFFRLEENIQVEVGDRVSVFGFPNQKPGSTDVCRFWADVNDRYVRSMIQCASIDKVMYAGNSGGPVLNLNQHVVGIVRRGAAGDPLGTNEFVCSSEIFKVLEDMNKVV

SEQ ID NO: 614 - protein, 555 aa, Pseudomonas sp.
  source 1..555: note = Related to RBNR01000201.1; note = Pseudomonas syringae
MSKLDSAIDVDGLASLLGTSYTKLRHFYYKPDTSAYYSTFEIDKKSGGKRTIMSPEKRLKTLQSRLKVLLEGIYVAKKQVNAFVKDRSIVTNARAHTRKKFVFNIDLENFFPSITFARIRGMLMAKPYSLQSGVATVIAHLATVRGFLPQGSPCSPILSNMICSSLDRQLLTLAKKHRGEYSRYADDMTFSFYDDLQFVSEEIVRCLKGDGLSNHYHCRVGFYLESVILKSGFKINESKVRLQGRYERQIVTGLVVNKKVNIERQYIRKTSAMIHSMSSDGLDFAREKFKSKAKESSVMLDAHLQGRLLFIKQVVSVDSPVYKRLAKKFNLLGLKYKVPLGKSKNIRGAESRRYSKWYDDRCWVIESELTTADVYDCAQGTGFVIKDGYVITCAHVVKFNGVIANEIQLFRVSSRGDVCKASVVMCDEDRDLAILRILDPALQDLPYFDLSDTSADIGDGVDVLGFPNDKLGATHVGRQKVSVRNKFSISAVTFCQIDKELYAGNSGGPALNEDGDLVGVVTAGNDGDGYNDHSRFVCISELKKVLHLLIGVKDA

SEQ ID NO: 615 - protein, 558 aa, Pseudomonas sp.
  source 1..558: note = Related to NZ_WLYI01000015.1; note = Pseudomonas karstica
MKLDSTLSVDGLASLLGTSYIKIKHFYYKPNTSAYYSTFEIDKKSGGKRKIMSPEERLKTLQRRLKLLLEGVYVSKKQVNAFVKDRSIVTNAKSHTRKKFVLNIDLEDFFTTITFARVRGLLIAKPYALQPSVATVIAHLATVHGFLPQGSPCSPILSNMVCSSMDRQLLSLAKAHRAEYSRYADDISFSFYDNLQFISEDIVETVKSDGLHNHYQCQTGQALESIILRSGFKINESKVRLQGRYERQVVTGLVVNKKVNVDRQYIRKTSAMIHSISTDGLALAREKFKSKVKDSSVMLDAHLQGRLLFIKQVVTVDSVVYKRLAKKFNLLEIDYKVPLGKSKSVRGLESRRYSKWYDERCWVIESELSTAEEFDCSQGTGFAIKGGYIITCAHVVKLKGGIANDISLCRVSKRGEVYKASVIVCDDNRDLAVLKIVEPALAILPYFDMSETIADIGDGVDILGFPNDKLGATHVGRQKVSVRNKFAISAVTFCQIDKELYSGNSGGPALNDDGDLIGVVTSGNDGGGFNDHSRFVCISELKKVLQDLVVAANEQALA

SEQ ID NO: 616 - protein, 574 aa, Pseudomonas sp.
  source 1..574: note = Related to NZ_FNCT01000024.1; note = Pseudomonas benzenivorans
MSKLKLCKSVDELAALLGTTYGKIRYFYYLHPTSESYSTFEIKKKSGGVREISAPSDKLKTLQGRLKVFLSEIYEPKKYVTGFVNGKSIVANAKPHTRKKFVFNLDLQNFFPSITFARVRGLLISKPYSLNSSVATVIAHLVTVNGKLPQGGPCSPVISNMICSSLDRKLKTLAVKNRAEYTRYADDITFSFYDDLEYVASDIVQILKGDELPNHYFARCGRSLERLIIDAGFKVNYLKVRLQGRYERQVVTGLVVNKKPNVNRQYVRKTGAMIHSIETKGLEEARRIHSEKIIKQEKKSGSGKEEEIKVPPVEAHIQGRLLFLKQVVGLESQVYRRLALRFNLLRLKYRVPLGVSKNKFSEDFRKFTKWYDSKCWVVEVEGEIRGEFECGQGSGFMISDQVLVTCSHVLDLKGVKLDEATVYQASSRSRSYKANLLYRDDHRDIALLKISVDKSEFDYFDLETSVLADVGDEVSILGFPQDKLGAQSAGNQTAFVRNKFPISGVGFVEVDKELYAGNSGGPVLNQDSRVVGIVGVGNDGEYCDHSRFICVSELLKVLERFKAASVDKSKLEPA

SEQ ID NO: 617 - protein, 566 aa, Pseudomonas fluorescens
  source 1..566: note = Related to NZ_CABVIZ010000005.1
MTKLNSTTDVDGFAALLGTSYQNIRYYYYSKPMSLYYNSFEIPKKNGGVRVIMAPSEQLKTLQDRLKVLLDELYTPKSSATAFIKGRSIVDNAKQHTRKKYVFNIDLSDFFTSITFPRVRGLLMAKPYSLQSGVATVVAHLCTVSGVLPQGSPCSPVISNMICSTMDRQLKGLAIRNRARYSRYADDITFSFYDDIKYISGELVACLKGDDLPNHYFSRCGKVLNSIIESCGFKVNSSKVRLQSRYERQVVTGLVVNKKANVERAYIRQTSAMIHSIEKNGLAFARQRFSEKNPPDPKSGTKLVLDAHLHGRLLFIKQVVSIESEVYRRLAMRFNFLDLNYKLPLGVSKNHRGIEFRKSTPWYDKRCWIVDTEFDLVFGQGSAFFVNDEFLITCSHVSEFDGCFVDVAEVYRAGSRGDKYSAKVVYRDVARDIAILIIDTDRPLAFETFDVATKMADVGDVLSVVGFPKDKLGAQHAGRQSVEVRNKFASSGVKYFEVDKELYAGNSGGPVLDADNNVVGIVAKGNDGDYCDHSRFICISELASVLQGYEKQKHVAPVVELELEKA

SEQ ID NO: 618 - protein, 558 aa, Pseudomonas sp.
  source 1..558: note = Related to NZ_CP061723.1; note = Pseudomonas putida
MSKLNSSIDVDELAGLLGTSYGKIRYYYYSKPIPDYYKTFEISKKSGGVRVISAPHDQLKVLQERLKILLDELYTPKSSAMAFIKGRSIVENAKQHTRKKFVFNLDLSDFFSSITFPRVRGLLMAKPYSLQSGVATVIAHLCTLNGILPQGSPCSPVLSNMICSGLDRQLKSFAIKHRARYSRYADDITFSFYDDLNYISPDMVSVLMGDGVSNHYYVKCGRPLVTIIESCGFGINLSKVRLQGRYERQIVTGLVVNKKVNVERSYIRKTSAMIHAIETKGLGFARERFAASNPPVDPDTGVQVVLDAHLHGRLLFIKQVVGVESEVYRRLAMRFNFLDLNFKLPLGVSKNRRGVEFRRSTPWYDKRCWIVETELDLEFGQGSAFFVADNVLVTCSHVSEFTGRFTSESEVYRANARGKKYNAGVVYRDKARDISILKLNDESLVFEKFEISTRLADVGDVLSVLGFPNDKLGAQHAGRQTVVVRNKFSMSGVQYFEVDKELYAGNSGGPVLDEDNNLVGVVAKGNDGHYCDHSRFICVSELLVVLEDYKKAILQVSV

SEQ ID NO: 619 - protein, 554 aa, Pseudomonas sp.
  source 1..554: note = Related to LKBT01000034.1
MTIPRLKACTNVDDLASILNTSYKKIAYFYYEVDYSKKRYYENFEIPKKNGNKRTISAPLAQLKNLQKKIAVLLGELYIPNPNAHGFIAEKSIITNAKIHTRKKYVFNVDLNDFFNTITFPRVFGLLTSQPYLINEKVASVIAHLCTLDGCLPQGAPTSPVISNMICQKLDRQLSRLAFTHRAVYSRYADDLSFSFYAPELHVSGEIVVFEQGAGNYYAKAGEQLNRIVNINRFSINPGKTRLQDRFERQTVTGLVVNKKINVPRQFVRKTCAMIHSIESFGLKTAQERFLIENPNSKSSIDNVIFGRILYMKSVVGYSSVVYKRVALRFNQLDLERKVPLSSSKDGKFSAKYLNWVNRRCWVIDNHETIEQGSGFMMAGNLLITCAHVVGNAKEIEVYRTCDTEKYKATVCYVSPDKAVDVAIALIQNPPTRFEEFHHKEETPNIEVGDLLTVLGFPKYKDDAKNVWINKASIVNQIKSSSSLIGYLDKELYGGNSGGPVLNEDGSLVGIVIKGNKDAEGIDDIYVDHSAFLHLSYVLACVKSLKEKYAADDI

SEQ ID NO: 620 - protein, 549 aa, Pseudomonas sp.
  source 1..549: note = Related to NZ_AZQQ01000096.1; note = Pseudomonas mandelii
MSKLQECLNTQDLADALGTNYKKIAYFYYDVDYSKKSYYENFEIPKKNGGSRVIKAPVARLKNLQKKLSFLLDEMFVPHSCAHGFVKEKSIVTNAKNHSRKKYVFNIDLNNFFTTITFPRLYGLLISKPYSLNNDVASVIAHLCTVDGCLPQGAPTSPILSNMICRSLDRQLRRLARLHRADYSRYADDITFSFYAPESFVNESIVVFKDGSGNYFSSAGNTLKKIIDKNKFSINESKTRLQDRFERQLVTGLVVNKKLNVPRAFIRKTCAIIHSIENFGIASAQARYIKENPCSMARVENVIFGRILHIKNVVGFDSVVYKRIALRFNQLNINRKAPLSNGKNGVVSAKFCNWANRRCWVIENNDEISQGSGFMISENLLITCAHVIGSAKVVEVFRAGENIKYEAVVCYTSSDPHIDVAILKIKDAPAPFEEFHYKDEAEALNSGETLTILGFPKYKHDAKNVWINKALLINQVKTASSSYGYIDKELYAGNSGGPVLSENGALVGLVIKGNNDAAEVDDIYVDHSAFLSFSDVLTCVKALKAKYTM

SEQ ID NO: 621 - protein, 550 aa, Pseudomonas sp.
  source 1..550: note = Related to NZ_CP034337.1; note = Pseudomonas entomophila
MNTPILQQCRSVDHLSAALGTNYKKISYFYYDLDSTKISYYEPFLIPKKSGGTRQILAPKPQLKNLQKKLQDLLEDLFKPHACAHGFISERSICTNATPHTRKKYVFNIDLQDFFSSITFARIFGLLISKPYSIEKSVASVVAHLCTVNGHLPQGAPTSPIISNMICRTLDRQLTLLAVANRAAYSRYADDITFSFYSPQEHTSSELVKFEKNSGNYFALPGEILSQIISRNKFKINPKKTRLQDRFERQIVTGLVVNKKINVRREFVRTTCAMMHSIESFGLASSQARYEIENPGSQSKVENVILGKILHIKNVASFASPVYKRLARRFNRLELSLKAPLSSTNEDNFDAKYCNWVNRRCWVIDNNDTISQGTGFMIQENFLITCAHVADGAKELEVYRACDETKYTAWVLGTYPQVDVAILKIQNSPGIFEEFHSRETPRKLNIGDNLHVLGFPKFKSNTKTVWINKAKLIGHTIVHNSNVNYIDKELYGGNSGGPVLDEDGALIGIVIKGNNDTDKVSDIYVDHSAFLDFQHVLDCLKLLKEKYSTT

SEQ ID NO: 622 - protein, 587 aa, unidentified
  source 1..587: note = Related to RZHD01000010.1; note = Halomonas populi
MPITSAQIAASGTPLRLKCKLVMRKVKPKRRPMLDTKTTPHELAVLLGTTYSKLCYTLYKKHTDNLYKDFTIPKKNGGVRKISSPKPILKNLQSKLKLLLDDIYRPHPSASAFIANRGLIYNTTPHIKKALIFNIDLKSFYGSIHFGRVKGMLISKPYCLREDTAQLIAHICCYYKTIPQGAPTSTTISNMICRRLDRELSFLAKKNHAYYTRYADDLTFSFHKIKPNEICAFEDNIWKPSDRLINVISNNTFKINNTKTRGETSRCRQVVTGLKVNTKVNVDRRYIRTTKAMIHSLSLDIESANEYFSSIRKGENEATLETVVAGRINFIGMVKGTECSIYQTLAHKFNNLNIDLKVPTRSNIDTTSQNDNQLKTLEYRKQEKLKKCIWVVSFDGIEGIELDEQLTQGTAFMIKGQKLLTCNHTFEKAGNPSYCLIHRIDDSSIKYYARLVKVDKHRDVALLEIDSKDKVFFDHLEIYFNDDMHSGYKVNLAGFPEYRSGHRDVTVLPSTIIRHEVVSLVKHYSVNSELLGGFSGGPVLNLYNQVVGMVTKGRYISHDKDAGQSTLEGSNSFISAVEFEKFLGSSN

SEQ ID NO: 623 - protein, 546 aa, unidentified
  source 1..546: note = Related to NZ_JABUZC010000043.1; note = Halomonas sp.
MLDSNTTPRRLAALLGTTYPNLCLTVYKVRPNNLYTTFKIAKKSGGVRTIAAPDKRLIYLQDKLKSLLEELYSPHPAATAFIKDRGIIYNASPHVGKALVFNIDLADFYGHINFGRVRGLLSAPPYNLRPDTSQLIATICCLNGSIPQGAPTSPVLSNMISRQLDRRLSLLAKKNHAFYTRYADDITFSFRNNNFEGVCFSVNGVFQPSSELIKLVEKSGFYLNKQKTRGEVSRSRQVVTGLKVNKKINVDRRYVRTTKAMIHALSGDIDTANVVFWQKFPEKEPKRLENVVAGRINFIGMIKGVNSRVYQMLAKKFNRLPLKQKLSTRTSKLVDTDQKYRDMAKQRELQKCVWILDFEGAPNVTDEAEFIQGTAFMVKGQQVLTCSHTFNKADDAEYCYISRIHERGVKYLMKVAKRCKHRDIAELEFVNEPNEIFQSLDIYHKEEMFPGYQVSLVGFPDYMSGHTTVSVINTSITSHVNISTVDNYEVDAEIGAGYSGGPVINDFHQVIGMIVSGRTTSVDFETQESALTGRNAFISAHHFLQF

SEQ ID NO: 624 - protein, 544 aa, unidentified
  source 1..544: note = Related to NYSM01000021.1; note = Alcanivorax sp.
MISSKTTPRALAHSLGTTLPKLNYTVYKLGVSRFYNEFEIEKSDGGKRTINAPEGRLKIIQDRLKVLLDELYSPHPSASAYIKERGIVYNAKKHVKRKVVANIDLKNFFGTIHFGRVRGVLIAKPYCLRADTATLIAHICCLDGVLPQGSPASPVISNMISRRMDRELSLMAKKNRAHYSRYADDITFSFKSKKDTELFDFKNRSVGSKIVRCIEENGFSLNERKTRIQFSSERQTVTGLKVNKKINIDRRYIRETKAMVHSLSFGSLEANKKFIDKYGRDDAQLEDVVFGRVAYIGMIKGRDSSVYQGLARKFNNLDWDRKLSINPGKILKDLEWSGFAFKAEGYRARFEQCVWVVSFDGVKGLGLDEMLVSGSAFSLKGGRVLTAFHVFVKAGMPDYCYLYRINKPGKKYKAKIKSVYEDRDVLELKFDEEVENIRYLDVAPNKFPGTGYELAVLGFPQLHPGHQSLTILPCKVVNTYIGSTFRYCEVDAQISGGNSGGPVVNAYMQVVGMALRGVDVASHEDRVELEGSNAFISAEHFPSP

SEQ ID NO: 625 - protein, 544 aa, unidentified
  source 1..544: note = Related to NZ_VCGW01000002.1; note = Marinobacter maritimus
MIQPTTSPSDLASLLGTTHSKLNYTLYSFPLEYSYTKFTIEKKNGSSRQIRAPNPKLKIIQKRLKNHLEKLYRPHSAATAFVAGRGIVDNAKRHIKRECVFNLDLDSFFDYIHFGRVKGLLVAPPYNLRDDTAKLIAHICCLNGRLPQGAPTSPLISNMVARSLDHKLSRLAKKYKARYSRYADDITFSFQKKTDGIIFHVDEGVVKPSVELVDIIENAGFLINIRKTRVQYYDQRQVVTGLKVNSVVNVDRRYIRTTRAMLFSLSQGVESANMKFFEKVGGDPERRLENVVHGRIAFIGMVKGRGGSVYQTLSQKFNDLGLDIQSPIGPAEIKDELEQKLHFYSYKNRARLQRCVWVVDFGGVPGLDMDQELVQGTAFMIGGQRILTSAHTFAKAGNPVQCKLYLVNEPGKKYSAEVVNINNNSDIAELKLINVDGSFPVLKVAPNLKTNTGYKVSIAGFPQLQPGHQSVAITPCTVINTLNISSHRYIEVDTPIQGGSSGSPVLNVYMQVVGMAAMGVSVTKDGEDVQLEGTNAFVSAVHFP

SEQ ID NO: 626 - protein, 585 aa, unidentified
  source 1..585: note = Related to nan
MNNKPSLSLFDDPQVASFLAANTKMELAAAINEPYRRFTYLLFAIDPDRQYKSFDIAKGNGKSRIIDAPVTALKNIQKKICAILSKIYVPPYPANAFIFGRSIVTNAIPHVKAKSVLKLDLQDYFPSIHFGRVRGLFMAPPFSFNQDVATTLARACCKGGCLPQGAPTSPILSNMISLKMDAQLNRIAKSNRCNYSRYADDITFSSTKDIFPLVVTNAKGLYEPAQEITDCILRNGFAVNTYKTKFMVGRDSKFVAGIKVNSKINTSRKHVRAVRAMLHALEKFGPEASVAEHLRRWRRRHTISSPTNFLQILKGKISFIRMVKGGGDLSVVRLENRLDEWMSLYSGAQVDVRRVETLIAQDDTYHAVVYTEGKTDALHLRYALKRLQKLSLYNNMKLIFYDFPPDTTSGETELKKILGTAKVANNTGKLKIVIFDRDVTGDVGDSRRPKYWGSNVWSFKLPCPGPRTLYENVISIEHYYPDKILFKQDNEGRRLFFVDEFDANTLAHKSIAGVICRKDVIGKKRPGVVICEGVRDQQGKSLTLSKSDFSKNIARGQFFVSDTEMLEFKPVFSAIERLIKKNHYC

SEQ ID NO: 627 - protein, 353 aa, Nostoc parmelioides
  source 1..353: note = Related to JACJQL010000002.1
MKDSSKLVLTDTPESLREKFYSLKQASDIADLLGVSYPRLVYHIYVVDPNQRYTTFEIAKKSGGVRQISTPITALKIIQRKLNQVLQAVYEIKPSVHGFVMGKNIVTNAQAHAKKRYVFNIDLKDFFPSINFGRVRGMFMATPYGLHPEVATVLAQICCHNNQLPQGAPTSPIITNMICAKMDSQLQRLAKECKATYTRYADDITFSTTLPKFPRDLAYIVNDENEEKLNVGDTLIQIISENGFEVNESKVRLQIKGNHQEVTGLTTNIFPNIDRNYIRQVRAMLHAWAKFGLEDAEKEYQRKHEFRSRFNQKEQHSFKQIILGKIEFIGMVKGKNDTIYKKYMQQYKILASL

SEQ ID NO: 628 - protein, 338 aa, Nostoc parmelioides
  source 1..338: note = Related to NZ_JACJQL010000002.1
MREKFYSLKQASDIADLLGVSYPRLVYHIYVVDPNQRYTTFEIAKKSGGVRQISTPITALKIIQRKLNQVLQAVYEIKPSVHGFVMGKNIVTNAQAHAKKRYVFNIDLKDFFPSINFGRVRGMFMATPYGLHPEVATVLAQICCHNNQLPQGAPTSPIITNMICAKMDSQLQRLAKECKATYTRYADDITFSTTLPKFPRDLAYIVNDENEEKLNVGDTLIQIISENGFEVNESKVRLQIKGNHQEVTGLTTNIFPNIDRNYIRQVRAMLHAWAKFGLEDAEKEYQRKHEFRSRFNQKEQHSFKQIILGKIEFIGMVKGKNDTIYKKYMQQYKILASL

SEQ ID NO: 629 - protein, 401 aa, Anabaenopsis sp.
  source 1..401: note = Related to NZ_CP063311.1; note = Anabaenopsis elenkinii
MISVVDPATVYFTVSFNPDVHPDNCFILSRISENIPASDIFLLSTTDKVPKKSHLFLQRSPELLREKFYSLKQPVEIADLLEISYSRLIYHIYLVTPEERYKSFGIPKKSGGIRQITTPITALKIIQSKLNQVLQAVYDIKPSVHGFVMGKNIVTNAQAHVKKRYVLNIDLKDFFPSINFGRVRGMFMATPYGLHPEVATVLAQICCHNNHLPQGAPTSPIISNMICGKMDSQLQRLAKDCKATYTRYADDITFSTTLSQFPRDLAYITNDEDGEKLVIGNSLLNIINTNGFEINQSKVRLQTRGNHQEVTGLTTNVFPNVDRTYVRQVRAMLHAWAKFGLEAAEKEYLSKYEFKNRLPQKAKPTFKQVLRGKIEFIGVVKGKDDTIYNKFITQYNILKKW

SEQ ID NO: 630 - protein, 377 aa, unidentified
  source 1..377: note = Related to NZ_LZQD01000011.1; note = Trichormus sp.
MQKNSKLFLTETPEALKEKFYSLKKPTDIADLLEVCYSNLIYHIYVVKPEKRYKIFDIPKKSGGIRQISTPITALKIIQRKLNQVLQAVYETKPSVHGFVSSRNVVTNAQNHVKKRYVLNIDLKDFFPSVNFGRVRGMFMATPYGLHPDVATVLAQICCYNHELPQGAPTSPIITNMICAKMDGQLQRLAKECKATYTRYADDITFSTSLSKLSKDLAYIVNEEDQEKLIIGDTLFKIIKQNGFELNDNKVRLQTRGNHQEVTGLTTNVFPNVDRNYVRQIRAMLHAWSKFGLEAAAKEYSIKYESKSRLINNEKLEFKPVIREKIEFLGIVEGKKDQLKFKKVIRGKIEFLGMVKGKNDPVYQKYFNIYQQLIKSV

SEQ ID NO: 631 - protein, 330 aa, Nostoc calcicola
  source 1..330: note = Related to JACJRQ010000001.1
MDIADLLEVSYSRLVYHIYLVEPDKRYKTFEISKKSGGIRQISTPITALKIIQKKLNQVLQTVYEIKPSVHGFVTGKNIVTNAQAHTKKRYVLNLDLTDFFPSINFGRVRGMFMATPYGLHPDVATVLAQICCHNNQLPQGAPTSPIVTNMICAKMDSQLQRLAKEYKATYTRYADDITFSTTLPKFPEELAYIVAEEDVDTVFIGNRLLSIINDNGFEVNNHKNRLQVKGNHQEVTGLTTNLFPNVDRKYVRQVRAMLHAWAKFGLEAVEKDYQDKYESKSRLSTKGEPNFRQVLRGKIEFIGMVKGIDDSIYQKYLKQYQLLSTLVIS

SEQ ID NO: 632 - protein, 330 aa, Nostoc sp.
  source 1..330: note = Related to JACJSJ010000006.1
MDIADLLEVSYPRLVYHIYLVEPDKRYKTFEIPKKSGGIRQISTPITALKIIQKKLNQVLQTVYEIKPSVHGFVMGKNIVTNAQAHTKKRYVLNLDLTDFFPSINFGRVRGMFMATPYGLHPDVATVLAQICCHNNQLPQGAPTSPIVTNMICAKMDSQLQRLAKEYKATYTRYADDITFSTTLPKFPEELAYIIAEEDVEKIFIGNRLLSIINENGFEVNQEKVRLQSRDDHQAVTGLTTNQFPNIDRKYVRHIRAMLHAWSKFGLEAAEEQYLTKYENKSKLPIKDNPTFHQVLRGKIEFISMVKGKDDPIYRKYIKQYKNLVSFSRI

SEQ ID NO: 633 - protein, 362 aa, Cylindrospermum stagnale
  source 1..362: note = Related to NC_019757.1
MQKDSHLILTDSPETLRERFYSLTKPIDIAHLLGISYRRLVYHIYLVEPEKRYKTFDIPKKSGGIRQISTPITALKLIQRKLNQVLQAVYQTKPSVHGFVSGKNIVSNAQAHAKKRYVLNLDIKDFFPSVNFGRVRGMFMAKPYNLHPDVATVLAQICCHNNQLPQGAPTSPIITNMICAKMDSQLQRLAKDCKATYTRYADDMTFSTTLPKFPEELAYIVAEEECKKIVIGNRLTAVINENGFEVNQQKNRLQVKGNHQEVTGLTTNLFPNVDRKYVRQVRAMLYAWAKFGLEAAENEYFEKYLFKSRLPIKKDLKFQQILRGKIEFIGIVKGKNDFIYQKYSNQYKILTKLSISNKIRED

SEQ ID NO: 634 - protein, 362 aa, unidentified
  source 1..362: note = Related to CP021056.1; note = Richelia sp.
MQKGSNFILKYKPEFLAEKFYALKNPMDIADLLGISYGRLVYHIYVIESENRYKIFDIPKKSGGIRQISTPITALKIIQQKLNQVLKTVYKPKASVHGFVSDKNIVTNAQAHTKKRYVLNIDLKDFFPSMNFGRVRGMFMATPYNLPPDVATVLAQICCHNNQLPQGAPTSPIITNMICAKMDSRLQRLAKDCKATYTRYADDITFSTTLPQFPNDLAYTGTEEDTEKILIGNRLLAIIHENGFEVNEQKIRLQVKGNHQEVTGLTTNIFPNVDRKYVRQIRAMLYAWAKFGLEAAENEYFEKYVSKSRLSIKPKLEFQQVLRGKIEFIGMVKGKEDSIYQKYMNQYKILARLSIVNKNSED

SEQ ID NO: 635 - protein, 330 aa, Anabaena sp.
  source 1..330: note = Related to JADEWB010000105.1
MDIADLLEISYSRLIYHTYIVYPERRYKTFEIPKKSGGIRQISTPITALKILQRKLNQVLKAVYEPKASVHGFVTGKNIVTNAQAHVKKRYVLNIDLKDFFHSINFGRVRGMFMATPYGLHPNVATVLAQICCYKNQLPQGAPTSPIITNMICAKMDGQLQRLAKTYKLTYTRYADDITFSTTLPHFPRELAYILTEEDNEKIVIGDNLLRIIHENGFEVNEQKIRLQVKGNHQEVTGLTTNVFPNVDRKFVRQVRAMLYAWAKFGIESAESEYLTKNRYESIFPGKEKPTFQQALRGKIEFIATVKGKNDPIYRKYLSIYKQLIKPESV

SEQ ID NO: 636 - protein, 359 aa, unidentified
  source 1..359: note = Related to JACGCP010000001.1; note = Dolichospermum sp.
MQQDSQLLLKLTSETLREKFYDLRRVLDIAELLEVSYDHLVHHIYLIESEHRYTTFEIPKKSGGIRQISTPITAIKIIQKKLNQVLQAVYQTKPSVHGFVNGKNIVTNAQSHCKKCYVFNIDLKDFFPSINFGRVRGMLMATPYNLPPDVATVLAQICCYNNQLPQGAPTSPIITNMICAKMDSQLQRLAKDCKATYTRYADDITFSTTLPKFPNKLAYVLTGEDTEKVFIGNRLLAIIHENGFEVNEQKIRLQVKGNHQEVTGLTTNLFPNVDRKYVRQVRAMLYAWAKFGLEAAENEYFDKYVSNSRLPIKQKLKFKQVLRGKIEFIGMVKGKEDSIYQKYINQYKILRNKKSTNSY

SEQ ID NO: 637 - protein, 373 aa, unidentified
  source 1..373: note = Related to LWHC01000033.1; note = Cyanobacterium sp. IPPAS B-1200
MTINFPQGQLISPPWDKKSLLLLNRSPEELKNDFYQLKTPLDVAKLLNIPHKRLVYHLYLVDSQRRYKTFTIPKKSGGQRQISTPITALKIIQQKLNQVLQAVYQVKPSVHGFVQDKNIVTNAKAHAKKRYVLNLDLENFFPSVNFGRVRGMFMAIPYHLPPDVATILAQICCQNNELPQGAPTSPIVTNMICGKMDSQLQRLAKDCKATYTRYADDITFSTTLKNFSTDLAYVVNEGEAEKVVLGDLLSGIIRENGFNVNEKKTRLQTKGNHQEVTGLTTNQFPNVDRRYVRQVRAMLHAWAKFGLEAAQKEFEEKYNHKARFSGKQIPHFQDVLKGKVEFIGMVKGKDDLIYQKYINEYKQLLNLNFPKNI

SEQ ID NO: 638 - protein, 369 aa, unidentified
  source 1..369: note = Related to NZ_CM001775.1; note = Geminocystis herdmanii
MTINLPQWQLIFPHLHNQNPLLLQDSPEELSKKFYELKTPLDVAKLLNIPHKRLVYHLYLVDSQKRYKTFTIPKKSGGERQISTPITALKIIQQKLNQVLQAVYQVKPSVHGFVQDKNIVTNAKAHVKKRYVLNLDLENFFPSVNFGRVRGMFMAIPYHLPPDVATVLAQICCHNNQLPQGAPTSPMVTNMICAKMDSQLQRLAKDCKATYTRYADDITFSTTLKDFPPHLAYIVDYGNNEKVMLGESLLNIIRENGFSVNEKKTRLQTKGNHQEVTGLTTNQFPNVDRRYVRQIRAMLHAWAKFGLESAQKEFEEKYHHSARFSGKEIPRFQDVLKGKIEFIGMVKGKDDSIYQKYISQYYQLLKIYF

SEQ ID NO: 639 - protein, 374 aa, unidentified
  source 1..374: note = Related to NC_019779.1; note = Halothece sp.
MVINLPQGQLIEKKRSKREQKSSLLLLKKSPEELRTKFFELNSPRDVAKLLGISYGRLVYHIYIVSEANRYKTFEIPKRSGGVRQISTPRTALKIIQWKLNQVLQAVYKPKPSAHGFVPNKNIVTNAQAHSKKRYVLNLDLKDFFPSVNFGRVRGMFMGTPYSLNANVATVLAQICCHNNQLPQGAPTSPIITNMICAKMDSQLQHLAKSCKATYTRYADDITFSTTLKQFPESLARVITEEGEERVILGEPLLGIIAENGFEVNEQKIRLQTKGNHQEVTGLTTNQFPNVDRRFVRQIRAMLHAWQKFGLEAAEAEHRERYRNKANFPGKSESNFKEVLRGKIEFIGMVKGRNNEIYQKYLQWYVKLLKFGSN

SEQ ID NO: 640 - protein, 367 aa, unidentified
  source 1..367: note = Cyanobacteria bacterium SW_9_44_58; note = Related to PXPI01000109.1
MVINFPKGQLIPENSNIKSKSYAHLLLKDNPETLREKFFSLSTARDLAKLLNVEYRRLVYHIYIVPPSKRYKTFELPKNSGGTRQISTPQTALKIIQWKLNQVLQTIYEPKPSVHGFVSGKSIVTNAQAHAKKRYILNLDLKDFFPSINFGRVRGMFIAAPYGLTPEVATVLAQICCHNNQLPQGAPTSPIITNMICAKMDSQLQQLAKACKATYTRYGDDITFSTTLKEFPESLAKVVTEEGKEKVALGEPLLGIIAENGFQVNENKIHLQAKGNHQEVTGLTANKFPNVNRKFVRQVRAMLHAWAKFGLEAAEKEFQEKYASKSRLPSKSTASFKEVLRGKIEFIGMVKGKEDKIYSKFIDKFNI

SEQ ID NO: 641 - protein, 376 aa, Synechocystis sp.
  source 1..376: note = Related to NZ_CP063659.1
MLNSAVQEKINIHPLDHQAQIKERFTLPGSPEELRQKFLALQTPDDLASLLNLTYPRLAHHIYRVPSDKKYKTFTLPKKMGGERTISTPISALKIIQWKLNQILTAVYEVKPSAHGFVPGKNIVTNAKAHAGKRFVLNLDLADFFGSVNFGRVRGLFMATPYNLPAKVATVLAQICCHEDKLPQGAPTSPIITNMLCAKMDSQLQRLAKECRATYTRYADDITFSTTLKEFPEALAYAIETEDGDKLLLGDRLLGIITENGFKINEKKVRLQVRGNHQEVTGLTTNEFPNVKRTYVRQIRAMLHAWAKFGLEAAEKEYYQKYEEKVKFSLKKKASFSQVVKGKIEFLGMIKGKDDDLYQKMLKSYLKLKKSAPVTN

SEQ ID NO: 642 - protein, 374 aa, Synechocystis sp.
  source 1..374: note = Related to NZ_CP054306.1
MLSSVIENKVIVHPLDRQAQAKERFVLPGSQTELRQKFLKLQTPDDVARLLNLDYRRLAHHIYHVPTEQKYKTFTLPKKTGGERTISTPVSALKIIQWKLNQLLTAVYEVKPSAHGFVQGKNIVTNAKVHAGKRFVLNLDLADFFGSVNFGRVRGLFMATPYNLPAKVATVLAQICCHEDKLPQGAPTSPIITNMLCAKMDSQLQRLAKECRATYTRYADDITFSTTLKEFPEALAYAVETEDGDKLLLGDRLLNIIADNGFNINEKKVRLQVRGNHQEVTGLTTNEFPNVKRTYVRQIRAMLHAWAKFGLEAAEKEYHERYNFKARFALKEEASFKQVLKGKIEFLGMVKGKKNLAYNKFLKSYYNLTNFGKK

SEQ ID NO: 643 - protein, 339 aa, Synechococcus sp.
  source 1..339: note = Related to CP000955.1
MQTPQNVAVLLDVEYDKLIYHIYSSNVDERYKKFEVYKKSGGIRTITTPVTSLKFIQWKLNQVLNAVYQPKPAVHGFTLNKNILTNAQAHVGKRFVLNLDLEDFFPSINFGRVRGLFMAPPYQLPAGVATVLAQICCYDNQLPQGAPTSPIVSNMICAKMDTQLQRLAKECRATYTRYADDITFSTTLREFPEDLAYPVKTEEGTQFVLGDHLLQIIAENGFKINNQKTRLQTKGSHQEVTGLTVNQFPNVKRTYVRQIRAMLYAWEKFGLQQASQEYYFFYKDYNRLPLKFNNKSSEDDFVQVIKGKIEYLGMIRGKQDSIYRKYISKFNYLKNYNGR

SEQ ID NO: 644 - protein, 371 aa, Synechococcus sp.
  source 1..371: note = Related to NZ_JALAAD010000001.1
MESNLPEHQAVNPESSKRSFQRKKGCLNLTQTPEELRAAFLALKTPRDIARLLNVRYDRLVYHIYKVPLENRYTTFEIPKKSGGTRTISAPVTALKLIQRKLNQVLQAVYEPKPSVHGFTPGRNIVSNAKPHVKRRYVLNLDLKDFFPSINFGRVRGMFMGIPYHLPEPVATVLAQICCHNNQLPQGAPTSPVITNMLCAQMDSRLQRLAQKLKCTYTRYADDITFSTNMPEFPADLAIEVTTDEGTRIKIGEPLRQIIESSGFLINDKKVRLQKRGHHQEVTGLTTNEFPNVDRRYVRQIRAMLHAWRKYGNQNILSVTSKSNHPISYESFDNFKQVLRGRIEYVGLVRGKEDPIYIKFLNQLKMFEEVF

SEQ ID NO: 645 - protein, 371 aa, unidentified
  source 1..371: note = Related to RFIJ01001009.1; note = Bacteroidetes bacterium
MRDRLKGTPDQLREAFLKLRSPRDVAELLDVRYDRLVYHIYVVPEAKRYTVFHIPKKSGGQREILAPATPLKLIQKKLNQVLQAVYQPKPSAHGFLPARNIRTNAEPHAGKRYVLNIDLKDFFPSINFGRVRGLFLSKPYNLPDEVATVLAQIACYTHPEDTWQHNGKVVRRSYLPQGAPTSPIITNMICAGMDAELQRLAKRCRATYTRYADDLTFSTTLRTFPEDLAQVVDDTEGRKRVFLSETLRSIIEKHGFEVNDKKVRLQDRRFRQEVTGLTVNEFPNVRRSFVRQVRAMLHAWDKYGLEQAEREYRVKYESKHRGPYHAAPSFAHIVRGKLEFIGMVKGKGDPVYLKYLGHYYSLIERDKLASK

SEQ ID NO: 646 - protein, 753 aa, Nostoc sp.
  source 1..753: note = Related to AP018322.1
MSLYDFSPELVAKTIGVDYHSLIELLEQVDEIYRDFKIPKKSGGVRTIRTPRSTEYEDGDITLLDIQKKISKEILQPVYQPKPCVHGFTAKKSIVTNAKAHTKKKYVLNLDIQDFFTSIKFERVRKMFMAQPYNANDEVANLLAQICCYEDQLPQGAPTSPIVSNMVCAKMDGQLLDIARQYKATYTRYADDITFSTNLEEFPEALGYVVNEGSIRRFFVGHELQEIFNSNNFEVNERKVRLQTQNCRQEVTGLTVNHFPNVNRQFVRQIRAMLYAWQKFGINNAASEYISKYGRYGEFYKIILNYKSGVEAKRFHHVLRGKIEFLGLVRGKNDPIYKKYLAQYKRLLYEEIAQEPRLPSVLKTKGWQEGRLSLNNHDWNANIRKRGLLLPNYIKTSYLLSVLTSLYTGQIVLLNGSVGIGKTSLVEKSAKIFNGNSKIIPVRPAWTDSTDLLGFYNPVNDSFHPSIFLTALQQASENFEQIFLVCLDELNLAKIENYAADLLSCLEYSKTGQGAQKLILYSPSIEVQIRQEIKLLQSQKSKTFEQSNRLAKLQNLLNTYPAEFLLPKNLVLIGTLNSDETTYDISPKVIDRSFVITYPLPDFAEDTKATPSSNPITGTYIPSLFQELDNKILQAHSSSDEFNDSWYTLLNWNSRYLSQCGIPLGYRVKRDYKVFYAASQIIGLTVEECLGYFLFTKLMPRLSFFKDESRENICLEWLEEIENNYSQFGTPDVIENLRNQIQDIRRRNVRYWG

SEQ ID NO: 647 - protein, 753 aa, Merismopedia glauca
  source 1..753: note = Related to NZ_PVWJ01000139.1
MSLYNLSPELVAEQLGVNYHSLIELLQQLDEIYRDFVIPKKSGGVRTIKTPMSIREIIRGYEDGYFPLLDIQKKLSKEILQPVYQPKPCVHGFTAKKSIVTNAKAHTKKKYVLNLDIQDFFSSINFERVRKMFMAQPYNANDEVANLLAQICCYEDLLPQGAPTSPIVSNMVCAKMDSQLLTLAKKYKATYTRYADDITFSTNLDEFPEALGSVADEGGIRRFVVGEELREILNSNNFEVNERKVRLQTQNSRQEVTGLTVNRFPNVDRKFVRQIRSMLYAWQRFGIEQAAGEYSSRYDKKYKYLINRSGEEAKRFHHVLRGKIEFLGMVRGKNDPIYKKHLAQYKRLLYEELAQKPRLSSSLKTKGWQDRVSLNNQDWNTHIRVAGLLLPDYIKTSYLLAILTSLYTGQIILLNGSVGIGKTSLVEKSAEILNGNSKIIPVRPAWTDSTDLLGFYNPVNDSFIPSSFLTALQKASENFEQFFLVCLDELNLARIENYAADLLSCLEYSKSGQQAQKLILYSPSIEVQIRQEISLLQSQKTKTSEQSNRLAKLQNLLSTYPAEFSIPKNLVLMGTLNSDETTYDISPKVIDRSFIITYPFPDLAGDTNATPSNNPITGTYIPSLFKELDNKILQERSTNDEFNESWYIISNWNSRYLSQCGIPLGYRVKRDYKVFYAASQIVGLTVEECIGYFLFTKLIPRISFFKDDSRENICLEWLEEIENNYSHFVTPDVMGNLRNQIQDIRRRNVRYWG

SEQ ID NO: 648 - protein, 757 aa, unidentified
  source 1..757: note = Related to NZ_CP051206.1; note = Dolichospermum flosaquae
MNLKDLYCLSPELVAEKLGVNYHSLIELLEQVDEIYREFKIPKKSGDVRTIRTPISSSERYKIYEGEGYFPLLDIQKKLSKEILQPVYQPKPCVHGFTAKKSIVTNAKAHTKKKYVLNLDIQDFFASINFERVRAMFMAQPYNANDKVANLLAKICCYKDQLPQGAPTSPIVSNMVCAKMDRQLLELAKKHKATYTRYADDVTFSTNLEEFPEALGYVINDGSVRKFVVGEELREIINSNNFEVNERKVRLQTQNYRQEVTGLTVNHRPNVNRKFVRQIRALLHAWQKFGIEKAADEYSSRYDKKYKYLKIRSSENTKRFHHVVRGKIEFLGMVRGKNDPIYKKYLSQYKRLIYEELAQEPKLSFVLKTKGGKERVSLNYQDWNANIRARGLLLPNYIKTSYLLSVLTSLYAGQIILLNGSVGVGKTSLVEKSATILNGNSKIIPVRPAWIDSSDLLGFYNPVNDSFNPSSFLTALQQAQEKFEQFFLVCLDELNLARIENYAADLLSSLEYSKSGQGAQKLILYSPSIEVQIRQEIKLLQSQKSKTSEQSNRLAKLQNFLNTYPAEFSIPKNLILVGTLNSDETTYNISPKVIDRSFVITYPLPDFAEDTNATPSSNPIAKTYIPSLFKELDNKILQADNSNDEFNDSWYTISNWNSLYLSQCGIPLGYRVKRDYKVFYAASRIIELTAQECIGYFLFTKLLPRISFFKDEERENICLEWLEEIENNYSHFGTPDVIENLRNQIHDTRRRNVSYWG

SEQ ID NO: 649 - protein, 581 aa, unidentified
  source 1..581: note = Chloroflexi bacterium; note = Related to JACRMK010000078.1
MSILLESADTTLRERFHNLRDFADLADLLEIKKSLLYYYAFKARGVDHYKVFQVPKKSGGTRQICSPSSPLKLIQRKLNQIFQSVYVPKASVHGFVKDRSIVTNARRHIDGTPRKRYVLNIDIADFFPSITEGRIKGLLMATPYNLPRDLAHVIAGLVCLDGRLPQGAPTSPVLSNMICARMDTQLRRLAQKYRCVYTRYADDITFSTSLPRFPAGLATGNDTNRQIVVGDELASVISGNGFAVNQKKVRLRSKDNRQEVTGLTINRFPNVTRSYVRQIRAMLHSWERYGYENANHEYAQKYFAGDEDKAPSLRQVLYGKMEFLRMVRGSDNSIFLSFREKLRRIDPEYKPLELTPINASIPIYVVTEGKTDWKHLKAALHRLKEQGLFIGLEIEFWEYEDDVSMNDAELLKRCKYKDDIDLPKLYIYVFDRDKPDIVRQVTGTDGDFKQWRRRLYSMAIPVPAHRVGNPDLCIELLYDDDSVKQKDSHGRRLFLSSEFDKHSCRHLTEDLNCTDNNKVKQPLAIIDNAVFDSNRKNVALSKSEYATNVLTKVPGFTTFDVAAFKLVFETLERIIKYDNQH

SEQ ID NO: 650 - protein, 382 aa, unidentified
  source 1..382: note = Related to NZ_NKFP01000006.1; note = Leptolyngbya sp.
MFRSRIKRSSTLLLCKNCDELKQEFLSLKTAKDIATLLEVPYYQLAYHLYKVAENEKYREFSIPKKSGDSRTITAPAKALKILQRKLSQVLYSVYEPKKPVHGFVPARSILTNAKQHSHKRFVLNIDLKDFFDSIHFGRVKGIFIKPPCNLPEEVATILARICCHSGKLPQGAPTSPVVSNMVCARLDRQLRLLAEEFRCTYTRYADDITFSTTMSDFPKEIAFANPEGDNLESLLGERLILTIWDNDFEINENKIRLQHKGQHQSVTGLTVNQFPNVKRAYVRKISSMLHAWDKFGLASVQQRYVEKHYKESGKFNKEIPSFQEVLRGKINFLGMIRGKDDEIYRKYLTWYRNLSVREIPIDLSQLDSKTQPSQSHPTDRG

SEQ ID NO: 651 - protein, 337 aa, unidentified
  source 1..337: note = Related to JAHHHP010000108.1; note = Myxacorys chilensis
MKTPKDVARLLEVTYDRLVYHLYISSENTKYIEFSIPKKSGDSRTITAPSTALKILQRKLSQVLYSVYKPSDSVHGFVAGRSILTNAKQHLRKRFVLNIDLKAFFDSIHFGRVRGIFIAPPYNLPKEVATVLAQICCHSNKLPQGAPTSPIVSNMICVRLDRQLRLLAKKYKCTYTRYADDITFSTTLPNFPKEIAFESPGGDDLESLLGEELILTVWDNGFEINENKIRLQHKNNHQGVTGLTVNRFPNVNRDYVRKINSMLYIWQEFGLASAQKGYIEKYNEKSGKFNEEIPLFQEVLRGKINFLGMVRGKDNEIYLKYLDWYCSLSNQEEISKE

SEQ ID NO: 652 - protein, 361 aa, unidentified
  source 1..361: note = Related to JAAURG010000500.1; note = Leptolyngbyaceae cyanobacterium RM2_2_4
MLKENSTLILYKNCNELRQEFLALKSPRDIAELLEVKYEQLVYHLYKAPGSSKYKEFSISKKSGHSRTISAPSSALKILQRKLSQVLYSVYDPKYPVHGFLPEHSIVTNAKQHLRKKFVLNIDLKNFFDAIHFGRVRGIFLAPPYKLPEEVATVLAQICCHSNKLPQGAPTSPVVSNIVCTRIDSQLRLLAKELRCNYTRYADDITLSTTRPNFPIEIAYESSEDNKVKIVLGERLISIVQNNGFEINDRKIRLQHRSQHQEVTGLTVNQFPNVKRDYVREISSMLHVWDKFGLASASQRYAEKRSRELEISQEEVPSFQEVLRGKINFLGMVRGKENEIYRKYLNWYYILSNRSETPSGG

SEQ ID NO: 653 - protein, 363 aa, unidentified
  source 1..363: note = Related to NZ_JH976537.1; note = Nodosilinea nodulosa
MLTETEINSSLILLEDCEKLKKKFLSLKDPRDVAALLDVTYDRLIYHIYRVPDSEKYLEFKVPKKSGQMRKISAPSTALKIIQRKLSQVLYSVYDPKAPVHGFVPSRSILTNARPHLRKRFVLNIDLKDFFDSIHFGRVRGIFMAPPYNLPADVSRVLAQICCFSRKLPQGAPTSPVVSNMICARLDSQLRLLAKENHCTFTRYADDITFSTTLPVFPKRLAYIDSDVKEDEEKTVLGSSLVSIVRENGFEINWKKVRLQHKSHHQEVTGITVNQFPNVKRDFVRKISMMLHIWDKYGLDSARKRHAELLSKSLEIPEEEVTDFREMLRGKINFLGMVRGKNDSIYVKYLNWYCNLSARERRM

SEQ ID NO: 654 - protein, 359 aa, unidentified
  source 1..359: note = Related to JAIUYC010000141.1; note = Coleofasciculus sp.
MSDSKFKENSTLLLYKNCDELKEEFLSLQTPRDVARLLEVSYDRLVYHLYIVPENRKYAEFSVPKKSGDTRIISAPATALKILQRKLSQVLYSVYEPKAAVHGFVPSRSILTNAKQHLHKRFILNIDLKDFFNSIHFGRVRGIFMAPPYKLPEEVATVLAKICCYSGKLPQGAPTSPIVSNMVCPRMDSQLRLLAKEFKCTYTRYADDITFSTTLPNFPKEIAYINIEEDKPKILVGERLISVIQDNGFEINENKVRLQYKTKHQEVTGLTVNQFPNVKRDYVRKISSMLHAWDKFGLDSVQKRYIEKCSKELGIPAEEVPPFQEVLRGKINFLGMVRGKDNEIYRKYLNWYRRLSNRE

SEQ ID NO: 655 - protein, 378 aa, unidentified
  source 1..378: note = Related to JACMPV010000402.1; note = Alkalinema sp.
MSSSSFTDLNSQHNKGSSLFLYQNCDELRESFKSLKTPRDIARLLDVSYNKLTYHISILPENERYRDFLIPKKSGQSRTISAPCTPLKILQRKLSQVLYSVYEPKSSVHGFVPNRSILTNAKRHVHKRYVLNIDLKDFFHSIHFGRVQGIFMKPPYNLPKEVAVVLAKICCYSGRLPQGAPTSPIVSNMICARMDSELRKLTVEFKCTSYTRYADDITFSTTLSKFPVEIAYQEKSGDDNSQKLILGERLSSIIQSNGFAINESKIRLQHKSQHQEVTGITVNQFPNVKRSFVREISSMLHIWDRFGLKSAEQRFRDKAAEDLKTSAYTLPSFQEIPSFKEVLRGKINFLRMVRGKDNATYLTYSKWFYELSRKEAIK

SEQ ID NO: 656 - protein, 376 aa, unidentified
  source 1..376: note = Oscillatoriophycideae cyanobacterium NC_groundwater_1537_Pr4_S-0.65um_50_18; note = Related to JACQYI010000059.1
MENLSLLLERSCEDLCEDFHSLKTPRDVAALLDVPYKRFVYHLYKEENRYTSFEIPKKSGDRRTISAPVIGLKIIQRKLSQVLYCVYNPKPSVHGFVPAKSILTNALPHVKKRYVLNADLKDFFPSINFGRVRGLFMAAPYGLSPEVATVLAQICCYEGKLPQGAPTSPVVSNMICARMDRQLQHLAKEYRSTYTRYADDITFSTTVPKFPKALAYVPEEGDEKKLILGEKLAEIIISNDFRVNEQKVRLQDKRSHQEVTGLTVNEFPNVDRRYVRSIRAILHAWDKFGLQKAQEVYLEKYAPTPRYPQQEKSSLKQVLHGKIEFLAMVRGKEDQIYQKHIKKYFELSQRDSIPHKAILVRQEAVHEQTGTSNDEV

SEQ ID NO: 657 - protein, 333 aa, Microcoleus sp.
  source 1..333: note = Related to JACJPD010000044.1
MKTPRDVAQLLEIPYQRLVYHLYQVPLEERYLTFELKKKSGGVRIVSAPASALKLIQKKLNQVLQCAYQPKPSVHGFTFSKNITTNAKAHTGKRYVLNIDLKDFFPSINFGRVRGMFIAMPYSFSPDIATILAQICCYNNQLPQGAPSSPIVSNMVCAKLDSQLQQLARKLRCTYTRYADDITFSTTVPKFPKELAYLIDINEQQKLVLGDGLLSIIKDNGFQINEKKIRLQSKDEHQEVTGLTVNQFTNVNRNYIRQIRAMLHAWEKFGLELAEREHRIKYYFKQKSPYKNIPSFKQVLRGKIEFVGMVRGKEDQIYQKYLNHYLRLNNPVI

SEQ ID NO: 658 - protein, 364 aa, unidentified
  source 1..364: note = Related to JAKGPC010000001.1; note = Planktothrix agardhii
MAKTRNSKSSIQPTLRKEGDELRKEFFLMKIPRDVAQLLEIPYQRLVYHIYIVPLEDRYLTFDIKKKSGGNRNICAPATALKIIQKKLNQVLQFVYKPKPSVHGFVLNKNIATNAKPHAKKRYVLNVDLKDFFPSINFGRVRGLFMALPYGLSSEVATVLAQICCYNNQLPQGAPTSPIVSNMICAKMDSQLQQLAKKLRCTYTRYADDITFSTTLPKFPKELAYFIEIENQQKLILGDDLLSIIKENNFEVNERKIRLQSKDSHQEVTGLTVNQFVNIDRNYIRQVRAMLHAWEKFGLEDAEREHQEKYYSKYKSPYKVIPNFKHILRGKIEYIGMIKGKDDRIYKKYLNHYIKLHKNSQNKK

SEQ ID NO: 659 - protein, 382 aa, Nodularia sp.
  source 1..382: note = Related to NZ_BDUB01000001.1
MSENYEKKSQVIKALKPCLDKNCDELIKKFYSLKSGRDVARLLEVPYGDLVYYLYVIPYEQRYTTFQIPKKLGGYRIISTPATSLKLIQKKLNQVLQCVYQVKPSVHGFVKDKNIVTNAKAHIGKRYVLNFDLKDFFVSINFGRVRGMFMALPYALNPEVATVIAQICCHDNQLPQGAPTSPIVSNMLCAKLDSQFQKLAKKYRFTYTRYADDITFSTTRPNLPEEIAYIIITEEPEKLEKVVLGKDIYSIVKENSFEVNQLKVRIQNDKQHQEVTSITVNTFPNVDRNYIRQIRAMIHAWEKFGLESSELEYINKYEFKARLFSGDTPKFKQVLRGKIEFLGMVKGKNDTIYKKYLTQYLELNKRDKNFFYRLFSWREGNL

SEQ ID NO: 660 - protein, 592 aa, Plectonema sp.
  source 1..592: note = Related to NZ_JADEWL010000096.1; note = Plectonema radiosum
MGTTALSRTEEELKEDFYKLKTRQDIAQLLEISDYQLRYHLYIYPRDKAYTKFQIPKKTGDYRIISAPITSLKIIQRKVNQILKCIYKSKPSTYGFVTGKSIVTNAKQHLRQRHVLNLDIKDFFPSINFGRVRGLLMAVPYSCTEEVATILAQICCHENQLPQGAPTSPIISNMICAKLDSQLQRLAKKYQCIYTRYADDITFSTSRTKFPGHLAWFSQEADVLILGNDLKNIIENNGFIVNDSKLRLYNRYKHQEVTGITVNQKLNVKRSYIRQIRAMLHAWEKYGIVNAEVEFWNKFDRKSSFKKDRKSFKSIVKSKIEFIGAVKGKDDTIYLNFLRWLKRLAPELVSDKKLNQYSDKLLENNFRLKATIWTEGKTDIKHLKSALKWLKYQGKEFNVELEFKEDLDDQKQGDGELLNVCQQFCKEKKIIPIIAVFDRDVPNIIPRVHDDTMGFKVWGNGVYSFALPIPLHRKENKDICIEFYYTDEEIQKLDEDGRRIYLSSEFNSKSGRHITFDVNTTDKNKLKPNQLKIIDNDVFDKNNKNIALSKNNFADYIFEQKSGFNDFNFRAFEEVFIIIEKIIKYHAEIIKE

SEQ ID NO: 661 - protein, 591 aa, Nostoc sp.
  source 1..591: note = Related to CP046703.1
MGTINLSLTEEELKERFSQLKTRKDIASLLEISDYQLRYHLYIYPRDKAYTTFQIPKKTGEYRTISVPHTSLKIIQRKLNQVFKCVYQPKPSTQGFVTGKSIVTNAKQHLRQRYVLNIDIKDFFSSINFGRVRGLLMASPYNCTEEIATVLAQICCHENKLPQGAPTSPIVSNMISARLDSQLQRLAKKYHCIYTRYADDITFSTSRPKFPGHLAWFSEEAEKLIISDDLKKTIEDNGFIVNESKSRLYSKHRHQEVTGITVNKKLNVKRKYIRQIRAMLHAWEKYGLDNAQAEFYNQFDNKSSYLKKQKSFQYIIKSKIEFVGTVRGKDDQIYLNFLRWLKRLAPELVSNEKLNVYNLLENQNKSSIKASIWTEGKTDIKHLNSALKWLEDQGRKFDFEINFKDDLDPQKQGSSQLLEMCKQLCKTKHQQPMIAIFDRDEPNITKQVNDDSLGFKNWKNGMFSFALPIPQHRHGQNDICIEHYYKDNEIQRQDVNGRRLFLSNEFHDETGRHFKDDLNCTDRNKYKYDGKIIDQDVFNRNNEKVTLSKNDFADNIFNKKEKFDDFQFEAFEEVFLIIEKIVKSYAEELQE

SEQ ID NO: 662 - protein, 489 aa, unidentified
  source 1..489: note = Related to QBMH01000079.1; note = Leptolyngbya sp.
MGTTLLSLSKDELKDLFYKLKTREDIAALLQISDYQLRYHLYIYPRKYPLKKAYTAFKISKKSGGSRSILAPNTSLKIIQQKLNQVLKSIYQPKPSTHGFVVEKSIVTNAKQHLRQRYVLNLDLKDFFPTINFGRVRGLLISPPYGCTDEVATVLAQICCYENQLPQGAPTSPIISNMICAKLDSQLQRLSRRYQCIYTRYADDITFSTSRSRFPPHLTWFSREAEKAILGDELKAIIEENGFLVNESKVRLQSRYKRQEVTGITVNEKLNINRKYIRQIRAVLHAWEKYGLENTEAEFWRKDKKHRFQANSDSFRKIIRGRIDFIGTVRGKDDQIYLNFLGWLKKLAPDLVSDSKLSLASPKILLENQKKNRQEAVLWTEGKTDIKHLKSALRWLENRKISYEFKLNFKDDLDEQKQGDDQLLKMCEQFCKEARSKPIIAIFDRDKPDYVRKAHDETQGFKIWGSGVYSFAIPIPCHRQDVRDICIEL

SEQ ID NO: 663 - protein, 601 aa, Pseudanabaena sp.
  source 1..601: note = Related to NZ_JAAVJL010000001.1; note = Pseudanabaena yagii
MNTTFLNLSEEELREEFCRLRTREDIAKLFQISDYQLRYHLYVNPSQKAYVIFEIKKKSGGIRSISAPKTALKIIQHKSNQLFQSVYKPKPSTHGFTSNKSIVTNAKQHLRQRYVLNLDLKDFFPSINFGRVRGLLMANPYNCTEEVATVFAQICCHNQQLPQGAPSSPTISNMICAKLDTQLQRLAKKYQCIYSRYADDITFSTSRSRFPSHLAWFSRDSEKLNIGSELKDIIEGNGFQINESKVRLQNRYNHQEVTGITVNEKLNIKRKYIRQIRAVLHAWEKYGLENAEMIFWQKYEKHRHTEFNPDSFRQVIRGRIEYVGSVRGKDDHLYLKLLRWLSKLAPDLVNKTKFDIANINESSEEQKDLPQVIIWTEGKTDIKHLRSAHRWLQNNKTTRYKIEIKFKDDLDDQKQGSPELLKMCEQFCKEKRNNPIIAIFDRDEPDLIRKVHNETTGFKSWNNGVYSFAIPIPQHRKDNHSICIEFYYKDEEIKRHDNDGRRLFLSNEFNPISGRHIIDRDLVTQETKKIKKNEIKIIDSNVFDSNDTNVALSKDNFANYILQESANFNDFDFNPFLEIFEVINRISKHHEENIKSEHITH

SEQ ID NO: 664 - protein, 585 aa, unidentified
  source 1..585: note = Related to NZ_LXYR01000030.1; note = Phormidesmis priestleyi
MESNDGIKQLLGGLESRQDVATLLDVTDRQLRYLLYSPRYKKYEKFEIKKKMGGVRLIYSPSHALKNLQRRLNAILQQVYQPKPSTYGFVKGKGIVKNAEQHLRQKCVLNLDLKDFFSSINFGRVQGLLKAAPYNLLHEVATVLAQICCHEFEVDGQLNRRLPQGAPTSPVISNMIYAPLDSQLQRLAKRHKCIYTRYADDITFSTSKSKFPSSLAFYSVGDEKWLLGKELLEVVEGNGFSVNEKKTRLATKYQHQEVTGITVNQDLNVKRDYVREIRSMLYVWRTHGLEKAEATFLEKFDKKHRLNSITPSFRSVVKGKIEFLGSVKGKSDPIYLKFTDELRVLAPELVSIDKLLNSPIVRAQIMTEGKTDIYHLRAAFSNLQKKGLFLSLAIDFVDLPPEKQGDSNLEKHCESLCIVTPQFPVIAIFDRDNSAILKKVHDDSKGFKSWGNGVYSFALPVPSHRHEDPEVCIELYYSNEEVTRLNLQDRRLFLNSEFSKKSYRHSENKILSTTKFNEVKNNSLKIIDSEVHDDADNNVALSKNDFAKCILNSNPGFDNFDFSEFSAIFEVIEKILQRHNLDSAV

SEQ ID NO: 665 - protein, 612 aa, unidentified
  source 1..612: note = Related to CP000806.1; note = Crocosphaera subtropica
MGNKLEYNAKYLAFLFLLTDMGTTSLDLPQEELKKHFEQLKTRQDVARLLQVSDYQLRYHLYIHPRDKAYTTFKIPKKSGGHRLITTPQTSLKIIQHKLNQVLSSVYQVKPSVHGFAIQKSIVTNAKIHLKQRYILNLEDQDFFPSINFGRVRGLFIAKPYNCTQEVATILAQICCYNNQLPQGAPTSPIISNMICARLDSQLQKLAKKYRCIYTRYADDITFSTSRFKFPHRLAYFSQDSETFVLADELITVIKDNGFSVNLSKLRLQNRYQRQEVTGIIVNEKLNVKRKYIRQVRAILHAWKKYGLENAEAEFYKGFNENNNNMKSRDCFRKMVQGKINFIGLVRGDTDHIYLKFLKQLKVLVPDLADDSKINFITSKLSEIKSSNNLHKAIIWTEGKTDIKHLKVAWKWLINKKIVDYFDLDYKDDLEPDKQGSSQLFDVCKQFCKEKRNIPLIAIFDRDEPNIIKKIHDDSQGFKDWDNGVYSFALPIPKHRQDVKEICIEHYYQDSEIKRTDKKNKRLFLSNEFHRESGRHLSKPQLTTTDNKFKSNQLKIIDGKVFDSDNNNVALPKDDFATYIYDKEEGFNDFDFTAFKEVFEIIEKILNRHYSQ

SEQ ID NO: 666 - protein, 581 aa, unidentified
  source 1..581: note = Chloroflexi bacterium; note = Related to SLTK01000007.1
MSTELFASNEVLIAAFFQLKTRHDIAKLLEVTELQLNYYLYIVPRDKRYKRFEIPKKHGGSREIYAPATALKIIQQKLNQVLQSVYKVKPSAHGFVQKKSILSNAIPHVSKRYVLNLDLKDFFPSINFGRVRGLFMAPPYLRNNEVATTLAQICCFNGYLPQGAPTSPIVSNMICSKLDSQLQKLAKKHRSTYTRYADDITFSTSRPKFPSGLAYFLEETGKLEIGDELKALILENGFEINERKNRLQPYSKRQEVTGLTVNVFPNVRRDYVREIRGMLHAWQRYGYDAAEMTYREKYAGKHPESKREQISFKRVVQGKLNFLKMVKGENNRVYVNLAKWFWQLAPEFAQSEVLTPLHLPKPIIFTEGKTDWKHLKVAFTSLKKMGMFTELDVQFHEFGDDVQMGHGELLKMCKAYCKRENRQPNIFIFDRDVPAVVNEVMEKDKDYKNWDNNVFSLAVPIPAHRTNTTDVCIELYYQDKDIKRKDGDGRRLYLSDEFDSNNNSHKQQNDVYTLSNKTRRLVGVTIVDSQVFNFITKESVALSKDSFAELIANDDPNFHNVDFSEFGKIFDVIVTILREHQ

SEQ ID NO: 667 - protein, 576 aa, unidentified
  source 1..576: note = Chloroflexi bacterium; note = Related to JACPVE010000065.1
MSTELSASKDELRATFFQLQTRQEIAEMLDIPEKQLNYYLYILPEHRRYKRFEISKKRGGNREIFAPATALKVIQQKLNQVLQSVYEVKPSAHGFVPEKSIVSNAQPHARKRYVLNLDLKDFFPSINFGRVRGLFMGYPYHRNHEVATTLAQICCFKSYLPQGAPTSPIVSNMLCAKLDAQLQRLAKKYRSTYTRYADDITFSTSRPNFPSALAYFSDDTGKIEIGDELKSIIQENGFKIHERKSRLQPNSRRQEVTGLTVNVFPNVKRDFVREIRGMLNAWGKYGYEAAEQIYRQKYAGKHPENEREHLSFKRVVQGKLNFLKMVKGENNRVYLNLIKWFWKLAPELAKPEVIAPLPLVKPMVYTEGKTDWKHLKTAFYALKKMGLFEQLDIQFLEYGDETPMGDSELLKTCQGGSKMLHETPQIFIFDRDKPDVVKHVTDTDKPYKVWGNNVFSLAIPIPAHRVDINDVCIEFYYQDKDIRRSDENGRRLYLSDEFDSKNGKHNSLNVYTRSEKIRKITIIDSQVFDFAGASVALSKDMFAELIANGNPQFQNVDFSEFGKIFDVIVAILRENS

SEQ ID NO: 668 - protein, 582 aa, unidentified
  source 1..582: note = Chloroflexi bacterium; note = Related to JACNJY010000485.1
MTLVLSAKPENLRKGFLSLQSAKDIAGLLEIDLQLLYYHLYIRPESSRYTSFEIPKRSGGSRSILAPISALKIIQRKLNQVLLSVYSVKPPVHSFVLGKSIVTNASVHVKRNYVLNVDLLDFFPSINFGRVRGLFMGKPYCLNPKVATILAQICCFKGNLPQGAPTSPIVSNMICARMDSHLTQLAKKNRSDYTRYADDITFSTNKGVFPSDFAVINELEQLELGKELVRIISDNGFQINHTKTRLRSRKQRQEVTGVTVNKFTNVRRSYLRSIRAMLHAWEKYDLEKAQEKFWHDYDKGKYRSPYKSKPSFKRVVRGKIEYLGMIRGKDDPLYQRLLGQLRVLAPELAKKAKKIQPVYLQGSQAIVYTEGKTDILILETAWKKLYPDKLIPFILKPCDFNPADKAHGTGGASFLSNFIKYVSPDSPNVIIGIFDRDHDGIRAYEGIGESFPEKKGLGSKLAKHGKAGAILLPIPKGKEKYAKYKNLCIEFYFSEKTLNRKNEGGKGLDFQFGTEAIHVAGKPASGSKPSAIRETRTIIRGKDVFSNDIVPQLPTSAFRNFKLLFDVIIATLEKCKTKVASH

SEQ ID NO: 669 - protein, 522 aa, unidentified
  source 1..522: note = Candidatus Bathyarchaeota archaeon; note = Related to QMXJ01000455.1
MYKIELSANPEKLKARFLALKKPEDIAELLEVSYKDFVYWIYRTPEKYRYVSFTIPKKHGTPRYIDAPNNNIKILQQKLNYILQIVFSPKYCVHGFTNGRSVVTNARKHVGRRYVLNIDLKDFFPSIHFGRVRGMFMGKPYNLPSKVATFLAHLCCYKKVLPQGAPTSPVISNMICAKMDSELQRLAASNRCSYTRYADDISFSTSKHSFPSALATINDLGQVEVGKELVRIITENGFQIHPEKIWLRRKDRRQEVTGIIVNERTNLPRKFTNNIRAMLHAWEKYGLESAQKHFEEKFDKKHRAPWKKKPRFQDVLKGKIEYLGMVKGKESSTYLRFLDQLGRLAPKLTGGRGTPQDLLFRRYQALLKSDDPQGRGYLLQSLLHDVFTFLNVTIEKSFTRNRNGEQIDGAFIFEGWHYIVECRWREKVSDIRQVDGLLGQVLRSGKQTMGVFFSINGWSQNVPTLLKQNPSKSIILMHGDDFHALLSQKISLDKLLKGKISELNLKSEPFISAEEIIKKDDT

SEQ ID NO: 670 - protein, 483 aa, unidentified
  source 1..483: note = Related to JACPTZ010000059.1; note = Planctomycetes bacterium
MSLWLADPPHVLKARFHALLRPFDIAALLDVPFGDFFYWTYRVPPSRRYTTFYIEKHSGAPRRIDAPELNIKILQQKLNQVLRAVYVPKRCVHGFVPGRSVLTNAQAHAGRRHVFNIDLRDFFPSINFGRVRGMFMGKPYRLPPKVATVLANLCCFDRRLPQGAPTSPVVSNMICARMDSQILGLAYRHRCTYTRYADDMTFSTSRRPFPAEMATLNDLGQVAVGAELRGIIEGNGFRVHPEKIWLRGRDRRQEVTGLTVNVEPNVRRRYVNQIRAMLHAAGKYGLPSAQSEREQRYDHKHRAPWNDPPSFERALQGKIEYLGMVRGHACPKYLKMLDDLGRLAPHLFIIRGTPRERLLRRYRALLTSPNHQARGYQLQALFEEGARPGRAGRGGISATPDRGGICPGTPSLRGRTLAPRFPASHPTTARGSEGHVQAPYESHPRPRIQPRHGPVDEQVERHEKRAVHRHPARDEIVVPVHHS

SEQ ID NO: 671 - protein, 511 aa, unidentified
  source 1..511: note = Phycisphaerae bacterium; note = Related to JAEUJA010000134.1
MSDGPPSKPLPLPLSPTLAKSDADIKAAFRVLQSVTDVADLLEVRETQLTYAIWRTPEEKRYSTWSIRKRSGGTRTIDAPRKTHKILQRKLAYVLSLVAQRRSVAHGFSPGKSIVTNAAAHARCRWVFNADLKEFFPTINFGRVRGMLMGKPYRVGERAATAIAQLCCHKRLLPQGAPTSPVISNMVCARLDGELRRLAEHYGCNYTRYADDITFSTNKKTFPEELATLIGEGTKAAVGSALSRVIESNGFQVNPDKVRLQGKRTRQEVTGLVVNRRPNVRRAFVRQIRAMLHAWERYGYDAAQKEFLDKYDSKHRPDGASGRTYERVIRGKLAFLKQVRGKDDNRYLAMRRRLRRLLGEVDAGVGRGVEMEYDVFICHASEEKTTVVVPLAKALNDAGIRVWLDEEKIGWGDSVTKEINDGLAKSKFVVVVLSAAFMKKKWPAKEMNAVLNKEIASDITCALPLIVGDSSDKKIILETYPLLADKHYKEWSPSDIGTIVGALKAMLSRYA

SEQ ID NO: 672 - protein, 544 aa, unidentified
  source 1..544: note = Related to NZ_JALCZB010000001.1; note = Anaeromyxobacter sp.
MQVRLSQSSADELRRRFFACRTARDVARLLEVPYSVLHYHACKSPVSIRYETFTVPKSTGGSRQILAPATALKLLQRKLNVVLQAVYRPRPSAHGFLPARSILTNARCHSGRSYVLNVDLEDFFGSINFGRVRGMFMARPYNLGEGAATVIAQLCCHLNRLPQGAPTSPIVANMICARLDGELQRLAIRHRCTYTRYADDLSFSCHSHTFPEALATYSPGTGTSARVGPELSRVVHQNGFRPNPSKVRLQRPSERQEVTGLIVNRDPNVHRTFVRQVRAMLHAWRKFGLEAAEAEFIAKYGWRHRAPERATPRFRRVVKGKLDFLRMIRGRYDPLYRKLLREYCTLSDEHFEEAPTAPTVEALIARAVWVLECDICLRQGTAFYLRGNGLVSCDHVVCDHIRAFRPDAPGTKFNIDIVGRHSVVDLAVLRLRDADFSDDGLRAGTASALQTGDELTVWGFPNFRLGDTVQVHPGRVAGFRQVSGIRRILVSAPIVRGASGGPVLNRRNEVIGVAVTGAETMETAHETEDHGVLPINALEHVPLR

SEQ ID NO: 673 - protein, 537 aa, unidentified
  source 1..537: note = Related to JAIPEW010000016.1; note = Clostridiales bacterium
MEIKLRADDSTLIEKFIALQSRKEVADLLEIDVKTLIYFLYRRKDKDNYKIFYLRKRSGKERTICAPINSLKIIQRKLNYILSLIYKPKPSAHGFIVERSILTNAQAHLKNNNMLNVDILDFFPNINFGRVRGMFMANPYNIPPEPATVLAQICSCNNQLPQGAPTSPIISNMICAQLDSQLQKLAKKHSCTYTRYGDDLSFSTWQYKFPKELGYKTKTGEVIVGISLEKIIRQNGFKHNKDKVTLKSRKSRLSVTGLIVNEIPNVPRKFVRQIRAMLHSWEKDGLIKAEQIHLNKYRYKQKNPKAFQPKFSNIVRGKINYIRMIKGEENPVYQKLASKFNDLNGGGFPKYYHNLREELEAAVWIIEGEGGTNQGTGFMLEGFGMITCAHVLTKSMEAFRCNDYGNKFPVEIISYDNENDVAVLKIKGNENYHYLRVGDSDEIDVGSEIKLSGFPNYNIGDSIYIDDGKVTLCRKSLGRTRYLISARIVKGNSGGPVLNKNNEVIGIAAKGAPCFEDKNMDEKFEVIPITIINPEPL

SEQ ID NO: 674 - protein, 551 aa, unidentified
  source 1..551: note = Phycisphaerae bacterium; note = Related to JADHXR010000104.1
MRNRLDIQLRKNIDEAVGEFQSLSSPHDVAALLEIPYKVLNFHLYVAHPTRRYKTFTVHKKSGGVREICAPVTAIKIIQQKLNYILQNLYKTIYKKKFSVHGFIYGKSVRTNAQSHTRKDYVFNIDLLDFFPSINFGRVRGMFMANPYRLPPKVATVLAQICCFNNQLPQGAPTSPIISNMICARMDDELYRLAKRFDCKYTRYVDDMTFSTNRPNFPAELANVTRLESGWRLKADVGKELNKIIEENKFSVNTSKVWIQHRNCRQKVTGLIVNEFPNVSRKYTNQIRAMLHDWDKHGLIAAENRFVNDYDKKKRWPYEPGILFKNVVKGKINFLKMVRGDRNPTYQKFSEKLASLDPDFSFIRIVREADSDNLQQAVFVLESPRGQGTAFMLRGIGLVTSAHNLKNDKLDTYLYKTDEPADKQRLKVKHINTNLDFAIIEVAQGWAKASLVRGDSTILKTRDTVKVIGFPNYAKGKSIHIHDGKITGRGRWFKVKTLNVSARIIYGNSGGPVLNDKNEVVGIAFYGAPDPEKADRIESGVIPIEILDKLM

SEQ ID NO: 675 - protein, 580 aa, unidentified
  source 1..580: note = Related to NZ_NCQY01000020.1; note = Salinibacter altiplanensis
MSISLDASEEELQNDFHNLEDLEDVADLLDVESSNLIYHIRESPEEGRYKTFTLDKSGGGEREISAPVSALKIIQQKLNQILQAVYTPKAAVHSFLPDRNIRTNAEQHVKQRFVFCVDLKDFFHEINYGRVWGLLQAVPYELPEDVATVLAQICCHNNRLPQGAPTSPIVSNMLCAQLDSELLRLAESNKCIYTRYADDLTFSTSMRQFPDELATGGEDGNVKVGKELREVVDKNGFELNEDKTRLQHEDYRQMVTGLIVNEKVNVPREFVREIRAMLHAWKAHGYEAAEEEFLREYDTKNRKSEKEEPVFSRVIRGKLEFLSMVRGKDDKIYKKYLTEYSRLSNTPINIDNQEEPENDTSKLIVYTEGKTDWKHLKRAIRELAVNQSSELPDLEFNETESDRGDDELLEKCRHTSESEGQHQHAHVFLFDRDQPNQVQEVTEDDQSFRSWGNNVFSAAIPPPPHREDVNISIELYYEDDDLLKRDGNSRRIFLGQEFHKTSGKHKEEAKINCSLLNKTGDENRIIDDRVFNEENENISLSKNDFAEYILNEEPPFDDINFKPFARIFDLLSEIEERVDS

SEQ ID NO: 676 - protein, 529 aa, unidentified
  source 1..529: note = Related to JAGQYO010000133.1; note = Flavobacteriales bacterium
MITELTAPDIVLTDKFFALASPEDVADLLELKSYAFLQHLIFILPSSKRYKEFVIPKRRGGKRYLLEPSPNLKIVQKKLSYVLQLVYKPKRSVHGYVNGRSIVTNAIQHVGRRYLLNIDLEDFFPSIHFGRVRGMFMSYPYNFNGRVATTLAQICSLRNCLPQGAPTSPIISNMVCAKLDSELQKLAKQHRCYYTRYADDLTFSTSIKQFPTALAVSIVEGKRLRVEAGNELSEVINRNGFTINVKKIRLQKHSQRQEVTNLTTNEFVNVNRKFIRQIRAMLHAWRKFGYVAAEIEFRNEYNKKPPNKPYKKQPSFKNVIKGKIEFVQMVRGKNDRIFIMLNNQAAQLERIQNIEPYQFQILEDEDHEIVSLIASGETEWVEFKEGACLDPHTGENNKKNMSHKILRAVASLINSKVEGRVLIGIKDNGAITGVEREYALADPSKVNWDGYELYLTNFLNDSLSIENAHNFFKISRHAINDKIVCCISTRMADKPVLVHEKLYIRSGNQSKEIKGTEKVDFILKWATSS

SEQ ID NO: 677 - protein, 481 aa, unidentified
  source 1..481: note = Anaerolineaceae bacterium; note = Related to JADJXK010000002.1
MTIKLTSTDTVLTDKFFALTSPEDVADLLELKSYSFLEYLIFILPSSKRYREFIIPKRRGGKRYLLEPIPNLKIVQKKLSYVLQLIYKPKHAVHGYVNGKSIVTNATQHIGRRYLLNIDLEDFFPSIHFGRVRGMFMSYPYNFNGRVATTLAQICSLRNCLPQGAPTSPIISNMICAKMDSELQKLAKQHRCYYTRYADDLTFSTSIKQFPPAMVVTLVESKRLRVEVGIELSEIINRNGFNVNMSKIRLQKDSQRQEVTNLTTNEFVNVNRKYIRQIRAMLHAWRKFGYVAAENEYRNVYNKKPPDKPYKNAPSLKRVIKGKIDFVKMVRGQEDKLFIKLNNQAAQLERAERIEPYFFDILQEPDHELMTVIANGETDLVEFKEGACVNPHTGKDDKRNMSSKILRAVASLMNSKSNGVVLIGVADNGAISGVEREYSVANPAKANWDGYELYLNNLLNDSLSVENAYKYFNISSLTMLN

SEQ ID NO: 678 - protein, 525 aa, unidentified
  source 1..525: note = Anaerolineales bacterium; note = Related to JAGRDB010001140.1
MAIYLESTPEIIEGRFRDLATPEGIAELLELSSLAFLKYCLYTLPQARRYRTFTIPKRSGGERIILEPEPNLKIIQQKLLQVLTLVYQPKRAVHGFVDERSIVTNASPHINRRAILNVDLLDFFPSIHFGRVRGMFMAFPFHFNDKVATILAQICSLPHCLPQGAPTSPIIANLICAKMDSQLTQLARTHHCYYTRYADDLTFSTSLAHFPKSLATIISEEGERTVEIREELARIIHKNGFRINPKKVRLQTRDHQMEVTGLVVNRKVNVKRSYIRHVRAILHAWQQYGYQAAADEYFAKYFGKAPDKPYKTLPGIRQVIKGKLSFIAMVRGQEDHLYIRYNNQAAQLERRDLPEPHIFRILAEPDNAIVRLVAEGESVCIEFKVGACLNPHTNKQDKKMKDKIVRAVASMINSLPVGHLLIGVKDNGEIIGVEREFPVADSSKQNRDGYELYLANILNDSLQVNNAQQLFTITFHNVGSHTVCQVQTTKSMQPVLVNNQLFIRSQAQTRELSGQEMVEYIQQYS

SEQ ID NO: 679 - protein, 584 aa, unidentified
  source 1..584: note = Related to CP000876.1; note = Herpetosiphon aurantiacus
MSLHLSSDPDTLRQQFFQLKSRDDLLNLLDISQQQLLYYLYICPENKRYRHLRLRKKRGGYRTIYAPATHLKIVQQKLSSILQLIYEQKPAVHGFVPHKSIVSNAAMHLNKTYVLNLDLQDFFPSINFGRVRGLFMNQPYYLNEEVATILAQICCHRNTLPQGAPTSPVISNMICAKLDRELLRFAQANRCVYTRYADDLTFSTNTRQPPSKLVRRTEATASIELGRDLVSIITANGFQVHPEKSRLQVKGRRQEVTGLTVNHFPNVPRRLIRQIRAMLHAWRKFGLDAAQQHYYAHYCHRQYPVFKPRPPFRQVLIGKIAFVGMVRGKHDQLYLRLRDQLLNLDPTYRAAVEKKAEETFILSTPLIKTEGKTDWKHIKHALRVLQAQGLYAGLSLDFDESLTEGGSSELKKTCYYLSRVKQAQIIIALFDRDEPNIIREVADGDRFKAWGNQVFSFVLPIPDHRTHTPDICIEFLYPDNNLLLVDEHGRRLYLSSEFHETSGRHKENPAISCLLSSKFKKDAKLSIIDASVFDANHRSIALAKDAFADYILHDQVPFNRMNLDGFKPIFDMIIAILRAETNKT

SEQ ID NO: 680 - protein, 562 aa, unidentified
  source 1..562: note = Chloroflexi bacterium; note = Related to JACPQA010000272.1
MLSAALAISRIGGQVSLRIHPVPTSTQTRHLTASDDDFRQSFASLIDRDDVVRLLEVTDSTLIYLLYRPRPRYTTFTVPKRGGGIRKIMAPVGSLKIVQQKLNQVLNAVYRVRPSVHGFAIDRNVKTNALPHVGKRWVLNIDLLDFFPSITFPRVRGMFMGRPYAIPERAATVLAQICCKDSLPQGAPTSPVVSNMICGKMDSELRRLATHYRCVYTRYADDMTFSCNSKEFPADLATTYLDGEMRPIVTVGDVLVKAIQANHFSINNSKSTLRGHGTRLAVTNVTVNEFPNVPRTYIRQARSMLHAWRKYGVESADDSYRASRGLRPADDRSRGQVFRRVVLGKLEYVRMMKGDTDPVYINLKNRLADADPRYPRVPTIVTEQQLGAALWVVVSQRGEEIRQGTAFMLQGFGLVTCDHVILDRTEVYQISDPTNAFDATPVKRNGHIDLAILSIDQKPEAQFTGAGRAAILGEDVTLIGFPNLGPGDTERTERGHVTGLRTRFGVKHILISPTIYSGHSGSPVLDAELRVIGIAQRGIDYRNDDPDAIEPSAIAIDEVNKL

SEQ ID NO: 681 - protein, 564 aa, unidentified
  source 1..564: note = Related to JAHBWB010000001.1; note = Labilithrix sp.
MAKAYSRELKDPPSVLASRFASLRDYRDVAALLEVDAPTLGFLLYRSPPSVRYHTYDVPKRRGGSRTISAPMASLKFVQRKLNQVLQAVYSVKPSVHGFVDEKSIISNADCHDRRRFVLNVDLENFFGVINFGRVRGMFMGKPYRLPERAATVLAQICCFNNQLPQGAPTSPVVSNMICGQLDAQLQRLARDHKLTYSRYADDLTFSGTNHVPSELGADRRAPKTFDVGPRLTAVISANGFAINRKKVRLATAAERQEVTGLVVNRKVNVPRKYIRQVRAMLHAWRKFGLAAAEAEFFARYDKKHRPVSKRPTFRRVVRGRLEFIGMVRGKDDPLFQNLLAQYDACVAPSGRSTPRAPNDVIRGALWVVEEDHSEMYQGTAFAVSADSLPEHLRVAVRAAGVEWTLITCDHCLLSGMKAYHPANSGAFFPVEVVARDNTLDLAVLAVRTASLGTLPLDLSATMTDGMSLRVAGFPNYGPGMTAPIYSGTVVGTRAWHGRQLPILDATIVAGMSGGPALNNSGAVIGVAVTGAIDHASAKATEKHGAVPIAALSELQALPKPEPL

SEQ ID NO: 682 - protein, 506 aa, unidentified
  source 1..506: note = Anaerolineae bacterium; note = Related to JAIOHN010000449.1
MSTELHSNPEVLREQFYGLEHPKDIAKMLEISYLTLNYYLYRLPENKHYTIIEIPKRSGGKRSLRVPISPLKILQSKLYEVLLCIYQPRASVHGFARGQSILTNAEAHLQRKNRTFILNIDIEDFFPSINFGRVRGMFMARPYNRSEKVATVLAQICCVDNQLPQGSPTSPIIANMICAKLDSQLQRLAKEHRCFYTRYADDITFSTSLSSFPRALAKVEHNTSGNPLIPGSKLNEIVEKNGFTINPDKVRLQSSDRRQEITGLTVNKLPNVPRKFLNQVRAMLHDWEKNGYGRAQENHFQNWRKGYSSPYSSPTSFAAIVRGKIEYIGMIRGTQNRTYRKLLKKLSELDPTFKKSGLVDMREQIFISYSHKDKKWLEELKRHLTVLEHNHKLVVWDDTKIEAGSKWRQEIEKALNSAKAAILLVSDNFLVSDFIREHELPPLLQAAEKEGLKILWIPVTSTMYEYTEIVEYQCLTEPSRPLNSLKKSERNRELVEICRKIAELAS

SEQ ID NO: 683 - protein, 513 aa, unidentified
  source 1..513: note = Related to JAFGJA010000607.1; note = Anaerolineae bacterium
MDIELSASPEDLQKRFFALQTSEDIAELLEIPYDYLIYYLYRVPFEHQYTTFFIPKKSGGTRKITAPISPLKIIQRKLNQVLQAVYIPKPSVHGFVPGRSIVTNAEAHMYKRIQKKKSQKVEKPRNYILNIDLEDFFPSINFGRVRGMFMAVPYKCPERVATVLAQICCAYNELPQGAPTSPIVSNMLCSKLDSQLQRLAQKYRCHYTRYADDITFSTSLLSFPRALATTEYSSQSGYQVVVGPELNVIVEENGFRINRQKVRLQTPDRRQEITGLTVNEFPNVRRQYINQIRAMLYAWKKFGHDNAEERYRELHDNQEYQCPDKLLPSFRSIVRGKIEFLGMVRGKQDRTYLRFLEKLAEVDPEFRANWEMNKIKKGGTNKQVFISYSRKDEDFARKLVNALSNRNIGAWLDVNEISPGENWVNVIQNGLVVCELMLVIISPDSMSSSQVAEEWQYFLSQSKPVIPLLYKNTNTIPYKLDTKQRIDFQEHYEFDSAMDILLRALNRENIASN

SEQ ID NO: 684 - protein, 554 aa, unidentified
  source 1..554: note = Pyrinomonadaceae bacterium; note = Related to JACDEG010000211.1
MTDVEHREDTGARFSALKDARDVASLLDVSYEYLRHHLYRAPAGERYTLFTIRKKSGGVREIMAPRRPLKLLQHRLAKVLECVYEPKSSTHGFTRKRNVLTNAHIHARRKHVLNIDLLDFFPSINFGRVRGMFMANPYRCPPEVATVLAQICSHNNQLPQGAPTSPVISNMLCARMDRHLQEVAKQYRCAYTRYADDLTFSTYLDEFPPELASMQTEHGVDRCVPGRTLVNIVTKRNGFRINESKVRLQNNKQRQEVTGLTTNKFPNVQRAYVRVVRAMLHNWKKHGLEAAQRQYLSKYNKQHRPPESVQPLFRYMVKGKIEYLGMVRGKDDAIYQRFLKRLRELAPDLVKASSVDDPYAKILDRLWVLETEEIGKCSQGTAFYIQDYGFVTCAHVLGESELAIITAHTRHDASQKYRVKVTAKDDQIDLARLEVIGVTPQVGLKVGASESLQIGDAIKLAGFPNHHIDDTGIVASGTVIGRRNAPVTREPRILISANIIAGNSGGPVLDSNNRVIGVAVRGGANEEESRNTEFHGVVPIEALGRLVVAGVGGN

SEQ ID NO: 685 - protein, 553 aa, unidentified
  source 1..553: note = Pyrinomonadaceae bacterium; note = Related to JACMJZ010000029.1
MTASPQREEIRTQFTSLRSRSDVASLLGVTDRALRYRLYGLPIPSQYVVFEIRKKSGGLRSIAAPIPPLKILQRRLRKILECVYEPKDVVHGFTVERSIKTNATRHEKSKHVLNVDISEFFLSINLGRVRGMFMAAPYKCEKEVATVLAQIACLEGKLPQGAPTSPIISNMLCARLDAHMNRLAGSFKCTYSRYADDLTLSTLQTKFPREVAELRIVDGQPKCFAGPKLIRVLTRRNGFKINLSKIRLANRSQRQEVTGLVVNEKVNVPRLFVREIRAMLHNLHKKGVEKCQQDYETNYARHRRPSSPVPPFLWVLRGKVSYVGMIRGENDELYRKLLKRLDELAPGLVKVPVIKDELDSIFEHLWAIQVETEAGDGGQGTAFMLRGVGLVTASHVLGTKKILGIKMQSSDGRVEREATVFRRDGLLDLAILESPDLDPSRGLEASTLKSTRKMAVTLLGFPNHNTGDPGHFDQGIVTSMRRSPLSEDQMFLISCPIIHGHSGGPILDSSSKVLGVAVRGAISRKEAALTEFHAGMPIAAIEKLTNEMAEPEK

SEQ ID NO: 686 - protein, 544 aa, unidentified
  source 1..544: note = Related to MSXN01000018.1; note = Nitrospira sp.
MPYHLTKSLDLLREEFKKLNSPQAVAALLEVDYKRLIYHLHKVPPSKRYTVFTIPKKSGAARQITAPISPLKILQKKLSFILSSVVDSKHSVHGFVRGRSIRTNSRVHAGKKYVFTIDLENFFPSINFGRVRGLFMAPPFKFNAETATILAQICTFENSLPQGAPTSPVVSNILCRKMDQQLSRLARNYKCDYTRYADDITFSTAKETFPKSIAFTLPDSKEPHCGDELSRIISDSGFTINAKKVRLIERCRQQKVTGLVSNEFPNVDRRFIRQIRAMLHAAQKFGFTAAEKDFHARYYNKLLKPGGKKPSFKKVLKGKIDFVGMVRGKLDRLYLKLIRKLQLLDETLVRAVPSEAWINEIKAALFVIDVHKPAEKPGVPTIEQGTGFLLKGIGLVTCAHVINERIGKLEVYQGADPSKLYDVDVSIEDLDADIAVLTIHGFTGPQLLQGDDGIVREDTEVILAGYPGYARGHSGTIGRGRVVGTNLHFDKKRMLIDAVIFPGNSGGPVLNNERRVIGIAAKGDGGQNSIVPISAIKEAMIRSR

SEQ ID NO: 687 - protein, 585 aa, unidentified
  source 1..585: note = Related to WYDU01000005.1; note = Chloroflexi bacterium AL-N5
MSISLSLLNEELKERLFNLQSRKDLADLLEIDEKQLIYHLYIIPPDQKYKKFIISKGHGSVRRIDAPISALKIIQRKLLKVLTCVYRVKKPVHGFVYGRSILSNAKTHRRRRYVLNLDLQDFFPSINFGRVRGMFMARPYHLNSAVATVLAQICCFNNQLPQGAPTSPIVSNMVCAKLDDELQRLSGKYRCMYTRYADDITISTNLPAFPSNIATLSDKTGQPELGVELQRIIDENGFVVHKDKTRLQIKSQRQQVTGLTVNRKVNVRRSFINQVRAMLHAWDKYGLEAAQEEFINKYDMRSRSPYKNKNGVSFARVVKGKIDYLGMIRGQDDTIYLKYYAQYCRLAGIPNRRALTYPVDETLLPLIVTEGKTDWKHLKIALSKLQSEGIFQNLNISFHEYEDNMEAGDNRIIQMCRDRALLPNNVITIFIFDRDNKEVIKKVTENGQEYKTWNNNVFSFAIPVPNHRTETPDVCIELYYRNEEITREDGNKRRLYLSREFNPESARNHDGSLNCTDMNKIRDQRKVNVIDSNIYNSSKENVALPKSDFADYILHQEENFNDFDYTEFKAIFEIIQRIIQENPIT

SEQ ID NO: 688 - protein, 477 aa, unidentified
  source 1..477: note = Related to JAFGRA010000087.1; note = Anaerolineales bacterium
MGKLLSRSNSQIIERFDALETPKDIADLLEVDYQHFDSILFKTARATLYRECLIPKKNGEFRQINVPAVQLKNIQRRLHEALQVIHKSKLPSHGFERERSIVTNAEAHVKQKFVLNLDLKDFFPSINAGRVWGMFQTVPFNCNEKVASILANICTFKNELPQGAPTSPIVSNMLCRKLDSELQKLAKKYNATYTRYADDITISFSYGEIPKNIATTNELGQLELGNEIKNVIKNNGFRINYDKFRLQSKNMRQEVTGLTVNEFVNVNRKYVRQIRAMLHAWDKYGYEKAEEEFRREYDNKYRPHWKSNPSFKKVVKGKIDFLGMVRGKDDKVYIKYREKLRELAPDIISEPPPPPESESPQSMVPIIRTEGKTDWKHLKAALRWLIDRGEISDLQIEFDEFEETLGEPLLLQDCEALCRHKQPRPIIAIFDRDTKNVNKFHNEKKGYKDWGNNVFSFAIPVPAHRKNTPKVCIELYY

SEQ ID NO: 689 - protein, 580 aa, unidentified
  source 1..580: note = Related to JACSRT010000201.1; note = Ignavibacteria bacterium
MKNLLQYSPEILKNKFHSLTTHFDLCDLLEIKYKDLIYYLYRIDPDVQYKTFYIPKKNGSFREINSPISTIKIIQKKLAQILNAVYLPKEPAHGFIIEKSILSNARLHVRRKYVLNLDLENFFPTINFGRIRGMFLKKPYNFDPKTATIIAQICCYKGFLPQGAPTSPILSNMICSKLDSNLSFLASKNKCIYTRYADDLSFSTSLTNFPKAIAKPNPTGLVELGEELKKIIRDNGFEVNSDKIRLQYKQQRQEVTGLVVNEFPNVKRKFVRQIRAMLHAWEKFGYDSANYEYSTVYNNKTRFASSSVDFAKVVAGKIEFLGFIKGKDNQIYQSFLNKLIALDPEKFKYLEKFVISSTNYVNPLVFTEGKTDLKHLRAALNHFQKNGEFTEIKLEFDEEEKEMGDEELLKLCKNYVKMTGNAKPIIFIFDRDNEKIISQVDNKGSYKIWGNNVYSFSIPIPDHRTDLTYSPIEFYYKNEDLKICDVKSRRLFLSDEFDKNSGRHLFEKELSCNNLKKIKDSKLNIIDNSVFNSESVNVSLSKNDFAENILLGIGKFADVDFASFKKIFDLILQIIKIQDN

SEQ ID NO: 690 - protein, 488 aa, unidentified
  source 1..488: note = Related to CP058566.2; note = Dehalogenimonas sp.
MSHKLNSPPQDLAKSFSALKDGRDVAKLLEVEYAHLVYHLYKIPQEARYSQFKVKKRGTNEFRTISIPNGSLKIIQTKLVQVLEAVYFPRIAVHGFIKGKSILSNARIHANQKWVFNADLEGFFPSINFGRVRGLFIAKPYVLPDNVATVLAQICCYNNELPQGAPTSPILSNMVCAKLDSELRILAQHSRCNYTRYADDLTFSTSSPKFPPQIASIDGDSQNTIIELGEQLRTIIGNNGFCVNAQKTRLQTKTHRQEVTGLVTNQFPNVSRQFIRQVRAMLHAWEKFGLEKAQTEYLMLYRDQQRNPLKNDPKYRNVSLKDVILGKIGFIGSIRGKTDFIYIKLLNKVISLSPELAKQKDKISALMSSGPAPLIRVTTEGPTDWMHIETAFNNLQSKGLFAGLAFDLVRYEHDMGHSRLLSICEAYATLPIPGGLSHVFIFDRDEPQIVNKVNEHGDVRKWPNNVYSFSIPIPTHRTKTPEICIELN

SEQ ID NO: 691 - protein, 544 aa, unidentified
  source 1..544: note = Related to JAGQGA010000179.1; note = Anaerolineales bacterium
MPEAQRYTTFKLAKASGGFRIISVPNHSLKILQQKLNHILQMVYQPKASVHGFLQGKSILTNAERHVKRKYVLNLDIEAFFPSINFGRVRGMFIAAPYNLPENVATVLAQICCYQNQLPQGAPTSPIISNMICSRMDVALKRLAQTYKCTYTRYADDITFSTSKPQFPPQIASIFNKQETSVIVLGTELNHVIESNGFEVNSSKVRLQTKNHRQEVTGVTVNRFPNVKRAYIREIRAMLHSWRENGFTEAEQIFREKYDSKQENRNPNLPIPSFAKVLRGKIEFLGAVRGKNDHIYLRYLNELSSLAPPGTIKLPKSVGKSNIIKLKPTVYVEGKTDKKILSIAWAKLFESRPIPFNIEDSNLSQTDQGGGLGGAEILKQFISVVREDHLHLAIAMFDHDQEGIKCYNSLPKYFDQVSELEAKISRHGKAAAFLLPASDQKSEYIKYENFVIEYLFSDAALAKTTEDAQGLIFQQASIEQRIVGSGKSFRLSSTPSSIPETRTIKEGKVVFAERIVPHLDKSEFTEFRFVFAKIQQIITYMASL

SEQ ID NO: 692 - protein, 564 aa, unidentified
  source 1..564: note = Related to JAGOBP010000036.1; note = Thermoflexales bacterium
MNNLSPVLSASAEELRKKFQELQTREDVANLLEIDESRLNYYLYIIPEPHRYTTFQIPKKSGKFRTISVPATALKILQRKLNQVLLAVYQPKAAVHGFVLGKSIVTNAQMHLRQKFVLNIDLKDFFPSINFGRVRGMFVAPPYKLPPMVATILAQICCWNNQLPQGAPTSPIVSNLICAKMDSQLLRLAEKHRCVYTRYADDITFSTSTSQFPIAIARKSEVTNQVEVGGDLGRVINENGFEINSDKIRLQTRQQRQEVTGLIANGKTPNKTPNVQRRYLKQIRAMLHAWEKFGLDNAEKDFLEKHDGHYRHPNLNEPSFKKVVCGKIEFLGMVRGKDDVTYHRFRDKLWSLAPELARFDPEIESTNIPTSVLIITEGQTDWKHLKAALQQLKEAGDFSDLNIEFREYDDSIQMGDGELVKLCIQMAKIPQSKITICLFDSDAPSTLKPLALSDAMYKHMGGNVFAMVLPTPNHRQGLPGVCIEHYYQDSEITREDTHGRRLYLSNEFHEKSMLHRTKHGISTSDRRVHDLKKVVCQVLCKLGGAGQALVSTVMRRNFRLRITA

SEQ ID NO: 693 - protein, 652 aa, Chlorogloea sp.
  source 1..652: note = Related to JADQBB010000011.1; note = Chlorogloea purpurea
MVNVDEELIKNFQNLKSVKGLYLLLQKFHTGPASFPDYSTFRQILFNQWQDEPYESFKMAKKNGSHRTIEVPKPEIKLLQQSLNTILRGIYEPKASVHGFTIKKNIISNAQNHCGKKYVFNIDLADFFHSITQQRIRGVFMKPPYSLPSKVATAISHLCCYNDRLPQGAPTSPIISNIVCAKLDSGLRLLAKENNCFYTRYADDITFSTTRKNFPTDLGVIYGGGTQDIKIGDKLASILAENGFTVNAAKTRIQINTLRQEVTGLTVNTKVNVSRDYIRHVRAILHDWELNGYVKANSNHWSHCSKKHLRHGNIDDVLGGKLAFIGQVRGNEDLLYKKLLQKYAGLIVNEMARDLALKFDNKLYELWSGVIDQYLEQAVIDYVANENITNEDIKNGFEELKKLKPINGRDYKQRQDPDYNQVGVPVAYTFLYLPRKIMAATAILTHYFGQKNSRIPYNILDIGSGTNAVSIAIGLFLFTDKININLTALEPSHYMRHFCSYQPNFSHLNISYREGMVGEWQDVLHSNYYELIFMSSVLQNSFNDQQDTWWEDRCRELYNCCKNNGTFIIVEPNAKMDLLNSLVNAMQKIGWSFKERLFLSNLLPKVSKNDELIKMQKLTDLKKEYKCDYHNYSVCNWNPNPKYNEIIYIFEK

SEQ ID NO: 694 - protein, 643 aa, unidentified
  source 1..643: note = Related to BJCE01000167.1; note = Sphaerospermopsis reniformis
MRYLLREASEIVESFRKINSFQDFADLLEVDYFWFKQELFAVPLEEKYTSFTIPKRNGESREIYSPVSGIREIQARLNEVLRLVYEPERKQSVHGFTTSRNIVTNAKNHCNKKFVLNLDIKDFFPTITQQRIRGVMMSPPYNLPSQIATTISHICCYEGKLPQGAPTSPIISNIVCAKLDSELRLLAKQNKCFYTRYADDITFSTIVKNFPLSIAKITGLKITDVSLSDNLISIFKSNGFQINFNKVRIQGDNQRQEVTGLTVNNKPNVSRKYIRQVRAMLHDWHKNGYVQAYINDSAIRYQKNKNRVNFSSALRGKIEFIGQVRQKDDFIYQKLLTFYEKLIEREIIRQRSLKFDDKDYNNWCDSVDEYALHIINNYIDAISVDIDNMKECIQQGFDELDKLRKKQDPDYDLPGVPIAYAFKYLPRKIIAMTAVLSHYFREENVPIPEKILDVGSGTDAVGIALGLFRQKMSFQITAIEPCSYMRQFAMFRPSLPNLEVLNVNGRLGDWFNYLNNNYFNLIFMSSILQNSFENLGNSWWLEWANELYQASTNNARLILIEPSVKVKLVNKMKWAMESSGWILREQLLLSDLFPNVFNKGCQLKKLTSLKQELIGNYCPWPVSGWNTYYKYNEVIHIYSKNNQ

SEQ ID NO: 695 - protein, 574 aa, unidentified
  source 1..574: note = Anaerolineales bacterium; note = Related to JACZJC010000064.1
MTKTLLSITPIEQREAFFALKTRRDIAVLLGYRYDGLVYQIYKIPAEKKYETFFVPKKSGELRTIHAPSPKIKRIQRLLNEVLQNVYKPKPVVFGFTSGKNIVDNASKHKKKNWVLNVDLENFFPSINFGRVRGMFMHKPYNLPDEVATTLAKICCFENSIPQGAPTSPVISNMICAQMDSQLQDLAWKHRCFYTRYADDITFSTTLHEFPLEIAKVNSVLSIDLGQELINIIQQNGFEINHGKVRAFAYFQRQEVTGLTVNKFPNVRRKFVMQIRSMLHAWDKKGLQTAEAEHYELYNKRHHNQNSKLPAYKKVVKGKIDFFGMVKGLNNSRYMEFKREYLRLSRRDKNVPFKNISAKTESKIIIYTEGPTDPPILKTAWQKLYQDEILFIITPVEIKPGIATGATALAAELNTHRKQHGIVIGIFDRDAEGIKAYKSLHSGEFEEKDGFKISIDRNAAAIILPIPTGKEKLAELDKLWIENYFSETALNTKTTDGKGLAFEYKPVVVTKKIGDKIIEETKTDERSLETAVIKDGGKRIFAEKIVPTLPVDEFKGFELVFEKINEIAELLQEL

SEQ ID NO: 696 - protein, 553 aa, unidentified
  source 1..553: note = Related to JAHRVL010000217.1; note = Kordiimonadaceae bacterium
MSPHLPHFVARIVLLKNLLDVNTSRELATFLKINYENQLIFHAYRVPSHEKYLTFEIPKKSGGTRRILAPATALKLIQRSLAEKLLEIYKPRASTYGFCLGRGVVDNAKQHLGKRVILNVDFENFFPSINFGRVRGLLMAKPYSMPKEVATIVAQICCHDNQLPQGAPTSPVVSNMICRSLDRQLQIMARKHNCWYTRYVDDITISTNRRRFPPQIAQRTDDLSATEAQLGEEFKGIVENAGFNFNPSKTRILTNMERKEVTGVTINEFPNVPRSYVRQIRAMLHAWEHYGFAAAQEEYIKKYQPACRNDKKGAVNFEWVVRGKLEYLRQVRGTQDPIFIKQASRFNLLASSSIKLPLAAETTDVTTSTWIVQSTSADGKTLQEGTAFFLEGVGLVTCEHCIIGPTIIFSASSPTIEFPVVASKKNAYTDVAILNFTDDLQPTKTQDLRRNKGLGDNLPPPLTDIRLIGYPNWALGAGMSIRLGRVTSINHDEPRYFQIDASIISGNSGGPVLDAEGFVLGMASRGAPNQEDAQKTNDHRVVPIQAIFDLCNQ

SEQ ID NO: 697 - protein, 590 aa, unidentified
  source 1..590: note = Chlorobiales bacterium; note = Related to JAAXWZ010000064.1
MSLSNPLPPRNAASLTELSILQTKREVASLLGIKYKYLIYYIHKYPHDKRYTSFQIPKKSGGVREILSPIGPLKFIQRRLSEVLLKDYKVKPSVYGFVKEKSILKNAQRHVGKRYVFNADLKDFFPSINSGRVRGMFMSPPYSLNKEVATFLTQICCHNNALPAGAPTSPIISNIICRSLDNQLQELAKENRCTYTRYVDDITFSTTLRSFPQSIAHINEAGQIEAGSRLNQIVSANGFQFNSKKVRLQAKNKRQEVTGLTVNEKPNITRKFSNQIRAIIHAIEKYGLEAAEKEFLAKHQKKHRNPKLPTASLLRVLKGKIDFLGMVRGKCDPLYLKFLRQLKAIAPQMVKDLPEPRKECTKVEVWTEGKTDWKHLKAAFTNLKGQGYYINLEIDFKEFEDSMGEGELFKHCPIWSKTTHQSPLICIFDRDIPTRTKEVMNNGRFKDWTNNVFSFTIPVPEHRQSTQEVCIELYYKDSELKREDSNARRLFLSNEFDAKTTIHKEIPGLICPDKKAKDAKKLTVIDNNVYHSLNHKRENIALPKDDFASKVLAGEKNFDDFDFSQFKKIFDVIVEIADFSRRNYPSNLSP

SEQ ID NO: 698 - protein, 546 aa, unidentified
  source 1..546: note = Related to JAHJHP010000073.1; note = Candidatus Omnitrophica bacterium
MEKMQLKLTASDDEQITKFKTLKNYYDIANLLEVESRYLKYLLYHPKKTHYKIFFIKKKSGNLRKICAPISSLKIIQQKLAHVLYLIYAAKPSTHGFCPNKSIVTNAQLHIKKKYVFNIDIKDFFPSINFGRVYGMFNGWPYGLPSRVSAVLSKICCNDNELPQGAPTSPIISNMICAKLDSKLQELAKRCNITYSRYADDITFSSTSRLPKEIVEFEILDSSVAITTGERLRGVLNNNGFEINNEKVRLKYKTNRQEVTGLTVNEITNTKRRYVKQVRAMLNAWEKYGLKKADEEHFNKFNIKQRNPEFKKASFMQIVEGKISFIKMVKGEKSPVYRKLANRFINLSGKKKLKYFIDPNDEIKAALWVLEDDITGYQGSAFMLSGVGLVTCQHVLSKNIQAFKCEDPSKKYRVSSVLQDKDCDLAILKIDTEDSHYLKAGRSEVIRHGELITIAGFPQYRLGGSLIIIESKVAGFYPRFNFKRILIDKQIVGGNSGGPALNRDNEVIGIVATGAENFETTTKTIEYGIIPIELIFEMLKKSEICI

SEQ ID NO: 699 - protein, 536 aa, unidentified
  source 1..536: note = Related to JAHJDL010000235.1; note = Candidatus Thermoplasmatota archaeon
MNNYIEVDKNVLREFKNLKNERDVANLLQIPYNVLHYYIVINRNNNYKKFIIKKKNGEIRTIYAPISSLKILQRKLHKILSEFYKVYYRPSVYGFRDNLSIVDNARKHQDKKNIFHIDIKDFFPSISYKRVIGLLSSGIFNFPYSVSIILTKICCYQGMLPQGAPTSPILSNIICSKLDYELQLISKDNYCTYTRYSDDIVFSNTANTFPKDIATDGKCSDKLVSILLRNGFKINDSKVYLQRNIQRQVVTGLTVNQFPNVKRIYVKKIRAILHSWEKYGLKNTESIYCKKREVEKENRKEFMCSLVKVIEGKIAFLKMVKGKDNYTYLKIYKRFCDLIGREFPYHDLLNALKVEKRVMLNKYAKSIRKCIYRCNQSYAYDIFKPTNDLINSLDNLGIDARDYHRFGDRIDDLYMIFYEGTGYIERLKEHSLDRTIITEINILRTYYRHDIDHGKTNEIRRKRIKTMKVIQKYINKNSIINASELDLYIFQKKLYDNVMIFLEELEESINKNTYNNDTTGNIRRLIKEIISSLKRL

SEQ ID NO: 700 - protein, 509 aa, unidentified
  source 1..509: note = Parcubacteria group bacterium GW2011_GWA1_59_11; note = Related to LCSE01000017.1
MQAFFKASNLELINRFHKVDGLIDLANLLEVDSSELLLLFYGLRRGGGYYKEFSIPKKTGGERKILAPDSRLKFVQRKLAYVLSLVYFGRPSVHGFRLGRSIITNAECHARKKCLLNIDLKDFFPTIHFGRVRGLLQAKPYGLSKTGATAVAGICCFWGKLPQGAPTSPVISNMVCAKLDYELQALARGEGATYSRYADDITFSTQRRNLSENIVKFENSSFIAGPKLVEIIRKNGFEINKDKIRMRFLTERQEATGLVVNKFPNVKRSFIREIRIMLHMWRKFNLETASLFYGMKFPGREIYFPEIVRGKINFVKLVKTERDPTYLGLAEKFNDLVGKPVFKIVPIKDWPDEEYIPAGHRYRAIETLETIFANADKEILISDNFLRKDIVGLLEKQVGRSPRLKIRLLFSRGRYKSEERKYAECIEAIKKMVSLHKDLSIDCREVLPGGPHGRNIIIDREEVYHSGHSLDQLGSRADSIIRMRIQSAKRDALQDIETWFANSAEIPLI

SEQ ID NO: 701 - protein, 322 aa, unidentified
  source 1..322: note = Related to JACPLU010000002.1; note = Parcubacteria group bacterium
MRPDLLNSPEVLKEKFRNLKTLIDVADILEIDCKTLIYLVYRKNKPTNYKEFVIKKKSGGERRILAPTSTLKILQRKLNYILSICYEPRPSVQGFVNNRNIVSNASAHSGKKIVFNLDLKDFFPSINFGRVRGLFLKPPFSLPAPVATALANLCCHNNQLPQGAPTSPIISNLICSRMDGAFQALVKKYNAVYTRYADDITISTRQAFFHKEIVESGSAPLCGKGILSIIASNGFIINDAKTRILRTGRRQEVTGLVTNRTPNIKREYIREIRVLLDKWRKYDLRVAEEAYFKNRLKERAPHIKSVEFSKIIEGKINFVKDG

SEQ ID NO: 702 - protein, 551 aa, unidentified
  source 1..551: note = Related to NZ_LT828648.1; note = Nitrospira sp.
MDTQLKASQDTIISLFAALRTPRDVAKLLEVPYGLLIYHLHKTPPSTRYISFAIRKRAGGERIISAPGTALKILQIKLNYVLKTVYRPNSCIYGFIVNGGIVKNASVHANRRLVFNLDLKDFFPSIHFGRVKGMFSSPPYNCPSEVSTVLAQICCLPKTYPSLAPYAQLPQGAPTSPIVSNMVCSSLDSQLLRLAKKYKCSYSRYADDITFSTNLPRFHEAILVESQAEEGRISVTAGSELKAIISSNTFRINENKVRLQRAMQRQSVTGLTTNKFPNPPRRLIRQIRAILHAWTKYGYENAQNEFRSRYFNRTRNPNKMAPELKHVLHGKINYVGMVRGQTDPLYLSYLKQLKALAPELIIRQVIDVMDALWVLESDGAYAQGTGFSLKGYGIVTCYHVLRARTKLFKANTPAKKYNIEVIIQDQELDIAVLATDGPQGPELLLEEGERPRQDDWILLTGYPSYSAHATGVVRRGRVTGYYQFFGTERMLIDTPIVYGNSGGPVLNQSNKVVGIAAKGPVSLNDAQKTEKFEVIPISILRRLAPPAPTAQ

SEQ ID NO: 703 - protein, 528 aa, unidentified
  source 1..528: note = Related to DOHN01000106.1; note = Ruminiclostridium sp.
MNTELKSSDEELKKKFFALKNKHDICALLEIDIKTLIYILYRKMPSTNYSTFTIQKRSGGLRVINAPSTSLRILQQKLNYIFQLIGMIAPCAHGYINGKSIVSNAKPHAKKRYVFNLDIEDFFPSINFGRVRGLFMSYPYYLPKEAATILAQICTYENELPQGAPTSPIISNMICVKMDKQLMKLAYDTKSYYTRYADDMTFSTTLRMFPSELAYNKASGEIVASSSLTKVIIDNGFKINNSKIRLQKSTQSQQVTGLTINQMPNVKRTYIRNIRAMLHSWEKYGLDKAEEEYLSKYNYRNKDYIKPCFQDIVKGKINFVKMVKSEDSKVFRNLAIKYNQLAGSGFSDYTINQPSEEILLQIYTEGKNTEHIEKAIHILDKDLSALIYNGKIKIVNGVEHRSGDQQLKTTYEIMSKSKNSNKFLFVWDCDSKNKINSLVEENNFFKFVFASNTDNTKVEKGIENLYPESLFTQDLYSLEETKNDYGGKKSEEKFDKSKFLNKIKEETDPYVFENFKPLFREIRNILDM

SEQ ID NO: 704 - protein, 527 aa, unidentified
  source 1..527: note = Related to NSKE01000007.1; note = Aliifodinibius sp.
MDVELNYSNRELKQKFANLKSLREVSDLLEISSDKLKYYLYILDDEKKYNEFKIPKRSGGTRSISAPNDSLKILQQKLNHILRLFYNPRVCVYGFVNDRDIVEGASKHTDKKYVLNVDIKDFFPSINFGRVWGLFQAKPFNLPEEAATVLAQICIFKNSLPQGAPTSPVISNFICAKLDSELTRLAKKHKVTYTRYADDLTFSTTIPVFPKSLAKINDAGQTIVGSELEEIINDNGFEVNHDKVKLMNSSQRQEVTGITVNEFTNVNRSYVRKIRAMLHAWEKFGYENAEDTFHREYCNPGINPERSKPPLDKVIKGKLEHLGKVKGKHDPVFLKYYHKLVKLDDKYEREHYNKKYQLLDHNEYPFILDRLNDRFQDIKKLKPHPRGYAFEDFLNELFKTYSLEPRKPFKNVGEQIDGSLNFEGNAYLIEAKWQDKNIEAKHLNNFQVKVDSKASWARGIFISISPFTDGCLKNFREGKSTKLLGILGDEIESMLKHKIDLREVLKYKARKSVETGDFFTRIENELK

SEQ ID NO: 705 - protein, 364 aa, Nostoc sp.
  source 1..364: note = Related to CP046703.1
MSKDTSHSLLLYDSCKELSEKFKKLESPQDVAQLLEVPYKNLIYYIYRKSEDSRYNTFIVPKKSGGSRTIHSPNKSLAIIQRKLSQVLYTIYRPRASVHGFAAKRSIVTNAKAHIKKKFILNLDLKDFFDSINFGRVRGVFIAKPYEVNEKVATILAQICCFNNKLPQGAPSSPIISNLICAKMDSELQRFAEEYGLFYTRYADDITFSINRDELPSALVDSYKKGLPHVVLGKELKSIIEKNGFQINDAKVRLAYKTQRQAVTGLIVNKSVNVNRKYIRNLYGALHAWEKYGLEQAVETYISKYAKKPILPEKDIPAFLDSLRGKIEFIGSVRGKDDDLYQKLLNIFNGLRRKEADKESIAVE

SEQ ID NO: 706 - protein, 364 aa, Anabaena sp.
  source 1..364: note = Related to JAAVWA010000002.1
MSKNLSHSILLYDSCEELSKKFKELKSPRDVARLLEVPFGDLNYYLYRKSEDSRYKTFIVPKKSGGSRTIYSPHKSLSIIQRKLSQVLYAVYRPRASVHGFAVQRSIISNAKAHTKKKFILNLDIKDFFDSINFGRVRGVFIGKPYELNDQVATILAQICCFDNKLPQGARTSPIISNLICAKMDSELQRFAEKYGFFYTRYADDITFSITREELPTELVACYKKGLPKVVLGTELRSIIETNGFEINEAKVRLAYKTQKQEVTGLIVNNKSVNVNRKYIRNIYGTFHAWEKYGLEKALEIYKSKYAKKSILPEKDIPHFLDSLRGKIEFIGSVRGKDDNLYQKLLTIFNDLKSKETNAENIEK

SEQ ID NO: 707 - protein, 377 aa, unidentified
  source 1..377: note = Related to NZ_LXYR01000055.1; note = Phormidesmis priestleyi
MKKKAYLSLFLYESCEELSKKFQELQSPHDIAQLLQVPYEYLTYYLYRIPHGSRYTEFRVLKKSGGYRTIHSPKGSLGIVQRKLSQVLYAVYRPRPSVHGFAASRSIVTNAKAHVNKKFVLNVDIKDFFGSINFGRVRGMFIANPYKLDEKVATVLAQICCFDNKLPQGAPTSPVVSNLICAKMDSELQRFSKQHGLLYTRYADDITLSSNRNELPTSLVSHYEKGLPNVMLGDELRSVIERNGFQINEAKVRLAYKTQRQEVTGLIVNQTVNVSRKYVRNIDGALHAWERYRLEAATETYRAKYAKKTTFPEKESALFLDSLRGKIEFVGSARGKDDHLYQKLLKKFNDLRTREAIDQKTTETEPLQTTLELPFND

SEQ ID NO: 708 - protein, 358 aa, Nodularia sp.
  source 1..358: note = Related to REBL01000169.1
MNKNSSLSILLYDSCEELSKKFKQLQSPQDVARLLQIPYDYLIYYLYRRPDDLRYTTFSIPKKSGSHRTIHSPHKSLAIVQRKLSQVLYAVYSPRPSVHGFAASRSIVTNAKAHTKKKFVLNIDIKDFFDSINFGRVRGLFIAKPYELNEKVATILAQICCFNNKLPQGAPSSPIISNLICAKMDSELQRFSKENGLFYTRYADDITFSLTRNELPPGLVSSYQKGFSQVVLGNKLRSIIENNGFQINNSKVRLAYRNQRQEVTGLIVNQGVNVNRKYIRNVYGALHAWEKYGLEEAVKVYISEYAKKSVSPKQKYIQDYPDYLTSLRGKIEFIGSVRGKDDGLYQKLLNIFNELINK

SEQ ID NO: 709 - protein, 366 aa, Anabaena sp.
  source 1..366: note = Related to JACJRF010000019.1; note = Anabaena subtropica
MKKNISLSPLLYDSCEDLSSKFLQLKSPRDVARLLQIPYNYLIYAIYRKDESLRYRTFNIPKKSGDYRVISSPHKSLAIIQRKLSQILYAVYKPRPSIHGFAAKRSIITNAQAHTKKKFILNIDIKDFFDSINFGRVRGLFMAKPYELNEKVATILAQICCFNNKLPQGAPSSPIISNLICSKMDSELQRFAKEYSLFYTRYADDLTLSLTRDELPSELVASYKKGFSQVVIGNEVRSIIEQNGFQINNSKVRLAHRTQRQEVTGLIVNKNVNVNRKYIRNIFGTLHAWEKYGLEESVKTYISKYAKQPILSQKDVPTFLDSLRGKIEFVGSVRGKEDPIYQKLLSIFHGLKNKEIDNAIVVDSEN

SEQ ID NO: 710 - protein, 354 aa, unidentified
  source 1..354: note = Related to NZ_JAECZC010000098.1; note = Amazonocrinis nigriterrae
MYESCEDLGKKFKELKSARDVAQILKVPYNYLIYYIYRTSENSKYQTFNLEKKSGGYRTIHCPNNSLEILQRKLSQVLYSVYNPKPCVHGFAANRSIVTNAKVHTRKKFVLNIDIKDFFDAINFGRVRSLFIAKPYQLNKEVATILAQICCFKNKLPQGAPTSPIVSNLICAKMDKELQNFAKENGIFYTRYADDITFSINRENLPSGLVSSYSKGFSKVILGDELRSIIENNGFQINESKVRLAYINQRQEATGLVVNKGVNINRKCIRNLYGTLHAWEKFGLEQAQKTYIFEYAIKPVSPNNKVPPFLDSLRGKIEFIGSVRGKDDPLYRKLLNIFHELKEKESDKNNIIVP

SEQ ID NO: 711 - protein, 364 aa, unidentified
  source 1..364: note = Related to JAAHFU020000005.1; note = Leptolyngbya sp.
MESRSDFLQPLLYESCEELAKSFKSLKSPRGLASLLKIPYEYLVYYVYRFPQDRKYRAFKILKSSGGHRAILVPNKSLKIVQRKLSQVLYSIYNPRPCVHGYVPGKSIITNAKSHTRRKFILNIDIKSFFKSINYGRVRGLFIAKPYCLNPPVATFIAQICCHENHLPIGAPTSPVVSNLICSKMDSELQRFAKEHGCFYTRYVDDMTFSINKKNLPSALIANHGPGFSEVVLGNQLREIIEEDNGFQINSSKIRLRHYTQKQEVTGLTVNKFVNVDRKYIRNLLATIHAWEKHGFQNTIDMYMKKYAKESVLPGKETPNFLSYLRGKIEFVGSVRGKNDLTYKKLLNKFFELKTRDSKMIRGI

SEQ ID NO: 712 - protein, 372 aa, Synechococcus sp.
  source 1..372: note = Related to NZ_PCGE01000062.1
MRNQKTISLEGRTDDLQQDFLKVLNNRDLAKLLEISYPQLIYHSLKTINSVTRYQTFQVQKKSKGTRKICVPNKSLKIIQTKISQILYSIYEPKSCVHGYVVEKSIITNAKSHRRKEFILNLDIRDFFGSINLGRVRGLFIAKPFSLPKEVATTIANLCCHENKLPQGAPSSPILSNLICQQLDRELQYFAQKNRLYYTRYADDITFSSEYLESLKSLIKNLELVTENYPILLNNELEYIFTKNGFTINQKKVRLLYPHQKQQVTGLIVNEKLNVDRKYIRNLRAALYAWEKFGLEEASQVYLEKYAKTPTLRRKKKSSFIEAIRGKIEFLKNVRGESDPITRKFLDKYSELYEEYKKNVIQAKEEPDSQST

SEQ ID NO: 713 - protein, 369 aa, Synechococcus sp.
  source 1..369: note = Related to NZ_CP016483.1
MRNQKTIFLEGKTDDLQQDFLKVLNNRDLAKLLEISYPQLIYYSLKTINSDTRYRTFQIQKKTKGTRTICVPNKSLKILQTKISQILYSIYTPKSCVHGYVFGKNMITNAAAHRRKAFVLNLDIQDFFGSINLGRVRGLLMAEPFSLSNTVATTISNLCCYQNKLPQGSPSSPILSNLICQKLDRELSHFAKKHRFYYTRYADDITFSSKSLDALPFLIKNLDLVKEKYPILLSDELEYIFTSNGFTLNQNKIRILYPHQKQQVTGLVVNKKLNVNRKYIRNLRAALYAWEEFGLEKTSQVYLEKYAKTPTLKQKKKSPFVEAIRGKIEFLKNVRGKSDPITQKFLDKYSELYSRDVTQAKDDQDSQST

SEQ ID NO: 714 - protein, 351 aa, Synechococcus sp.
  source 1..351: note = Related to NZ_CP016477.1
MYLESSCERLKHDFLKLENNRELAELLNISFSRITYYVVRIPDSARYRSFQIKKRSGGFRKIDTPIKSLKIIQQKLSQVLYSVYQEKSCVHGFVVNKDIISNARAHTKKDFVLNIDLENFFGTINFGRVRGLFIGEPYNLPQDVATMIANICCYNNQLPQGAPTSPIISNMICERLDRKLQQFARKYKLFYTRYADDITLSATRKEIPSSLATVSPENRNKIELGDELQKIIYENGFSINHKKTRIAYSDQSQKVTGLIVNKTVNVPRKYIRDVRAALHDWDKNGYSKAQEKYHLKYAKQPSLQSKDSPSLHDSLRGSIEFIGHVRGRKDKVFCRLIAKLTVLKYRDLSKS

SEQ ID NO: 715 - protein, 715 aa, unidentified
  source 1..715: note = Related to JADZAP010000042.1; note = Ignavibacteria bacterium
MIEYDNKYNQYLHKFTKIKTSLSEDKFRLVEINLKTILSTKTFNGLLFTNECLNYFINKDKNKFPDWFINNIESEIKRRDELLTLKNNFFKIKHEHELAGILGLDYGTLVYHIFKVPDNRKYKIFKIPKKTGGYRTLCSPISNIKLIQKKLSEILYEIYIPRINAHGFIPGRGIVTNARIHVKQNAILNIDIKDFFPTINFGRVRGLFLNKPFYFPKWIATLIAQICTYQNQLPQGSPVSPIISNMICSKLDNKLSAISKKYFCYFSRYADDITFSTKKYDFPEELIRKIRIIIEEEGFIVNNNKFRIQKKNQRKEVTGITVNEKLNVKRKYIRKIRAMLSSWEKLGYENANNTFNKKIKPTYPHINFLPRLDNSLHGMIEYVGQVRGKEDNIYLKFLEKYNALNKTPHSERAINNNETDSKVEKREEHNQNPQHVPIKVCELLNSFKKEGSYLKKLVHNDEDKPDLPKILDGAKNEINTKKSILPYELYSNIWVNLIRLYEKEGMGVWNRNDKKHPISITKFNDKIIQFKKDIRFGASSDQTSMFTTIQSIIKELPNKQLENKIKVNPNLDKLDIYTDVQHIRNGLKIIIEHVIKYIDKGNGIRINLSELKWVNEKLYKYEISICNLNSSSYINKQVLIKRFNDLEHDLPKLKDKHSSKGHLFNRCDWYIEAIFDGQISKINVLSKDNPDGSTFEDANPKSNDGFTHILVFYGM

SEQ ID NO: 716 - protein, 549 aa, unidentified
  source 1..549: note = Related to JACKBS010000010.1; note = Ardenticatenaceae bacterium
MVYIYKIEPNRRYTIFSIPKHSKGERKISVPFKSLKFIQKKLSNILQTVYEPSIQTHGFIQERSILTNAKLHSRKKYVLNLDLKDFFPSINFGRVRGLFIHHYNFSPAIATVLAQICCFDNQLPQGSPTSPIISNMICSRMDNELAKLAKRYNCIYSRYADDLTFSTSEYYFPHELARTKIVNNFTITRLGEELRDTIEDNGFRINNEKVRLQKTNERQIVTGLVVNKFPNTTRKYVRQIRAMLYAWGKFGLQPAEEEYFKKYDKKYRAPYKIKPSYKNIVRGKIAFLGMVKGKEDKVFIRYWNQLVALAPEFGKPIVPSTISAFIPPIIYTEGKTDPKHMEAALQHLKKRGTFHDLIIKFHQEEGDSGLGHDNLLKMCQNFSKTPNSEARIFLFDRDVPGNVKSRVTGKGEFKSWGNNVFSFLLPIPTHRENNADSVCIELYFEDKDLMLKDEFGRRIFLNREFSNLSGRHKSLDLICSDRNKIKSSLLEIIDSSVYDSNDQNVALSKNDFSNLILERKHPFDQVDFSAFLKIFKVIGDIISKVNANA

SEQ ID NO: 717 - protein, 564 aa, unidentified
  source 1..564: note = Related to JAFQYI010000015.1; note = unidentified bacterium
MKKYTVKLNENEIKRRIADFCDDSKGEKTIEDFLDTSLKGLKIKLYKNYNELYKEKMILKRNGEQRILRVPNNYLKKIQRNLNYIIQTIYKGKFTSHAFEKASEGKSKNIITNAKIHTNKKFILKIDLKDFFPSISFPRIYGVFQKPPFNFDNKTARLLAHICIFQKSLSKDDVGELPQGAPTSPILSNLVCRNLDNQLFKLCSKNKCQYSRYADDITISTNLSIMPNEIYSNNDISTQIKEIIKQNGFIINQEKTKLLTQKRRQMVTGLVVNKKVNLKRNYIKNIRAMLFQWQQKRIKYMRILKNKKNIFTIIKLIKKSNFKNINSKNKNERKKIIKDLLSNDKYNNTIYFIAMKSALLDVEKEMHDKYYQNKFDKPKFKRVLSGRIGFVRKVRGDEDDIYRKLWNQYCYLNNKKKKIKPLIIKNVSDDPIWNIINKGESMELELKQEYSEQHLLETINAFLNSKFNGTLIFGVEDLTHIIYGIDKELKTKSKDAFRNEIIHKIFDTFNPQKQLPVMCKFYERYKKTICIIEVQPYGERIYLDAKNKIYFERMDGYSQKRQDP

SEQ ID NO: 718 - protein, 576 aa, unidentified
  source 1..576: note = Candidatus Limenecus avicola; note = Related to DVOD01000049.1
MKKKFQHDLKASKQQILEKLDKISNNPLATKKDVADLLERNLQALCIKLYVNTDDLYEISKIQKKNGKERIIFKPNPYLKQVQRNLLYILNLKYESKFCSHGFEKDKSIKTNAATHVSKKYILKCDIENFFPTINFKRVYGVFKSPPYNFNPEIAAFLAHICIYQVSTTDKHDLGILPQGAPTSPLIANLVCRTLDNQLFKLAKNNKCYYTRYADDMYFSTYLTNFPEKLYTNGKLSNEIEEIIYNNDFRINYDKTKLMYNNQRQAVTGIITNKKLNVKRSYIKNTRTMLYLWEKFKNKYTLQLFNATSEKDTVLHLLSLCKSLIFFPSKSEFKKYHTLNVTEQEDLVQKYLNDDNKRKNMYYAIATELSLYEAEQLMHEKLYKNKVKKPFFKNVLRGKIGYIKLIRGEDDNLYRKLWNRYCKIINSNQFKPLIYPNTPDNRIYNMLHSVKEGLDVEFKEYYDKKKLLETVNSFLNSDKGGQLIFGINDITMEITGIDKEINKQQKGEDGLRTMITNIICSKFHPTSQLNITCKFHKIYNKTICRIEVQPYHNKPIYYEPGKYYIRQDGRKQLVQT

SEQ ID NO: 719 - protein, 578 aa, unidentified
  source 1..578: note = Related to LBOR01000005.1; note = Candidatus Peregrinibacteria bacterium GW2011_GWC2_33_13
MKKNEHKPKHNLFFSDEIILEKISSLQNNVFAEKKDMAALLKSNIIAIGIKLYKHNHLLYKSISITKRDGTTRTIREPNAYLKQLQRNLVHILNLIYKGKFCSHGFEKGKSIVTNAKFHTNKKYIFKIDLKDFFPSITFARVYGVFCSPPFNFNKDISILLAHLCIYQETLSSDSEGELPQGAPTSPIISNLICRSLDNDLFKLSKKYKCNYTRYADDITFSTNLSVFPKELYDNSQIGTELNKIIIKHQFQINESKVRLVSNKRRQIVTGIVVNKKTNTKQSYIKNIRTMLHNWEKAKYKYVHILLDSKVTLEKKIQLVKLSKIPIIKPCSEEVQVENFKKFFDEENKKNNIHNIIKLAIELGLQEAEAEMYEKLYKDIEKKPSFQRVLLGKMGHLKNVRGEDDNVYIKLWNRYCRIVNMNKYKQYSVKDIKEDGLWFLLYSQEENLNIEFKENYQKDTVLKVINSYLNSETGGVLILGVSDYPREIVGIDHEIKKHQKGEDGFKLSMQNAIIDKFKPNKSLNINYKFHKFCNKTICVIDIKHEKEPIYFSPEEKEFYVRQNGNTSKLNHSNPSETI

SEQ ID NO: 720 - protein, 533 aa, unidentified
  source 1..533: note = Cyanobacteria bacterium SIG27; note = Related to SUTT01000012.1
MKHNLKRKPKDIIEKFKALSSREDVADLLEISDKQLRYYLYSLSDTEKYTKFNIPKKNGGSRDITAPIKNFKLIQKNLAHILYLIHNPRICSYGFEKNYKNKEQETVYKGICPNAKLHINKNNVLNVDLKDFFTSINFGRVRGMFMALPHNFSSDVATVIAQICCTNNALPQGAPTSPIISNMILKSFDSKMLKLVKPLKCTYSRYADDITISTNLKTLPKEIYDYTQNSISTDLNSIIEDNGFEVNKQKIRLQTKIQRQSVTGLIVNKKTNVPRDYIKNIRALLFRWEKDGEENADKYFQEHFKKCKLRRVLLGRISHIGNVRGVEDPIFIKLWNKYHILIGQSDKIKALISEDKEILTLISKGENSELEFKQAYEYSQDEKRCNNKLYYRPQGKKEDIPTMKHKVLKTVCAFLNSNSGGTLLLGVEDNSTIRGLKEDIKNNKNNLDSLALSIDHAIKDNITPSPIGNIKTKFYKIHNKYICKIDIEPYYDPVYLKTHGGIFYVRHDVESVEIKEKDKIDQWIRAHNKLQRN

SEQ ID NO: 721 - protein, 570 aa, unidentified
  source 1..570: note = Related to NZ_QBTW01000011.1; note = Muricauda sp.
MKKNFTDLKTKNDLAEFLDITIKQLDYNAYNEDKKYNKFHVPKKNGSKREIYAPIPSLKTIQKKLSKELTKLYLPKKHVHSYTSKKGIRTNAKIHVNQRFVFNIDLENFFPSINFGRVSGVFKAPPFNFNNEVAYILAQLCCHQNSLPQGSPCSPVISNLICRSLDNDLKRLAKNNKCFYSRYADDITFSTSLRRFPDSLCKIVKHEIQIGEKLNEIICKNRFSINPNKSSLKRPYEHQYVTGLTVNQKVNVKRKFLKQVRAMLHAWETFGLSNAAQEHFNKYSVRHKSKKDDSLFIRIIEGKLLFVADIRGKNDPIFKKLLAKFKVLAPKDTLKNYLSYQGDKILVYTEGNTDWMHLKHALESFNVINNYLQVNSAIKIYEYDETLTIGDKKLMEILRGHLLSDNTRPIIGVFDSDNPQTLGEFNPTRNRKYLNFDNRVFTFYLPQPFHRKTDKNCIEHYYKNHDLCIKDEYGRRIFLSNEFNDQSGEHIEMENVRCDFGQKKLRMTDGIIDSKVYDLEERSLALSKKDFARNILSKHDNFKKVNIDSFRLIFDRIQEIIKDIESIKNE

SEQ ID NO: 722 - protein, 598 aa, unidentified
  source 1..598: note = Cyclobacteriaceae bacterium; note = Related to JABFSO010000101.1
MESNKLSPEELAKKNEELRNSFLATDSIKKLAVFFNLRHSVLTYRVYKVPEDEKYKEFKLKKKNGGIRIILSPNEKLKFLQRKISDVIYLIYRPLIYSHGFEKGKSVKTNAQIHAKQRFILNIDLKDFFSSINFGRVRGMFMSPPFAFSPEIATILAQICCYKNALPQGAPSSPVISNIICLKLDRQLSKFALENKCYYSRYADDITFSTSCKKFPKQISSIKTGKVKLNTKLESIISKNGFEINEEKISFRSEYQQQIVTGVVVNVSPNVKRKYVRQVRAMLNAWGKYGLEEAEREHFEKYSTKNRNILRQRPSLRDIISGKVHYIGYIRKKLTGSDKLYIKLKKDLEKLIKEEDSIPKYQDNGSQLPLIITEGHTDWKHLKNALSHFKGFKKDAIDVEFWEYEQNLKFGDSVLKKFCLKESHKPKSRKYICIFDRDSPEIIKSMNGDNNSSFKYWGNNVYSFCLPTPSNRENYSNISVEMYYTDSEVNTIDTDTGKSLFFTNQIKETIEVNLTNNTTTQKREILKTPLAINEFDKKIFDYKVDLIKNTTGVQVAHSKTVFASRVYNSHKDFSNFDLSEFEKVFTIISEIIKHNSSQ

SEQ ID NO: 723 - protein, 543 aa, unidentified
  source 1..543: note = Related to FR885511.1; note = Azospirillum sp.
MKFTELKANIQLAAKLNMDYSYFTYLIYKRTDDQNYIPYIIPKKSGGYRKIAAPCKTLKYIQRQIANFIYDEIQVKDCVHGFARGKDIKTNANYHLKRKHILNLDLKDFFDSITVNRVYGVFHGHPFNFPEKLSSCLAKIATYYGSLTQGSPLSPIISTLVCRRLDNDLKAFAVKYGLRYSRYADDITFSSIRTMKELFKENPVTNKIILCKELVDIITRNDFQINEDKVRYRNKTQRMEVTGLIINDKPNLVRNYRDQIRAMLHAWKKFGYENAEKEYLSKFSRGHKSFKQVIYGKLNFYKSVRGVTDHYYQQMAKLFNTLSPDMKLLLKPTPEEIIQKAVWVIDNTVNAEKNDSPIERMSQGTCFFLKNIGIVTAAHVLFPNKKNTTDEFDVDFNQSPMSNFYILNPTNPSHRVNVQLVNLDKNRDWAVLSLKNTNDLSINRDYFELESCCKIQTGTEIMLCGYPSFELGHQIRKETGQIVAKKTEHAVKKFEITADIRHGNSGGPILNNKMQVLGWADAADPSIVNEIGELLDNYKSTSV

SEQ ID NO: 724 - protein, 556 aa, unidentified
  source 1..556: note = Related to NZ_LMUJ01000063.1; note = Acidisphaera sp.
MNDPTEQAKLEQAFRGLKTRDGVAALLGVNRRSLAYQVFRHPKPYISFAIKKRSGGMRTISAPNPSLKKIQRSLSKYLCAVYRTRNPVHGFALERSIATNGNVHLDKRYILKIDLNEFFDSIHIGRVIGLFEKVFHFNKDVATLLAQICCRTGSLPQGAPTSPVLSNLICWNLDNELRRVAMTHRCSYTRYADDITFSTNQARFPKDLATIAEIDGVAAVTVGAAIIGVVTANGFTINQSKVRLLTKTQRQEVTGVVVNVKRNVDRRFIRNIRATLFKWEKLGTLHLQKQYEDVYRRSANPSRPPAAIEDVIRGRIEHIAYIRGQRDTLYAGLATRFNKLAEKWLIIPATAFEAFTARLRRAVWVIECDGDKLSPDSEPSDGALMQGTAFYLEGTGWVTCAHCVEWDGIDNSKVKYLFRPDNPSKRYSFKISRSQPTVDVAVISADIPASEYEPLQIAATAPSRNNLVQVVGWPEFRLGDEITVMDSRIISFTMVSGIRRMRVSAPIIGGNSGGPGLNADGQVIGVVVTGSHKGEQTINNALIPISALSYLEDTPD

SEQ ID NO: 725 - protein, 378 aa, unidentified
  source 1..378: note = Related to JACKWW010000005.1; note = Clostridium algidicarnis
MICSPLDTQLIRLAKKYGIVYTRYVDDITLSTFNDSFPEAIVKGEVSNLIIGSELENILKRNSFSVNLDKVFLNNNFTRQEVTGLIVNRFPNVKREYIKNLRAILHNCFKEGIYETALEYICKGYCKNKDIIKNSDNKECVNNWFKYVLKGKINFIREIKGANDYIFLKYAQQLNRLFNEELFNLDFLDEFIYNVVVLETMNPDNIVQGSGFFIKDRGLFTNYHVTENNEFYSVKTYKMENLGAVLKGMNEINSNIDIDYALYDLKSSKISGLELGESKNIKIGDKIVVIGYPEYCDNDSPNIQTCNIISRTNYLGECLYTISGRIVHGSSGGVVLNMNHKVIGIIKAGVVTLNESDTSSKQGFIPIHLALEHLNKGV

SEQ ID NO: 726 - protein, 554 aa, unidentified
  source 1..554: note = Clostridiales bacterium; note = Related to JAAYMO010000138.1
MLRDEFYRLSTREDVAKILEIEEKSLRYFLYAKKPDNMYTTFKIAKKSGGTREISAPAKELKAIQRKLAYILNLVYRVKPSVYGFFHERNIKDNASKHTRRKVILNIDLKDFFSQIHFGRVRGMLMNKPYGIGQEAATVIAQLACYKGILPQGAPSSPVLTNMICSPLDTQLTNLAKKHGLVYTRYADDITFSTFNPVFPKDIIERDLSSIIIGQELDAILKKNSFSVNPKKIFLNNNKVRQEVTGLVVNKFPNIKREYIKSIRAILHNCFKNGVYETAIDYVARGFCKNKDIEENIDNIEYRDIIILWFKSVLKGKINYIKEIRGSDDYTFLQYADQLNRLFGEEIFNVEKHNEFFNKIAYNVVILENRNKLVQGSGFFLKDVGLVTGYHVTEDRGFFMVTTYKGENIGIVSKEMNEIISDKNIDYAIYNLNNSSMEGLELGDSNEIEIGDKVTVVGYPDYIEGDTPYVHTCEVTSKTKYLGECLYTVSARIIHGASGGAVLNKDNKVIGIIKAGVVSYEEKEDVGKHGFVPIHIALKHWMSQQENQKINTEG

SEQ ID NO: 727 - protein, 554 aa, unidentified
  source 1..554: note = Related to NZ_PJSO01000011.1; note = Clostridium perfringens
MINIFSKNDDELKKAFYALKSRNDLANLLEIEEKTLRYFLYGKSDDDKYNTFEIPKKNGQFRKIAAPISPLKTIQRKLTYVLSLVYKVKPCAYGFLKDRNIKSNAKNHSKKKVLLNIDLKDFFSQVHFGRIRGMLISKPYDIGIEAATSIAQLTCYKGVLAQGAPSSPILTNMICSPMDTQLIKLAKKYKLQYTRYADDITFSNYNEQFPQGIIKGEINNLIIGDELNNILTKNGFEVNMNKVFLNDNFTRQEVTGLIVNKFPNVKREYVKSLRAILYNCSRDGVYNTAKEYISKGFCKNKNVLENQDNEELVINWFKMVLKGKIDFIKEIRGSNNNIFLKYAQILNKVFNEDIYDLNILNKLTNNVVILNYEDNKCMIQGSGFFVKDVGLFTSYHVTESGAFFSVKTQYLETIGSVANEFNEISKDKRIDYAIYDIKKSTIEGFEVGNSKDIKVGDKVIIIGYPEYQEKDTPTIQTCNITSMTTYLKAPLCIVSGRIIHGASGGVVLDMNHKAIGIIKAGAASTEKEYKGKQGFIPIHLALEHMKNNKKSISN

SEQ ID NO: 728 - protein, 421 aa, unidentified
  source 1..421: note = Related to DMUT01000367.1; note = Clostridium sp.
MVNIFKKSDEELKKEFYNMISRKDVAKLLDIEDKSLRYFLYSDKNKSMYTTFEIPKKKGNPRRINAPNEELKNIQRKLSYVLNLIYKVKPCAYGFINNKNIKDNAKNHVKKKMILNIDLKDFFTQIHFGRVRGMLMKPPYGIGVQAATVIAQIACYDGVLPQGAPSSPILTNMICSPLDTQLTNLAKKYTLKYTRYADDITFSTYESTLPKSILDYQVNSLTIGNELNHILNKNSFSVNPDKVHLNNNYTRQEVTGLVVNKFPNIKREYIKTLRAILNNCTKIGVYETALEYINKGYCKNKEIATSKEDKEKVCNWFKCVLKGKISYVSQIRGYKDYIFLKYAQKLNRIFNEEIFNLDYVDDFIYNVVVLETSNLDNVSQGSGFFIKDIGLFTNYHVTENGEFYNVKTYKMEILGVVSKEL

SEQ ID NO: 729 - protein, 552 aa, unidentified
  source 1..552: note = Related to JAHLDU010000027.1; note = Clostridium sp.
MFKKTDQQIKDCFYKLKNRSDVSDLLEIEDKSLRYFLYVKRPENLYVTFTVLKKNGNKRIINAPQAELKSIQRKLAYILNLVYKIKPSTHGFVIGKNIVTNANNHCKRKAILNIDLKDFFTQIHFGRVLGMLVKGPYDISKDAAIVISQIACCNAVLPQGAPSSPIITNMICSPLDTRLTRLAKKNNSKYTRYADDITFSTFDKQFSSNMINSDILNLKLGKDLNKAIKDNGFVVNEDKIFLNTKNTRQEVTGLVVNKFTNIKREYLKNIRAILHNCEKDNVYNTAKTYVKKGYCKNGQIKANIDDKNYETQVVLWFKAVIKGKINFIKDIRGKNDFIYLKCAEKANIIFKDQIFNISKLKDFKDKIISNVLVLKGDNNGVQGSGFLLKDFGLVTSFHVTQDNAFYKAYHYNEYEETSLCVISKEINEIKSDLNIDYAIYKFNKDNENFLEAGSSVEVGDKVKIIGYPNFMKGNSYNVQTCYITSRKYYMGAIFFTVGGTVFHGASGGVVLNDQNKVVGIIKGGVVSNTESETNENQGFVPLDIVLTHFHQQ

SEQ ID NO: 730 - protein, 572 aa, unidentified
  source 1..572: note = Related to FPBY01000132.1; note = Clostridium sp.
MFKASDDELIEKFNNLKNRADVAELLEVDEKSLRYILYVKRLENMYKKFNISKKKGGFRTINAPEGSLKTIQKKLSYIFSLIYNKKACAYGFIKGRDIRGNSKQHIKRNFILNIDLENFFDSINFDRVICMFQKPPYNVEKDAATVLSQLVCCDGILPQGAPSSPIITNMICRPLDTQLVRLAKKFSLNYTRYADDITFSCNKSTFPKEMAYYDMQEKLCIGKSLQEVISRNGFKINTNKVFLNYKDRGQEVTGLIVNRFPNLRREYLKEIRAILYNCRRYDIYSQAKKYIKESSYTNKNIMRISMLEDKKSKEIIYNWFKNVIIGKIRFIGNIRGKESPCYIKYALECNKLFDEEIFKIIKSKSQELIENTVFVVKIEKGSKYIQGSGFFIKDLGFVTSMHVTPDIDETYDVFTPKEDIPRKLCLFNNKANNQELDYSIYDLKNPTSNYLKLGDSSNLNIGDRITVCGYPMYDKGDSIYIQNGEITNLKKDYFGSRIYTVSQRLIHGISGGAVLNTNNEVIGIIKAGAENMDEEDESIQGFIPINDVIEDVKSQGIELRPKSILVKSNNYN

SEQ ID NO: 731 - protein, 554 aa, unidentified
  source 1..554: note = Related to JAKNTH010000001.1; note = Enterocloster sp.
MLEEPNMVREKFFNMKSREDVADILGIKEKSLRYFLYSIKPDNMYVEFSISKKNGGERVICAPNDKLKAIQRKLAVILNMVYKTKPAAHGFVLDKNVATNAKGHVKKKYVFNIDLENFFDQIHFGRVRGMLMKPPYNLGEEAALVISQIACYKGKLPQGAPTSPILTNMVCAPLDTQLTKLAKKYNLQYSRYADDITFSTYKADFPVEIAYVDFNGVHVGTVLEELIKKNNFLINYNKVRISDYRQRQIVTGLVVNQFVNLRRDYIKEIRALLYSCKVKGLLESAKLYVEKGKCKNPKIIEAVNSGKSEKEDEIINWFLQVLKGKIEYIKSIRGDNNPTYLKYASELNRVSGKIFFRVDEYLDFIKQIEKSVFIIEINALDDYIQGSGFLLDPDLLLTNHHVTKKEGFYKVTTFKEDQIGIISNDIKFLKRNENIDYACYNGFGREDLIPWELGDSDDIKIGSKIIMIGYPDYNLGNTPDVQTVYVTGERTFMGQKLITVSGRIVHGASGGVVLNEEHKVIGMIRCGVVSYCETDTTNNHGFIPINDIMKDIKS

SEQ ID NO: 732 - protein, 553 aa, unidentified
  source 1..553: note = Related to JAFQLB010000113.1; note = Lachnospiraceae bacterium
MRQDSEQIKEKFLTLETREDVAALLGIQDKSLRYFLYSIKPDNMYSEFIIKKKNGEDRHIYAPDRRLKNIQRKMAQILNCVYKIKPAAHGFVLDKNIVTNAENHIKRKYIFNIDLENFFEQIHFGRVRGMLMKPPYSIGSEAALVIAQIACYKGKLPQGAPTSPILTNMVCSPLDTQLTKLAKKYNLHYTRYADDISFSSYRDELPTGIVYEDLEGIHIGKELREILSQNSFAVNSKKTRVFDYRKRQEVTGLVVNEFVNIRRAYIKKIRAILYHCKQDGIYETAKEYVEKGNCKNSSIIEMIKNETEENKERVAEWFKEVLKGKIGYIKFVRGKNDYVFLKYAKEINELYGEEVFSIETELKLIDKIEKSVFVLEFESEDNYVQGSGFIVRDIGLLTNYHVTDNNEIYTVNTYKGEKKCCVSNEMNLIKNNESIDYACYLYGKTSEDALELGNSDELDIGSEVLVIGYPDYYTGNSPEIQHVNIISQRPFMGQKIFTISGRIVHGASGGVVLNMSYQVVGVIRCGSVTLKETESNSLQGFIPINEIVNDLMA

SEQ ID NO: 733 - protein, 564 aa, unidentified
  source 1..564: note = Related to NZ_JACEGA010000001.1; note = Variimorphobacter saccharofermentans
MINARTDIETEKLFYQMQSREDVADILQIEDKSLRYFLYAIKPDNMYTEFKIPKKNGEYRKISAPNKKLRSIQRKLADILNIAYKVKPASYGFVKNKSIYQNADNHCKRKNVLNIDLKDFFTQIHFGRVRGLFMKPPYNLGEEAAMVIAQIACYRGVLPQGAPTSPIITNMICSPLDTQLTHLAKKNQVVYTRYADDITFSCYKNSFPEALVYLDKGDIHIGKELEFILKKNNFVVNMNKVRLMDNRRRQEVTGLVVNKFTNLKREYIKEVRAILHCCKNKGIYDSAKIYVNKGKCNNHRIKAYIQNEDKVDRKEDVSNWFEQVLKGKIGYIKLIKGNDNPTFLKYAKQLNIISNKKIFNIDEYDKFHNMIDDNIFILQCTSKNVARQGSGFLLKTYGLMTSYHVIPDDNFYSVKKNTGKQVGVITKSSNLYKESYEIDYACYINICNNFDKSQNGFELGDSSNLKAGDKVIIIGYPNYMDGDTPYIHTCYITNKTSYFGQELYTISGRIAKGASGGVVLDLLHEVVGIIKGGVTSLEEDDESNDPEFKHGFIPIHDVIEHMRN

SEQ ID NO: 734 - protein, 326 aa, unidentified
  source 1..326: note = Related to JAAZLI010000107.1; note = Bacteroidales bacterium
MEISALKHVKDKFYTLETRQDVSELLGIEDRSLRYFLFKRRPENLYYKFRIPKGMDGFREINAPKDELKTIQRKLANILNEVYEAKICAYGFIPGKDIIQNARSHVGRNLVLNIDLKDFFIQIHFGRIRGMLMNPPYSLGREAATTIAQIACLNGTLPQGAPTSPVLSNMICAPLDNSLMKLAKKTKCTYTRYADDLTFSTHRKEMDKALVYFDNNNDVVLGAGILSLLRKHSFKVNPDKIAFRTRYDRQEVTGLTVNVFPNVRRSYIKRLRAILHKCKKDGVYGTAKEYAIKRQIKNRVWFVNHADSSQKKELINWFRQVLIGKI

SEQ ID NO: 735 - protein, 560 aa, unidentified
  source 1..560: note = Clostridia bacterium; note = Related to JAFVSK010000006.1
MNRDEVKKAFLELKTREDVAELLGIKERSLRYFLFKRRPERLYTTFTITKRNGKPREISVPCREWKEIQRKLADVLSCVYAPKICAYGFIPGKSIVDNARQHTKRHLVLNIDLKDFFTQIHFGRVRGLLTSPPYGIGEEAATTIAQIACVNGVLPQGAPCSPVLTNMICVPLDNSMMKFAKATDCVYTRYADDISLSTFKRSFDPEVVYLDGEKLCIGSKLQHIFDKHSFQINPEKVAVRRNTERQEVTGLTVNVFPNLRRSYIRNLRAILDHCQRDGVHQTAKTYIEKGFCKNPSILATYKCDEARGSVEDWFISVLKGKIEYIRNVKGAESLTYLSFAQKLNEIVGVEILDISLLNRLETIAEKNTFVLECNQGESFYQGSAFYVPNIGLITSYHVVESGEFFYGYTHMDYPSKPAMVIGLSLNRVADNREIDYAIFSPPLTDLGEYALKIGDSKKLRVGNNVTIIGYPNHQIGNTPFIQNCAITSEKTFMSAPFFTVSGSIVHGASGGLVLNTGFEVVGIIKGGIQSLDDDDVSGNQGFIPIHLVLEDMAEKRKDVK

SEQ ID NO: 736 - protein, 566 aa, unidentified
  source 1..566: note = Oscillospiraceae bacterium; note = Related to JAFUCD010000004.1
MESKEIKTKFFQLKTRTDVADILGIDERSLRFFLFKVRPENMYIRFQIAKRGGGFREICAPNRKLKSIQRKLADILEIVYREKACAYGFVRGKNIVQNARNHTKSELVLNIDLKDFFSQIHFGRVRGMLIKPPYGLGEEAATTIAQIACLDGKLPQGAPCSPVITNMICASLDNQLMRLAKKTGCIYTRYADDITFSTNKKQFDDEIIFLNGGSLELGKGLSNVLTKNSFIVNPDKITLRAKSSRQEVTGLVVNQFPNLRREYVKQLRAIIYNCSKNGVYHTAQQYIEKGFCNNTKIATVVHDPNHREEVENWFRQVIVGKINYIRQIKGAGHATYKSFALRYNRLVGEDFFEVPQDDLLAELMRSVYVLESEERQGSGFAVKGIGLFTSNHVTGDGAKYEVFLPDGQGDVEIKGIISNGDNLIDSDDTIDFALFDVPFANESNLEIGDSDEVKFGSDVIIASFPDYAKGNSVRIEHRTVAGEARLFGSKIIIIDGVIFHGASGGVVVNDKNKVIGIVKAGIQDAVSKDELLSNQRHGFVPINLVMQHIREHQRPASEENHQETMT

SEQ ID NO: 737 - protein, 555 aa, unidentified
  source 1..555: note = Related to FMHA01000009.1; note = Ruminococcus sp.
MFKRSDNEIKELFSIAKTRTDIADMLEIDEKSLRYFLFVLRPENMYRSFFISKKNGGTRQIFAPSKKLRNIQRKLAYILNLMYKPKICAYGFIKNKTILGNALQHTKKAEILNIDLKDFFSQFHFGRVVGLLCSKPYSIGKEAATTIAQIACLNGILPQGAPTSPVLTNMLCVPLDNQLMQYAKKYGLVYTRYADDITFSSYNRCISDNIISKVGDKILLDDSLKKVLDKNSLIVNDEKITFRTKNLRQEVTGVIVNKFPNVKREYYKNIRALLHNCIQNGIYIEALKYIDKGYCKNRNIISFRSDPKKQPLIEEWYKSVLIGKIHFIKQIKGEHSFTFYSLALEANKVFSKNIFDLTYFNQMNEIINKNVFVLQSTDEMKQGSGFYVPGYGLFTSYHVTEDKDFYYLWQNDVKAVISPISADINQVSADKIIDYALYNISIANVASLSMGNSSNLKIGDTVVIAGFPNYIKGDTITKEECKITGKTKLFGAPFYKVSGKIVHGASGGIVLNTNHQVVGIIKGGCSSEDEDNTSIKQGFVPIDLVISDLKAKSVL

SEQ ID NO: 738 - protein, 568 aa, unidentified
  source 1..568: note = Synergistetes bacterium HGW-Synergistetes-1; note = Related to PGXO01000004.1
MDGNLPEKKLFYELKTQKDVAALIGCKERSLRYFLYAGNCIVKYRTFTLKKTDGSQRIISAPIPPLKKIQRKLANILNVVYKPKACVYGFVPKKNFIENAKQHVGCKYILNIDLKNFFNQIHFGRVRGVLMAKPYQLSQEAAGAIAQLACFNGTLPQGAPSSPILTNMVFRSFDNELIKFAANNGIKYTRYADDMTFSSYRNKIPEELATVSGNNVRLGTFLEKLLEKNNFEINPNKIHLFLKNQHQEVTGLTVNAIVNINRRYLGLLRVILYNCDKKNIDNPIYESAKRYIKLGYCKNNNIIELAKNDKNKDKIEKWFKQVLIGKVRFIKQVKGADSFSYYYFATRYNKVFKDTVFDLSLFNYVNMRIQQNVFIVEAGTNQGSGFYLKGYGFITCYHVVEKNKEEKKENEKEIYDSVCIYRCVDRSKQPFKRLRKEEIILKDKFLDYALYRLDENEVESAYKIGNSEKVELGEQVTIIGFPNYLEQDTFSLIKTHITSKSNFMNAPAFLVDSKIFHGTSGGAVLNKDSEIIGLVVAGSQDTAYELKNAFVPIHEIMASLSSKNIHEL

SEQ ID NO: 739 - protein, 549 aa, unidentified
  source 1..549: note = Related to NC_021016.1; note = Anaerostipes hadrus
MEDNVKRKFKQLNSREDVANILEIEDKSLRYFLYCVKPDNMYKNFEINKRNGGTRIISAPNKKLKNIQRKLLQILENVYTPKICAYGFINGKSIYDNASIHLKRRQILNLDLKDYFLQINFGRVRGMLLKKPYELGEEAATVIAQIVCYKGKLPQGAPTSPIIANMICAPMDNHFMKLAKANNMKYTRYADDLTFSTRTEFPTSIVRIENDTVVVGKKILQILKKDGFLLNEEKIYLRSKDKRQEVTGLVVNKKVNVRRDYVRELRAILHNYKNMGAEDAIKLYVKKKKSTNISAVNIDTLSDKKRQETINQFNEILKGKINFIKDIRGEDDLIYIKYANELNRICNKEIFNLDKQKAFMEKLKNSIFILQSRYTCVQGTGFLLKGIGLITNYHVTEDDDFYDVCMCNKNKIAVISNKLNLIKRSKRIDYASYKILDAKEDQFLDCGDSSNLQIGSELKMISYPEYNDEDTPNIQTIEITGSREYMKNKIITISGRVIHGSSGGVILDQKHKVVGVVNCGPVSLEETDDTIIQGFIPINTILKDISMPT

SEQ ID NO: 740 - protein, 360 aa, unidentified
  source 1..360: note = Related to RBMT01000022.1; note = Planctomycetes bacterium
MLFLRQAEASPVIDFGCDPQPATCLFPTSACPVALRHAGCSGREAECRRTSALPLLHSQPQPFLRASDNELRTKFRALRALEDVADLLEIQPRSLRWYLYVDKVRCQYKERSLPKSHGGTRRICVPPIPLRILQDKLLRILTLIYAAKPCVTGFVLGRSVANNANPHVCKQHVLTIDLDNFFPSIHFGRVRGILQSPPYGVAPPAASVLAQLACHDDGHLPQGAPTSPIVANMVCGPLDSAMLQMASNNRLTYTRYADDITLSTNLRTFPSDIVRQDEHDTCEVGVVLRDLLAEHGFTIREGKTRLRSRLRRQTVTGLVVNEVVNVRRSYVRQLRALIHSCSTVGLLPSGYCQELCIECA

SEQ ID NO: 741 - protein, 454 aa, unidentified
  source 1..454: note = Related to JAFGTG010000124.1; note = Sedimentisphaerales bacterium
MEIVLRTNKEELKKKFGRLKSRADVADLLEVSDHFLCKILYGVKERRKYRIFEIQKKSSKTRQISAPPKNIAILQSKLNTILSLVYEPKPCVHGFAEGRNILSNAQHHTKRRHVVNIDLKDFFPSIYLGRVKGALMSKPFCVGRIAAEVISQICCRDDGILPQGGATSPIISNIICRSLDNDLMSFARKNRCKYTRYADDITLSTSSFRLPTAVGKVENGNLILSDTLVLIVEKHKFIINPKKVRYTPPFLRQDVTGLIVNEFPNVRRSYVREVLGALHAWEKHGYRAANKRYMSHFRLRGQAGLDLENVLRGKISFIRMILGDNSPIFRKLARKYNGLASNKIAIIQIEETDPYPLRGGNTRIQMWNRWFNRYKAAIFFIETTNSKGDKSAGTAFYIGNNLFATAGHNLEYGKPIFYFGDSPKAVDTFTEYNKKSTDIGLIRNMGEILGSELD

SEQ ID NO: 742 - protein, 558 aa, unidentified
  source 1..558: note = Related to SJPO01000018.1; note = Posidoniimonas polymericola
MNSRQDVATYLGISDARLCAILYGYCDRRRYTEFQIPKASGGHRKILAPPKRLKWLQSTLLRRLEGQYTPKVCVHGFVKNRSIVTNARVHCGRRLTASFDLEDFFPSIHIGRVKGIFKNPPFSFGEDASEVLAQICCCDDGKLPQGGVMSPYLSNLACRSLDNDLLRLSRQHRLRYSRYADDLTFSSNDRYFPHEVVELDVEQPQPGERLVELITSNDFRLNHSKMVFRTSTRRQEVTGLTVNAFPNVSRKFVRGIEAALSSWRRFGYDAAQAHFLEKYHEGGGSELSSVLRGRIAFLSMVRGKDDFIVRRLSREFNDLGQPSINVKPLTTARPSPRHNSRAEWQTWIRKYSEGVLHLLFTSPEGDPSCGTAFHIGKGTFATARHNVFTECGAVHDDLRLKHDGNEFVANVLAPLDADANTPDVALLSCNALSKLARIPTQVRLPELGEEIVAIGFPSIPQRNVTQVVHSGIVEALPVNYSDRLRFIQVSFQSGGGLSGGSLIDAGGNLLGVVVENVFMQAADAGGITAPSRPYGQAVPVEYLDDLLKSYDRQQRPIR

SEQ ID NO: 743 - protein, 515 aa, unidentified
  source 1..515: note = Related to CP038033.1; note = Nitrosococcus sp.
MRLRVHLAQGARGKAHLSKLQFHLNKPLEEAAAQIVGAQTADDIAEVLEVPKGQLLHILYSYPDEKKYISFDIKKKNGGYRNIKAAKGGLRVLQSKLAPLLASHYRLKNPVHGFVKERNIVSNATQHKRKRYVFNVDLSDFYGTINFGRVRGLFRAKPFEMGEKAASVVAQICIFKNSLPQGAATSPIISNFIASELDRKLSRLARRYKLTYTRYADDITFSSNNRNFPEGIAFYDGNNPITNDCFVGQVLEETVSGCGFSINHEKTRLQIRGVRQDVTGLTVNEFPNVRRSYIRNIRALLHAWRKFGPDGVEVIYRRKYAKNKSRLVDTERHYFKEALYGMLAFLRMVRGEDELYLKLCLQTAELDKAPPELIKRMKEQYKMYDVFISHASEDKIDIVRPIYDACKSLGISAFLDEEEIDWGDSLTEVLNHALGKSKLFLAVLSNNSVGKKWPRKEINAALARQMDGKQKFLPLVVGSPDMDIFGLTNDLLYVNWKNNPDEIAEKLKFILSKYA

SEQ ID NO: 744 - protein, 303 aa, unidentified
  source 1..303: note = Related to JAKITL010000008.1; note = Gammaproteobacteria bacterium
MSKLQYQLVKSLDIAVKQIVKLQTAEDIAQLLEVPKGQLLHILYSYPAEKKYILFDIAKKNGGFRNIKAPKGGLRILQQKLAPILYSHYKRRNQVHGFVKDKSILTNAKIHKRKRYVFNIDLHDFYGSINFGRIRGIFKAKPFQMGDKAATVLAQICTFENSLPQGASTSPILSNFIASSLDQKLSRISRRYKLTYTRYADDITFSSNARDFPEAIAFFDGGNPITGDCYAGRILEETIVSSGFAINHAKTRLQIKGVRQDVTGLTVNEFPNVRRSYIRNIRALIHAWNKYGDSGVEDVYRSQ

SEQ ID NO: 745 - protein, 509 aa, Nitrosomonas sp.
  source 1..509: note = Related to FOSP01000012.1
MPEKLKPELNKNLDESVRAISQLSSVSDVASYFEIPEGQLLYILYKLPDNKKYRFFEIKKRRGGHRLIKAPIGGTAILLKKLKPALHQLYKTKSCVHGFVNGKSIVSNAKQHKKKRYVLNVDLANFYDNINFGRIRGLFMSKPFNMAPNAATLMAQLCTHDNSLPQGSPVSPVLSNFIASNLDKRLTLLAKKYGLQYSRYADDITFSTSKKDFPKSFGYYEGNNPITGNMVIGKLLEDQILASGFVINYDKVRLQYHGVRQEVTGLTVNEFPNVERSFVRKIRAMIHAWKKFGLIEAEKTYISCYAKPTLDISSDNLNGAYYKSVVYGRLAFLKMVRDEEDEVYMKLCLKVAEIDSNAPRKILETKEMFNKFDIFISHASEDKDDVALPIYEACKKIGVNAFLDVKYIRWGDSLTEKINHALGQSKFVLAILSENSVGKTWPSKEINAALAREIEGKQKILPLIVGSPDLSSVSLLVDKLHFPWEKDASKVAHRIKELTYEKYQISNCK

SEQ ID NO: 746 - protein, 504 aa, unidentified
  source 1..504: note = Candidatus Scalindua sp.; note = Related to JABIUT010001148.1
MLNVKLKSTIGNTVKIFLSSQNTEDVANVLEIPTRQLLYLIYTLTDEERYSTFFLPKKRGGQREISAPRKGISILQKKLLTIIDSIWHPKPWVQGFTNSRSILTNARHHKKKSYVLNIDLKDFYGSINFGRVRGLFMSYPFKLGHKAATIIAQLVTFNNLLPQGASTSPIISNMIAFKLDNMLVKIARRYHLTYTRYADDITFSTTKSNFPKEIAEIEGTNPSTGNIKLGHILEKAIKESGFSVNYKKVRLQIPFVRQEVTGLTVNEFPNVERRFIRNVRAMVYAWRKHGLIEAEREYINKYASRKLEIPSGKLKGSYYKNVLYGKLAYIKMIRGEDDQIFIKYCLQLAELDSDPPKQIQKAKEMHEQYDVFLCHASEDKEDIAKPIFEDLSNAGIIVFLDDKYIKWGDSFVEKINHALGKAKYVIAILSSNSVTKAWPVKEINASIAREIVGKQKFLPLMVGDGKEIQSFQDEMPLISDKKYLIWKNDTSEIVDKIKSLMSSK

SEQ ID NO: 747 - protein, 528 aa, unidentified
  source 1..528: note = Related to CP066225.1; note = Planctomycetes bacterium
MRYPKIAKPTTELVRPTEDSVKLFKAAHTFGDVAELLEVHPGHLKRWLYKYPGHSGYKDFEIPKKNGKPRQISAPPKNISILQQKFKTILDAVYQPKDCVFGFVNKRSVVGGANIHKKQSRWVLNIDLEDFYTSIHFGRVRGLFMSFGAGENASTTLAHLVTKDGVLPQGACTSPVISNMIAFKLDRKLINIANKYNLKYSRYADDITFSYRYCTFPKHIAILDKYSGDDQEQHKEGQYKSGLEPENITLGPLLVHAITKSGFTINTNKNRLFSKRQRQEVTGLTVNEFTNVNRKFIRQIRAMIHAIRKFGPELAGIEYIEKYRAPYKNCEVNNHAEYFLNVLYGKLSFLRMVRGKTDVCYLDFCLSMSKIDPEPPTFIKEAVKMRQKFDLFIIHASEDKNEIATPLHEHLTKIGLNVFIDEKYIKIGDSFIEKINHALGQSKHIIAILSSHSVEKSWPKHELQAVLARHIASDGNGKIIPIMAGNKYEIQTILDKWPLLSDKRYHKWEGDPDAAAQEIADSIGTVIS

SEQ ID NO: 748 - protein, 533 aa, unidentified
  source 1..533: note = Related to JAFLKZ010000048.1; note = Campylobacteraceae bacterium
MKGQKINIKLKKPFKESMTLFENLQTQEDVANFFEVEHRYLMYLAYKDKRPHYKELVIPKKTGGTRKISKPVKSIDILQKKLLPFLQEKYKIKKPVHGFVKGKSILTNSQQHLKKKFILNIDLKDFYDSIHFGRIKGLFMSETFKMGENAATLVAHLCCNNTKIPQGACTSPILSNFIVSQLDKKLMEFAKTSHCTYTRYADDITLSSSKNISNTVIKDENSSFPINGFELSSELEKLIHFCNFTINYKKVRLESKYIRQEVTGITVNDFPNVKRTFIRQIRAMLHSWEKDGLDIASQKHLSFKKREYSISSPEKFFKNVIIGKLAYLKMIRGEEDIILRKLCLKFTALVSNDEVLPKFIRNIKMKYEEFQVFICHASEDKEKIARPLYDELVKLGIKSFLDEKYIEWGDSLTEKINHALGQSRYVIAILSDNSIEKKWPKKEINSTLSREISGDKVLLPILAGDERKIFKVFPLLHDKLYKLWNNDAKFMANEIKNLLSSTEDYEINHEVNTSESSILEKIKDFLTKIKILK

SEQ ID NO: 749 - protein, 503 aa, unidentified
  source 1..503: note = Related to MIBX01000109.1; note = Sulfurimonas sp.
MTKKLHIKLQKTFEESLELFNNLTTASDVASFLEIPLQTLIYILYKDTKLHYKEFKIKKKSGKDRIINKPIGSISILQKKLLPFLQFKYKIKKPVHGFVNKKSVLSNAEQHLKKKFILNIDLKDFFSSINFGRVRGLFISYPFNMGNDAATLIAQICCHKNGLPQGTCTSPILSNFIASRLDVELIKYANATHTTYTRYADDITFSSTKKLSSKMIIYDMDSNPVINGFILSDSLKELIKFMGFDINYDKVRLETKNIRQEVTGITVNDFPNVKRNFIKQIRAILHSWENLGLEEAEKKHLETKKLKMDISSIKNDGKYLKNVVIGKLAYLKMIRGENDIVFIKLALKLASLSSDNLPKFIKEIKLKSEEFDVFICHASEDKEKVARPLYRELTELGINAFLDEEYIEWGDSLTAKINHALGRSKYVIAILSNSSINKEWPLKEINSTLAREISGDKKLLSILVGDEQEIFKVLPLLADKLYKPWNNNAKTLAIEIKTMLIPK

SEQ ID NO: 750 - protein, 511 aa, unidentified
  source 1..511: note = Opitutales bacterium; note = Related to JAGBOM010000008.1
MLITHSKLLPKIKKDITEQESLFSKLQTTKDVADLLEVPYKQLLYILYKQDDSKKYETFSIPKKMGGMRIISKPKGSISILQSKLLPLITSKYTAKSCVHGFVKGKSILTNAGAHKITQHTKILNIDIKDFYDSINFGRVRGLMMSHPFNMGNKAATVVAQILCWKNKLPQGACTSPVISNMILHRLDSKLTKLCEDLKSVYYTRYADDITISSNCPVFPETIATWDPKTKEVRLNQDFENIFKSENFNINYSKVRLKSNKERQEITGLTVNEFPNVRRVFIRQIKAMIHAWNKFGLEAAAKEYIEKYDRKKFNAENSNVVDYFKNVVYGKLAYLYMVRGKEGADRICQRFAERILNIDDEVPNFIKNMKESKYDIFLSHASEDKCIAERIYKECTSNNINAFFDKECIKVGDSIPERINDALRTSKIFVIIASYMYSEKKWTCEELWSAVNKTIETGEIRIYPIVIGDINEFKRNYPLLGHRKAMRWENNESEIVKDLENFLRVQENEVK

SEQ ID NO: 751 - protein, 591 aa, unidentified
  source 1..591: note = Related to NZ_CP014504.1; note = Pedobacter cryoconitis
MKKKEELAPEYLERFLQLNSIKELSTFLNLRISALEYFLFYAPDEKKYRIFKIQKRNGNLRSISTPTERLKEIQQILQIIFQYLYAGKPSVHGFVQNKSIITNAKLHINKKILVNIDLSDFFSSISFGRIKGIFLNHPFNFNEEVSNALTRICCHDGSLPQGAPTSPILSNFVCRQLDNQFMKLSKTSKVLYSRYADDITISTNLKSLPQSIGIIETDKLELSNEIKKILHKNGFKINYNKVRFALKTNRQEVTGLIVNKFINIKRDYLRQVKSMLNAWEKYGLYLAAFEHFSKFNPKTYMPGDIELAYTKELAGKINYIGIVRGRDDGIYEKLYTRIKVLAPSVMLSIIRRQIQSSKDPILFTEGKSDIKHIEAAFSHFRSQGLYHNLSLHFHHYKEEDKMSNGELLKFCETFSKSHETGSIVICLFDRDDENFLANVASTKNTFKEWGNKVFSMVLPIPDHRKFTDICIEHFYTDKEITTKDKNGRRIYLSNEFNKETGQHAKEKLTIKHVNKLQARRVQIIDSGVINTENINFALSKNQFAENIFNKVDGFDSFNFEAFKLIFDNIQTVIDYANDEAKKSNKIEMSIL

SEQ ID NO: 752 - protein, 576 aa, unidentified
  source 1..576: note = Cyclobacteriaceae bacterium; note = Related to JABFRS010000002.1
MTPEEIKELTDRFLAIKTPRQLAKVLDVEFKILTYYLYKVPELKKYNEFDIRKRNGNARRIIAPIGGIKRIQRSLNFILQTLYPTKKAVHGFTLGKSIKTNALAHVKKNLIINIDIKDFFPSIHFGRVMGLMMARPFNFNEPLARVIAQICCHKASLPQGAPTSPIISNFICRKIDNAFLRLTSYNRCTYSRYADDITISTNQKKWPTEIARIENGKVLLSNIIQGIFHSNGFLINEDKTRHATRVNRQEVTGLVVNESININRKYYQHVRAMIHAVEKYGITLAANEHFLKYNIKSKEPDNIELSFQNELVGKLGFIGFIKGKENSTYKKLAARINTAEPGIRLKIVQNEIDEAANPIIFGEGKTDWRHLSKALTKLKKEGMFKSLFLRFNRYENLEINNEQLLDICKSLPKGEPSKKIVICLFDRDTKKINNAVVENGKDFKSWGNNVFSLLMPIPVHRKFDEICIEHYYLDTELKRTDHDGRRIFTSDEFDKVTGIHKQENLQYPYIGYLQPNFPRIIDSHVRNDIGQNVALSKNNFSNNILNDVPLFDDFTFSHFKIIFDRIEEIITSHPVG

SEQ ID NO: 753 - protein, 579 aa, unidentified
  source 1..579: note = Related to NZ_SAYM01000002.1; note = Apibacter sp.
MEEDFDKDILNSFLEVETDRQLASVLDIPYKNLIYNIYKLPDEKKYEIFEISKRNKSKRQICAPISGIKNIQKKLSIILNNLHSPKYCAHGYVKDKSIKTNAQIHVKKRILINIDLKDFFTSINFGRIRGLFKSYPFNFNDKVATILAQVCCYNGCLPQGAPSSPILSNYICRRLDNQILDLSQKCKVDYTRYADDLTFSTNLKELPKEIGVIRDNELFLSNELISIIESNGFVINRQKIRFALKNNRQEVTGLIVNNRININRKFVRHVRAMLHAWEKYGLENAAIEHFEKYNYKNKKVENYIFSFLKEISGKIGYIGYIKGKNNSVYRNLFRRIKELNPEIKLPVPKDIIESNTAIVFCEGKTDAIHIETALKYLKSKGDFIDLNIGFHPYEGKEISNSTLYDICKNWSITKKSDRVDIFLFDGDDRRYNRKNICQYPNFYKHWGDKVYSVMLPIPPHRDFEEICIEHYYTDDEIKTKGNKERRLYLSTEFDPNTCFHKEENVNFANRKTIRSSYPKIIDGNDRVLNEFGVNVALTKMAFAENIANKTGEFKKISLENFKVLFDVLLKILEDSKDEN

SEQ ID NO: 754 - protein, 570 aa, unidentified
  source 1..570: note = Related to NZ_BDCR01000003.1; note = Paludibacter jiangxiensis
MEELSKDNFLASTNKRELAASLGIKYSTLAYLLYHLTDERRYSEFEIKKKNGKSRMIAAPTVGIKHVQSNLAYILLDIYPSKKNVHAYLKKRNIKSNASHHLHKKLLINIDLKDFFPSINFGRVRGLFMSHPFKFNEEVATILAKICCYKNTLPQGAPTSPILSNFICRKLDNQLVDLAQKGRFSYTRYADDITFSTNLSPLSQVLGTISDNKIVLSEELTSIITSNGFTVNQDKTRYATNANHQEVTGLVVNEFPNVKRQYVRHIRAMLHAWEQYGLTLAAQEHFSKYNTKHKIISNPEISYKNEIAGKIGFVGSIKGKDDDIYRKMCIRLRELDPDIKLAVAFSNFHNENKPVIYGEGKTDWKHLKAALRYFQHKGEFLDLNIHITEYSEQVKINNAELLAMCKSKALDANKHKLIFLFDRDNHQINSEASLNESNYKYWGNNVYSVLLPKPDHRDFNEICIEFLYEDEIIQRKDNNGYRLFINNEFSKDTGRHLINEKLQLSNLGIIRCPYPRIIEHDVMDIETGKNKALPKNNFATYILEQQPPFDNVSFEHFRGIFELLTTIATE

SEQ ID NO: 755 - protein, 577 aa, unidentified
  source 1..577: note = Related to NFLR01000001.1; note = Alistipes sp.
MQTEMPDIQSTFQAVTTKRELAERLGSSLKMLAYYLYKLPPEQQYKKYDIPKRAGGTREIYAPISGIKQIQKRLSHILQNYQPAKFCVHGYVKERSIKTNAYIHRRKRIVINLDLKDFFPSINFGRVRGLFKSAPFGFNDEVATTLAQICCHDGKLPQGAPTSPVISNYICRRLDNELIAFARKHKINYSRYADDITFSTNLQFLPTAVGHIKEHKIVLSNTLQKIFQDNGFTINEEKTRYALRTNRQEVTGLIVNAGINVPRKYIMRIRAMLHAWEKYGLEAAAKEHFEKFNYKHKHPDYPEIAFKNELTGMLNYVGQMKGIGNRVYIALYYRIKRLDSNIKLSIPEYIPAPEGTTVVFCEGKTDPLHLETALSWFHQQGEFSDLDLHFFKWRSDLDINNDTLLQMCQTRPQAKRDNRIEIYLFDRDVPRYIQKAAEKDKSYKHWEANVYSALLPVPEHRDFNEICIEHFYPDEDLLKEDKDGRRLYTTREFDPESGCHLKLKEVYYAGTRAQLRCKYPKILDSNVRKTGSDENIALSKNNFAKNIFHKTGSFKEVSFSYFKVIFELFEEIMAQAK

SEQ ID NO: 756 - protein, 575 aa, unidentified
  source 1..575: note = Related to JAFXLG010000026.1; note = Alistipes sp.
MDGFDSNMIEFCEIDSRRDLAAYLGCQYKDLIYNLFVLPDDKRYKKIQIPKRNGDTRDILAPSSGIKRAQRMLATILSDLYKRKSCVHGYVKKHSILTNASVHKNKRIVINIDLKDFFPSINFGRVRGLFLNPPFSCCEEVATFMAQICCFDGVLPQGAPTSPIISNYICRSLDNELLKFARKYRLDYTRYADDITFSTNLREIPSRLGVIQENKLVLSEYFTSIIEENGFKINPSKVRYSYHTGHQEVTGLVVNKIVNVHRKYVKRIRAMIHAWEKYGLTATANEHFEKYNYKHRLPESPDYAFKLELQGMMGFLAAVKGKNNQVYARLYERLILLDKHTILQPPLRITAPRDSVVIYGEGKTDVVHLAAAYRHFQQQGEFLGLKLHFHRWGNHDVNNEFVYNMCRTRSESKENDNLEIYIFDRDVARYVKDTTENGKGFKRWSDRVYSAVLPIPPHRDFNDICIEHFYSDQDLARRDKSGRRIYTSFDFNPQSGNLKDSNDIYYPYRQELKRTYPKIIDDKVMRISSGENIALSKNNFALYISRGIGEFADVDFENFRPIFKLIEEIVHNSMR

SEQ ID NO: 757 - protein, 570 aa, unidentified
  source 1..570: note = Related to JAFXAT010000041.1; note = Bacteroidaceae bacterium
MKNKEYRDFLLLGTREDVAKFLGGSLKNLSFLLYILPKEKQYHDFSIPKKNGGKRQISSPISSIKRYQRELADILSEYYHVKSTVHGYVKGKNIKTNAIMHCNKKWIVNIDLKDFFSSIHFGRVLGVFKSKPFEFNDKVATLLAQICCFDGKLPQGAPTSPIISNYVCRNLDNNLINYAKKNKLTYSRYADDITFSTNMSSLPENLGKISEDHELRLSDELLGIITNNNFAVNSTKVHYANRNNRQEVTGLIVNKKVNIKRTYIRRIRAMLHAWQKFGLSNAAIEHFNKYSIKTQIPDFPDLAFKKRITGQIGFIGHIKGSNDNIYRNLYKRIKELDPMTKLTLPNIISSPESCNAIILCEGKTDSIHLETALKYFIERGEFVNLKIHFYKYPDEAKINNSYLYKLCEARDLILHDVRIVCLFDCDDAKYVKHCCEGKKLYKNWGNNLYSCLLPQPMHRDFKEICIEHFYTDDILLKTNNKGRRIYLSNEFVYETGFHKTENIQIRKRDDAKSPYPKIIDSGVFKSNGENIAMSKNDFANSIAAGEKPFDNISFETFRPIFDLISDIVNE

SEQ ID NO: 758 - protein, 574 aa, unidentified
  source 1..574: note = Related to JAFVOO010000133.1; note = Alistipes sp.
MEENKNYEDFLQVTTRSDVATYLGGSLKNLSYNFYVLPKEKQYTKFAIQKKGGGERHICAPASSIKLYQRRLATILSPYYSTKPTVHGYALNKSIKTNAKVHCRRRWIVNIDLKDFFQSMHFGRVRGVFLSNPFAFNDQVATTLTQICCFEGVLPQGAPTSPIISNFICRRLDNELLEFAKRHKLSYSRYADDITFSTNLAAIPAELGTIREDNILTLSKELRDIIENNQFIVNESKIRFAGRNNRQEVTGLIVNEKINVKRTYIRRIRSMLHAWEKFGIANAAKEYFEKYATNNKMPDYPDVVFKRILVGRIAFIKQIKGIDDKVYRNLFGKIKALDPTIRLTLPTLITSPDTCRAVVLCEGKTDGIHLHAALQYFIERGEFVDLNVYFYKYPTEADLSNSYLYKYCESSNLRQQKKRTICLFDCDDSRFVAKCQEEGKLYKYWGNNLYSCILPKPAHRGFDEICIEHFYTDEVLCRESNKHRRIYLSNEFDPITGKHRTEDLIMRKRTDAKSSYPKIIDSGVFKPNGENVALSKNDFANLIATRNAPFHDISFEEFRPIFELLSRIVNAASE

SEQ ID NO: 759 - protein, 586 aa, unidentified
  source 1..586: note = Related to JADILV010000021.1; note = Bacteroidetes bacterium
MDTGNGNILNGFTDLKSKAEVAEYLGGSLKNLSYVFYVLPKEKQYKTFSITKRNGKKRTINAPVSSIRLYQKRLAEILSGFYKRKPCVHGYAKGCSIKSNAKIHCRKKWVVNIDLKDFFPSIHFGRVRGMFLSQPFEFNGTVATTLAQICCFEGALPQGAATSPIISNFICRRLDNDLISFAKKHRLTYSRYADDITFSTNLPALPESVGTIASDGSLELSDDLRRLIEKNSFNINESKIRYSDRHNRQEVTGLTVNEKTNVRRTYVRRVRAMLHAWQQYGLKDAAREHFEKYSDKVMPEYPELTFSRIATGRIRFIRQIKGPDDHVYRNMFRQIKALDASIKLDLPAFFNTPDGCNAVVLCEGKTDGLHLQAALRYFIGKGEFTGLKIYFHRYPDKMDINNSILYKCCETSVTRQSNILRICLFDRDDRTFMKKCREGDSLYKDWGNRLYSCVLPQPEHRDFSEVCIEHFYSDEVLRTKSPKGRRIYLSNEFDPGTGKHLSEDLTCRKRTDASCCYPKIIDSGVFKPNGDNVALSKNDFANLIFNREGDFADISFEHFRPVFELLSEIIEKDGALKEKLRASSSA

SEQ ID NO: 760 - protein, 570 aa, unidentified
  source 1..570: note = Bacteroidales bacterium; note = Related to SUYX01000009.1
MTGGCFYMSIENRDILFYNAATKEMLAAALGTRLNRLVYYLYVVPDSERYTKKCILKKSGKVRNVAAPRSGLKFIQRNLASILNTSVPQKSCVHGFVPKKSIISNASVHLKRNFVINLDLKDFFPSINFGRVLGLFKSAPFNFNDEVAVTLAQICCFEGSLPQGAPSSPIISNLICRSLDNDLMRLAKSLKLSYSRYADDITFSTNLKELPKGLGEEVEGKFIPSEALVDIIGRNGFELNFNKLRCRRKCQRQEITGIVSNEKLNVPRNYVRRVRAMIHAWEVYGLEKAAYEHFGKYSRRRFLYPEASFRKRVAGMVGYIGMIKGVDSPVYLKLYEKLKSLDDSIKLKIPEYSGSADMVVYCEGPTDPMHLKAALYHFRSKGMFNSLKVDFHMYRDDMTVGHGELYNYMVRKHLMKKDNVIEVYLFDNDLKQYVQKLDGKPFITVGHPKIYMALLPKPEHRDFFEVCIEHFYKDEDLCRKDANGRRLYFAREFDKDTGAHVTEDVRSVKLHPLKQPGYTIIDNRILDKDDRSVALSKKDFALAIMHRKKSHSDVDFSAFKAIFEMLQMLV

SEQ ID NO: 761 - protein, 570 aa, unidentified
  source 1..570: note = Related to JAFTHV010000023.1; note = Bacteroidales bacterium
MGAFFMDYDERYMRFYEADTRELLAVALGTKPNRLSYYLYVLPESERYKKKSILKKSGKVRNVAAPTGGLKFIQRNLADILTGSLAQKSCVHGFAPDRSIVTNAKVHLRRNLVINLDLKDFFPSINFGRVYGLFKSHPFNFNELVAATLAQICCFEGSLPQGSPCSPVISNLICRSLDNQLMHLAKSLKMSYSRYADDITFSTNLKEIPEEIGSIVDGRFVPSEKLTGIIERNGFSLNVNKTRCRNRNQRQEVTGIVTNQIPNVPRNYVRRIRAMLHAWEAYGLQKAAEEHFSRYSRKHCVYPEASFKKRLAGMIGYVGMVKGRDSSVYISLFEKLKAIDETIRLRLPEYSGDAKMVVYCEGITDPMHLKAALRHFRSKGLFGGLKIDFHMYRDDVPVGHGELYKIMEGRHLVKKDDVIEVYLFDNDQKDYVTKLNGKAFMTYRHPKVFMALLPQPAHRDFYEVCIEHFYSDSDLMRKDAKGRRIYFVHEFDKSTGFHKTESVRCLKLSPLKQKEYTPIVDGILNEKDQSVALSKKDFALAVLNGKQSHADVDLDAFKSIFEMFENIYIS

SEQ ID NO: 762 - protein, 561 aa, unidentified
  source 1..561: note = Related to JAGAPQ010000482.1; note = Bacteroidales bacterium
MELSKAESREDVLLALCSSWKNLAYYIYRLGDRRYEKMEIVKKSGKLRNIASPVRGLKYIQRNLSAALSYGYRQKGCVHGFVPQRSILTNASVHVNRRYVINLDLKDFFPSIHFGRVVGMFVGPPFGFNHEVAVTLAQICCFERVLPQGAPSSPVISNIVCRKLDNELLGLAKECRLNYSRYADDITFSTNLCEIPERLGRVEGERFIISDGLRRIIADNGFELNDEKVRWSSEYYRQDVTGLVVNEKVNVPRTYIRRIRSMLHAWQKFGLQAAAKEHYSRFSFKKTNNCEESYRRRVTGMIGYVGMVKGRDSKVYLSLVSKLYDLDKGMSLAVPDLKDKTGMVVYCEGKTDPIHLKAALSAFRKRGLYHELDVCFHMYKPDKSISNSTLYEIYAKRDVVKEGNQIEVYLLDSDDKRYTDKVKADGKCYTKGGQNIYLAVLPKPEHRNFDTVCIEHFYTDDDLRRCDKNNRRIYLSGEFDKNTGLHLVESGLRTTKLSPLAKSDYAIISEGVLDCHDVNHALSKNEFARAVSCRAASHKDVEFSHFSVIFDMLMDIQKDAL

SEQ ID NO: 763 - protein, 566 aa, unidentified
  source 1..566: note = Related to NZ_SNWM01000001.1; note = Pedobacter duraquae
MNLLNIKSKEDLLDYIGIEEAQLNHLLYRLPNAYKYHTFEVKKKNGSSRIINSPNPELKVIQTKLKDDLVEFFGKKNCVHGFVKDKNILSNASSHLKKQILINIDLKDFFSTIHFGRVRGMFLSSPFSFPERIATLLAQICCFNGLLPQGAPTSPIISNFICRKLDNSFIQFSKKNSFFYTRYADDITFSSNIRSLSSELGIFNKDQFEISKSILNQIHNNGFTINESKVRMASRFNNQTVTGIKVNVKPNVSRFYIKQIRAILHACEKHGVEKTAIVHFQKNEIDLNRLKSPIDFFIKRLVGKISFIGFVRGKDDFLFKKLYDRVKVIVPNARLSIIYKKIDESKNTLILTEGKTDWKHIKAALIKLQAQGAYNNLNLTFADYLDEHKVSNSELFKICESIPKLGMQKNKTICIFDRDDKNFIPKVTSINDFYKDWTNNVYSMVLPVPKHRNFENICIEHYYTDDDLFTYDHNNRRIFVSSEFENNGNHKLEKYRYKGNLEKLKNRFPTIFDSQVVDSSGASIALSKNDFADYVYNNNPRYNSFDVEAFKEIFNHIYVIENTTPK

SEQ ID NO: 764 - protein, 539 aa, unidentified
  source 1..539: note = Related to FR898423.1; note = Acidiphilium sp.
MRSQEFLKIKTEADLANFLNISEGTLKYYSNPITPSKAYTTTILKKKNGEDRIVCAPVRILKYIQRQISDVLYELYKPSRCVTGYVRKKSICDNARPHTSKRMIICLDLKDFFTSIHFGRVRGMFLNQPFNFNTTISTVLANLTCRNGCLPQGAPSSPIISNYICRRFDGDFMKLCAKYKLVYTRYCDDITISTKAYSFPHSIIYFSTTWSLGDDIRELIQKHNFILNESKFRVVTNKTRQMVTGLVTNQKVNIPKNKYRKLRAELYYTLKNGLDEAAKHDGYIHNKIVDKNAFLNHLRGGVNFFKSVLAVDNPRYKWLANEFNKIVGENYFFVPSSWDELKNKAIFVLMNNKETSQGTAFYVTDIGLITCLHTVCAISGRPSKSDVETALNDYYAFLPNTEYNHIKLSYCWHSNDLDLLVLKFVDYTIRIGYEIEKNIVLSDGINHLKALGYPEYGLGCSCCFIQDMSITSNRVLCGLKLYVVDKTFYTGASGGPVFNSANKVVGYIDRGNEIGSDEERYNAFCSIAPLLDEFNKGTL

SEQ ID NO: 765 - protein, 554 aa, unidentified
  source 1..554: note = Bacilli bacterium; note = Related to JAFSEX010000061.1
MYNEFGRIQHFKNIETKDDLLYVLNISSRKYNYLVYQKKNLYTSFYINKKQGGFRKILSPCYDLKKIQKELNIIMSNNYEFNNETVHGFVKEHSIKTNATVHKDANYIVNIDLKNFFDNIHFGRVRGMFMKPPFNFSDYIATNLAKLTCYEKKLPQGAPTSPTISNIICYRMDRELSYLCNKYNCRYTRYADDITISTKMLYLPKEIAKFRDGQVILSSNITDTIKNEGFTINIDKLKISPNTDRQEVTGLIVNKKVNVQKVYIKKLRALLNNVSKYGFYLEGCKYFEKTLNDCSNKDYVEHRFINVLKGKIEFLKMIRGIDDYVYIKYASLFNELIGYEYFDTDYGLTMKEFIEKRVYPLISYDEMVQGTCFMADEIGMITSTHVLISPQSFITENKYKEIELKDKFNFCTVGSKPFYILDHYNRKYIINPEITREQINSDILFYKCIPSKKRFKINMTYEPKIGETVYLAGYGEFKDFKTSTINYIKSNVTGYTEFLGRKVACINSKIYHGMSGGPVLNSNREVIGIIYAGLNLEDDDNGVISKTNGFVLFQ

SEQ ID NO: 766 - protein, 516 aa, unidentified
  source 1..516: note = Related to JABFRH010000087.1; note = Proposed Sideroxydans sp.
MNFIDIKSTQDLADYFELDYNILARITYGPSRSNLYKVFEIPKKSGGSRIIHSPEKTLRVIQRKLADELKQHYRRHDAAFGFVDKYSITDNASKHINQDWILNLDLADFFPSIHFGRIRGLFQKTPFAFPDKVAQWIAQLATFNGTLPQGAPSSPILTNMICLRLDKDLKKLARRHDLSYTRYADDITLSSKKYFPKEIAKMEKSDNESLATLGADVVSIIEKNGFKVNPSKTRLVSKSGRQEVTGIVVNEKSNLPRHYINTIRGEIGQLRYLDGEAKDALQLRVLGRLGHLKKVVGEYDPRYIKLKAKLHGIKLSCSPNETMYRAVNWIVENDDGVYGTAFHVDHLGWITACHVITKPAAILNFKLFHPDDSQNKYAIQLKSNFFDADIDYVIFNAPIKPIISARIAPKQIENGEACVLSGYPNHNHKNNSVSIIEAKITSTQTIFKAPRFVIDANIFHGMSGGSVFNKENQLVGLVTHGNEDGGTTVLQSAFTSIHLVMNDITNKSPQRIIRTE

SEQ ID NO: 767 - protein, 577 aa, unidentified
  source 1..577: note = Related to NZ_BEWN01000005.1; note = Gluconobacter frateurii
MSHLAKLKSATSRKELALILGYKPKSMTAIVYKTPTADKYATFDIDKKSGGKRTIKAPAPKLKNLQSHLSHVLYQCLAEIDRARDAKPISFGFRQDRSITENASRHKRRRWVLNLDLEDFFPSFNFGRVRGFFLKDKAFDLHPEVATTIAQIACDGTALPQGSPCSPVISELIAQILDMRLVRLAKKHGVTYTRYADDITFSTSQKDFPAGLAQVDESDPSVWHLSDELTRKIVTSGFAINNAKTRMNFRGSRQIVTGLVVNEKVNIRSDYYRRARAMCDTLFQTGQYYKAVIKPDDADEEPKPEVTSNLNPLQGILGHIYAVTQSAERREVSEQRQNPRAIRKLFRRFLFYKYCIVLNEPLIVTEGKTDPVYLREAVKSRVKFQPMLGAHGKDGFKHAVRYFNYGGLAHEVMDLGGGTGDLKSIPLDYLRNLKPSKGTHKPFAYKPMKYPVIIVLDNDDGLAAVASTVKKNFGTEIDKKSTQDFYNVIDNLYIVKTPEDGSKNTCIEDMFPKEWREYKINGKKLNTASKIDPSKDLSKEAFAKSVVKANADKIDFSGFDPLLERICKAVQHYAAKS

SEQ ID NO: 768 - protein, 365 aa, unidentified
  source 1..365: note = Related to SAQI01000010.1; note = Mesorhizobium sp.
MTAIVYKTPLALKYTTFEIDKKSGGKRTIKAPAPKLKKLQAHLSHVLYQCLAEIERGSDAKPISFGFRRDRSISENALRHKRRRWVLNLDLEDFFPSFNFGRVRGFFLKDKAFGLHPEVATTIAQIACDGAALPQGSPCSPVISELIAQILDMRLVRLAKKYGVTYTRYADDITFSTSQKDFPTGLGSVDPNDPAVWHLSEELVGKIVTSGFAINDAKTRMHFRSSRQTVTGLVVNEKVNIRSDYYRRARAMCDTLFQTGQYYKVVIQPDEDEEPKPDVTSNLSPLQGPLIPFAQGHTISREETCGIVCCLLMLLKDVAVWCRTIATQKIRFGAVCRPIPRECNPRSTGKCDAFCTATNTGLVRS

SEQ ID NO: 769 - protein, 322 aa, unidentified
  source 1..322: note = Related to CP060244.1; note = Entomobacter blattae
MSYLHKLKSATSRKGLAEILGYRPKALTSIVYMTPLDQKYTIFEIDKNSGGKRTIKAPVPKLKKLQSHLSHVLNGCLAEIERERSAKPISFGFRKGRSIAENARRHKRKHWVLNLDLEDFFPSFNFGRVRGFFLKDKAFGLHPEVATTIAQIACDGAALPQGSPCSPVISELIAQILDMHLVRLAKKYSVTYTRYADDITFSTSQREFPTGLATVDTNDPPVWHLSDELVDKIVTSGFTVNAAKTRMHFQDSRQMVTGLVVNEKVNIRSDYYRRARAMCDVLFQTGQYYKVMTQPDDDNEGPKPDLTSNLNPLQASLAIFTQ

SEQ ID NO: 770 - protein, 579 aa, unidentified
  source 1..579: note = Related to JAGHQS010000002.1; note = Qipengyuania flava
MNVTHLKKLRAASSRKELAVILGYKPKTLTAIIYQTPPALKYTTFEIDKKSGGKRTIKAPEPRLKKLQTHLSHALYQCLAEIEKDRGAKPISFGFRKDRSIAENASRHKRRRWVLNIDLEDFFPSFNFGRVRGFFLKDKAFALNPEVATTIAQIACDGTALPQGSPSSPVISELIAQILDMRLVRFAKKYGVTYTRYADDITFSTSQKNFPNGLATVDPNDPTVWHLSEELVGKIVSSGFTINNAKTRMHFRGSRQMVTGLVVNEKVNIRSDYYRRARAMCDMLFQTGQYYKVVIQPDEEDEEPKPDLTSNLNPLQGILGHIYSVTQTEERREISEQRQKPRAIRKLFRRFLFYKYCMALKEPLIITEGKTDPVYLREAVKSRTKFHPALGAPGKDGFEHAVRYFNYGGLAHEVMDLGGGTGDLKSIPLDYLRNLKPSKGSHKPFAHKPMMHPVIIVLDNDEGLAAVGSTVKKNFGVAIDIKSTDDYYNVTENLYIVKTPENGTKNTCIEDMFPKKWRDHKIKGKKLNTASKIDPTKDLSKEAFAKSVVKANADKIDFSGFDPLLERIDKAIQHHAAKP

SEQ ID NO: 771 - protein, 577 aa, unidentified
  source 1..577: note = Related to JAINWB010000007.1; note = Thalassospira xiamenensis
MSHLKKLKAATSRKELAAVLGYAPASMTAIVYKMPKDRKYTTFEIDKKSGGKRTIKAPVAKLKKLQSHLSHVLYQCLSEIEKDRGAKPISFGFRRDRSIAENASRHKRRRWVLNLDLEDFFPSFNFGRVRGFFLKDKAFHLHPEVATTIAQIACDGTALPQGSPCSPVISELIAQILDMRLVRLAKKYSVTYTRYADDITFSTSQKEFPKGLAHVDANDPSIWHLSDELVGEITGSGFVINNTKIRMHFRGSRQMVTGLVVNEKVNIRSDYYRRARAMCDSLFQTGKYFTVTQPPAGEGEEPVPELIDSLSPLEGILGHIYTVTQSEERRSVQEQRQQPRAIRKLYRRFLFYKYFMALKAPLIVTEGKTDPIYLREAIQSRADSHPVLGVLGEDGFNHAVRYFNYEGLAHEIMDLGGGTGDLKSIPLDYLRNLRPSKEAHKPLLHKPMEHPVIIVLDNDEGLASVASTVKKNFGVSINLKSTSDFYNVTDNLYIVKTPENGSNGTCIEDLFPKEWRNYKVNGKKLNTASKIDPLKDLSKEAFAKSVVRPNADSIDFSKFDSLLGRISKAIEHYAAKP

SEQ ID NO: 772 - protein, 572 aa, unidentified
  source 1..572: note = Alphaproteobacteria bacterium; note = Related to JADGDA010000026.1
MSRKDLAGILGYNPSSLTAIIYKTPNASKYTTFEIDKKSGGKRTIKAPSPKLKKLQSHLSHVLYQCISEIEKNRECKLKPISFGFRKDRSIFENAARHKRRRWVLNIDPENFFPSFNFGRVRGFFLKDRAFALNPEVATTIAQIACDGAALPQGSPCSPVISELIAQILDMRLVRLAKKFGVTYTRYADDITFSTSQKEFPTGLARPDGTNPTIWHLSDDLVGKITNSGFTINSNKTRMHFRGSRQMVTGLVVNEKVNIRSDYYRRARAMCHHLFRNGQYFKSMLPQEKDGEEPKPELTGNLNPLEGILSYVYAVTQREERRNDQDQRQKPRAIRKLYRRFLFYKYFIALKAPLIVTEGKTDPIHLREAVKSRTKFHPALGKPGKDRFDHAVRYFNHGGLASEILDLAGGGTSNLRSIPIDYKRNLHANKKEQKAIARCPMRFPVILVLDNDDGLKTISSTIKEMFKVEFVVSSDADFYHVTDNLYVVKTPENGNKNTSIEDLFPDKWRNMELRGKKFSSANKIDSSKEYGKEVFAKSVVKPNACQIDFSAFDPLLERLCKVIEHHSGARAS

SEQ ID NO: 773 - protein, 568 aa, unidentified
  source 1..568: note = Related to NZ_QAYR01000012.1; note = Rhizobium pusense
MAEILGYPPSSLTAIIYKTPTASKYTTFTVDKKSGGQRIISAPIPKLKKLQSHLSHVLYECLDEIEKGRAASPISFGFRAGRSIAENAAKHKRRRWVLNIDLEDFFPSFNFGRVRGFFLKDQSFSLHPEVATTIAQIACDGVALPQGSPCSPIISELISQILDSRLLRLAKKYGVTYTRYADDITFSTSKKEFPAGLATQDATDPTLWNLSDELSGKITSSGFVVNNSKTRMQFRGSRQMVTGLVVNDKVNIRSDYYRRARAMCDSLFETGKYFSSMVPPAKVGDDAVPNRTDNLNPLEGILSHIYHITQAEERRDVQEQRQTPRAIRKLYRRFLFYKYFIALKEPLIVTEGKTDPVYLREAVRRLPQFHPALGTPGAKGFKHVPRYFGYGGLVSELLDLGGGGTSNLKSIPLDYRRNLNPTKKEPKAFGFRPMSFPVILVLDNDDGLSPIAGTIKKTFNIQISQSSTEDFYHIIGNFYVVKTPEILATGNPPQSTYIEQFFPQKWRDYPLNGKKFSTKNEIDINREYSKEVFAKSVIKPNAAAIDFSGFIPLLKRIEKVMKHHAAQT

SEQ ID NO: 774 - protein, 582 aa, unidentified
  source 1..582: note = Related to JADOUL010000002.1; note = Labrenzia sp.
MSHLKKLKAATSRKELAQFLGYKPSSLTAVVYKIANDDKYKIFEIDKKTGGKRIIKAPIPKLKKLQSHLSNMLYQCLEEIEKDRQLKPISFGFRKDRSIADNASKHKRRRWVLNLDLADFFPTFNFGRVRGFFLKDHAFELHPEVATTIAQIACDGTALPQGSPCSPVISELICQILDMRMLRLAKKYGVTYSRYADDITFSTNQKEFPTGLASQDTGDFTIWHLSEELVGKIENAGFTVNDEKTRMHFRGSRQTVTGLVVNEKVQVPSDYHRRARAMCHALFETGKYYRSEVESEDEDKEGELEPELIDNLNPLEGILSFIYSVAKHGDHRPIEEQRKHPTAIARLYRRFLFYKYFVAPKKPLILTEGKTDPVYLREAVKRRDSFHPGLGKPEKDGFKHAVRYFNYGGLAHDIMGLGGGGTSNLKSVPLDYARNLYPKRGKPRAIKHRPMKFPVVVVLDNDDGLGPLASTIKDTFGVRITQKSTDDFYHVTDNLYVVKTPEDADKKTFIEGLFPEKWLKKELNGKSFNAENKIDPDKEYSKEVFAKSVIKPNAKDIDFSGFDPLLERIQKAILDYQTKLGS

SEQ ID NO: 775 - protein, 571 aa, unidentified
  source 1..571: note = Related to NZ_JACICD010000010.1; note = Angulomicrobium tetraedrale
MSQLEKLKAAKDRKELATVLGYKPSALTAIIYHPPAKDRYTNFEIDKKSGGKRTIKAPDAKLKKLQSHLSHLLYACLDEIEKERDAKPLSFGFRRDRWIADNATRHKRRKWVLNLDLADYFPSFNFGRVRGFFLKDNSFALQPEVATTIAQIACDGTALPQGSPCSPIIAELIGQVLDMRLVRLAKKYGVTYSRYADDITFSTSQKDFPAGLASQDPTDATIWHLSDELLGKITASGFAVNPAKTRVQFRGSRQTVTGLVVNEKVNIPSEYYRNARAMCDALFSSGQYFTSMKASAPEPDLTSNLNPLEGVLGHIYAVTQTEDRRDVREQRIKPRAIRSLYRRFLFYKYFVALQAPLIVTEGKTDPVYLREAVKARTAFHPVLGAKTAGRFEHAVRYFNYGGLAHEILDLSGGGSGNLRSIPLDYRRNFQPSKNDPRAIAHTPLAHPVILVLDNDDGLASVASTIWDNFKVKIDVKTTAHFYHIIQNLYVVKTPEAGGKSAIESLFPDVWLNIELNGKKFNCSNTINPETEYSKEVFANSVVKPNAGNIDFSGFDLLLERIVAAIEHHRAK

SEQ ID NO: 776 - protein, 425 aa, unidentified
  source 1..425: note = Related to NCFD01000067.1; note = Acidocella sp.
MSQLEKLKATTYRKELAALLGFKPQALTSIVYKTPLSERYTTFEIDKKTGGKRTIKAPSPKLKKLQTHLSHLLYQCLDEIEKQRGEQPLAFGFRRKLWIADNAARHKGRRWVLNLDLKDFFPSFNFGRVRGFFLKDKSFELKPEVATTIAQIACDGVALPQGSPCSPVISEMITRILDMRMVGLAKKYKVTYSRYADDITFSTNHKNFPVGIAVPDGEDATNWNLSNELLGKITSCGFEVNSEKTRMQFDGSRQIVTGLIVNEKVNVASEYYRRARAMCDSLFSTGSYFRSMKEPKEDNDEPTPDLINGLNPLNGILGHIYAVTETEERRAISEQRIKPRAIRKLYRRFLFYKYFVALEVPLIVTEGKTDPVYLRSAVRRRPDFHPVLGKMKGDSFIHAVSYFNYGGLAHEVLDLGGGGVGNLKS

SEQ ID NO: 777 - protein, 573 aa, unidentified
  source 1..573: note = Related to JAFKKU010000016.1; note = Hyphomicrobiales bacterium
MSYLSKLKAAQSRKELAEILGYSAQSLTAIVYQTPDTSKYTTFEIPKRSGGTRTIKAPIPKLKKLQTHLSHALYQSLDEIENGREARPLSFGFRKGRSISENASCHKRRRWVLNLDLEDFFPSFNFGRVRGFFLKDSSFGLHPEVATTIAQIACDGVSLPQGSPCSPIISELIGHVLDMRLVRLAKKYKVTYSRYADDITFSTSQKDFPAGIALPDPANSANWMLSEELLSKISNSGFSVNQSKTRMHFRGSRQSVTGLVVNEKVNIRSEYYRNARSMCFSLFANGVYYKKNAATGEREPTDNPNPLEGMLSHIYYVTQSSEKREIQEQRINPRASRKLYRRFLFYKYFLRLDRPLIVTEGKTDPIYLKEAIERLDAFHPALGQKRNGQFHHTARYFNYKGTAHEILDLGGGGTANLKSIPIDYRRNLMPYKKEPRAISHRPMLHPVILLVDNDDGLGALASTVKEMFGTNISLKTTNSYYHIVENLFLVKTPENNEKKTCIEDMFPLSVLKRELNGKKFNPSNQIDITKEYSKDIFANHVVKAEADTIDFSGFTPLLDRIKKVIEDYKISHG

SEQ ID NO: 778 - protein, 577 aa, unidentified
  source 1..577: note = Rhodospirillales bacterium; note = Related to JACKIO010000012.1
MSYLEKLKNAKNRKDLARLLGFKPSALTAIIYMIPVEEKYTTFEIPKKSGGTRTIKAPAPKLKKLQTHLAHWLYECLAEIEEGRDSTPVAYGFRRKGTIAANAHNHKRRRYVLNLDLEDFFPSFNFGRVQGFFLKDKAFELNKEVATTIAQIACDGTALPQGSPCSPVISELIGQILDLRLLRFSKKHGVRYSRYADDITFSTNQKNFPVALAIQDSLDLSKWTLGEALINEIEQAGFKINANKTRMHCRGSRQMVTGLVVNEKVNIRSDYYRKARAMCDSLFQTGKYFKTLKVSDDPKEEPQPDFTSNLNPLEGILSHIYDITQKEDRRGVSEQRKEPRAIRALYRRFLFYKYCVAPKAPLIVTEGKTDPVYLREAIKYRDSFHPRLGKPGKNGFEFAVKFFNYGGQAHEVMDLGGGGSGNLKSIPLDYLRNLDATKKGRKAFKSKPMAYPVILVLDNDDGLRDIAGTLKTNFSISIKTNTSSDFYHITENLYLIKTPETSGQSCIEDMFPEKWKEKPLKGKKFNPNSKIDPQKEYGKEVFANSVVKPNANEIDFSGFDPLLSRIVSVLDDYKAAS

SEQ ID NO: 779 - protein, 575 aa, unidentified
  source 1..575: note = Proteobacteria bacterium; note = Related to JABGZD010000203.1
MSYLKKLKSAKNRKALASILGFTPSALTSIVYQTPLEKKYTTFKIPKKSGGDRIIKAPNPKLKKLQTHLAHCLYSCLSEIEEGRNATPVAYGFRKGGTIAANAKNHKRRRYVLNLDLEDFFPSFNFGRVRGFLLKDKAFKLEEEVATTIAQIACDGEALPQGSPCSPVISELIGQVLDLRLLRFAKKHGVRYSRYADDLTFSTNQKDFPPDFAQQDASDLSKWTLGNELVQKIEGAGFKINAGKTRMQCRGSRQMVTGLVVNEKANIKSEYYRNARAMCDSLFQTGQYFKTVISPDIPNDKPMPDLTDNINRLEGILSHIYDVTQSEERRPIADQRKEPRAIRLLYRRFMFYKYCVAPKVPLIITEGKTDPVYLREAIRHRNSYHPRLGNPGKDGFEFAVRFFNYVGQAHEIMDLGGGTGDLKSLPLDYLRNLDPNRKGRKPFKHKPMACPVILVLDNDDGLSGVAGTIKKNFDVTVSIKTTDDFYHITENLYLIKTPEAKKKSCIEDLFPQQLKGTLLNGKKFSAKAKIDPQTEYSKEIFANSVIKPNASKIDFSGFDPLLDRIVSVLDHYSPQ

SEQ ID NO: 780 - protein, 578 aa, unidentified
  source 1..578: note = Related to VYFW01000066.1; note = Gammaproteobacteria bacterium
MNYRDKLKAAKDRKDLARLLGYKPSALTSIIYVTPPERKYTTFEIAKKSGGIRTIKAPNPQLKKLQSHLAHYLYGCLAEIEEERQARPVSYGFRKTRTIASNAKNHKRRRYVLNIDIEDFFPSFNFGRVRGFFLKDKAFALKEQVATTIAQIACDGEALPQGSPCSPVISELIGQILDLRLLRIAKKHGVRYSRYADDITFSTSQRDFPEALAVQDSESLFGWAPGAELVHEIRRAGFKINPSKTRMHCRGSRQMVTGLVVNEKVNIRSEYYRKARAMCDSLFQSGTYFRSFTPPVSPGVDPQPDLTVNLNPLEGILSHIYAVTQSEDRRGIKDQRLKPRAIRTLYRRFLFYKYCIALDAPLIITEGKTDPIYLREAIRFREIFHPQLGEPGESGFKFAIRFFNYTGQAHEIIDLGGGTGDLKSIPLDYLRNFDARKRKPFQHVPMAYPVILVLDNDNGLESIGSTVRKNFGISITVDSTDDFYHITKNLYLIKTPETKEQSCIEDLFPAEWKNKRLNEKKFNPSGSIDTQTEYGKKMFAKYVVRPNSHKIDFSGFDPLLERIVAVLDHYSAEGKQSL

SEQ ID NO: 781 - protein, 580 aa, unidentified
  source 1..580: note = Related to NZ_QWGA01000003.1; note = Henriciella algicola
MSQLENLRSAKNRKELASLLGFQPSALTSIIYKTPLADRYSTFEIPKKSGGTRTIKAPNDKLKKLQRHLAHLLYNCLAEIEDELSIASVSYGFRQNGSIIANAKNHKRRRYVLNIDIENFFPSFHFGRVRGFFLKNKFFALEDEVATTIAQIACDGEALPQGSPCSPVISELIANILDLRLLRLAKEHGVRYSRYADDLTFSTNSKKFPDAIASEGALGNWTLGNELVEEIDDAWFTINHAKTRMHCRGNRQLVTGLVVNEKANIKSEYYRNARAMCDSLFTQGRYYKSKTSPEDADAVPQPIWTSNLNPLEGILSHIYDVTQSEERRPVPEQRNAPRAIRALYRRFLFYKKCVALTAPLIITEGKTDPIYLREAIRHRNVFQPVLGSMGDEAFEFAVNFFNYEGSSHELMDLGGGSGDLRSIPLDYRRNLAPAKEKKRKPMIHTPMSYPVILVLDNDDGLSAVTGTIKKNFGVQIDKTTTDDFYQVIQNLYVVKVPETTSDAQIESLFPDSVQSIKLNGKAFSTKDKIDPEKEYSKAIFAKSVVRPNADKIDFSGFDPLLHRIVAAIDHYDANGPKAFS

SEQ ID NO: 782 - protein, 572 aa, unidentified
  source 1..572: note = Related to NZ_BARJ01000009.1; note = Gluconobacter oxydans
MSYLKKLKAAKDRKELAKLLGYEPSSLTAIIYMTPLPAKYSTFDIPKKNGGVRTIKAPEPKLKKLQTHLAHLLQACLVEIEADKLSRPVSFGFRKKGRITDNAKVHKGRRYVLNIDLADFFPSFHFGRVRGFFLKDKNFELSDQVATTIAQIACDGAALPQGSPCSPVISELIGHVLDVRLLRLSKKHHVTYSRYADDITFSTNNKAFPTALASQDPADPAKWVLGDELINKVQNSGFQINPAKTRMSCRGSRQMVTGLVINSKVNIKSEYYRNARAMCDSLFQKGWYFRDSTPPVEDGDPPTPNYIISLSPLEGILSFAYNITQSEDRREIAEQRKKPRAIRELYRRFLFYKYCVAPSQPLLITEGKTDPIYLREAIIRRTAYHPTLGTFGPTGFKFAIRFFNYEGQVHEIMDLGGGTGDLKSVPMDYLRNFKPYRKRKPFKHKPMQHPVIIVLDNDKGLQGVASFLKENFDTIISLTTKNNFYHIIENLYVIKTPESSPMTCIESMFPKIWLKHSLNGKTFNPDKPDITKEFGKEIFAKSVVKPNAGSIDFSGFDPFLDRIIAVFNHFYG

SEQ ID NO: 783 - protein, 577 aa, unidentified
  source 1..577: note = Related to NWSX01000001.1; note = Rhizobium sp.
MSYLAKLKATKDRKDLARLLGFTPSAMTSIVYQTMPAAKYTEFEIPKKSGGKRVIKAPFPKLKKLQTHLAHVLYGCLAEIEQNFDAKSVSYGFRKGRGIEGNAKIHKRKRFVLNLDLADFFPTFNFGRVRGFFLKDTSFALTNEVATTIAQIACDGVALPQGSPCSPVISELICHILDVRLLRLARTYGLRYSRYADDITFSTNRREFPADIARVNQTDPSTWVIGKELASRIDDCGFAINFTKTRMHCRGSRQMVTGLIVNEKVNIRSEYYRNARAMCDSVFRQGAYFHSHQTPTVAGGTPIPEMTDNLAPLEGILNHIYSVTQTEERRSVQDQRSAPRAIRSLYRRFLFYKRFIALEAPLIVTEGKTDPVYLREAIRHLPSWQPRLGEPTVNGFKFSLSFFNYGGKSHEIMDLGGGTGDLKSIPLDYLRNLDSSKSDRKPMQHKPMKFPVIMVLDNDDGLGDVAGTIKKNFNVGMSVTSTQDFYHVCENLYVVKTPEAGGKSSMESMFPKSWTTIVLNGKKFNPSNKIDITKEYGKEVFATSVVKANAAKIDFSGFNPLLDRIVKVIDHYAPPAS

SEQ ID NO: 784 - protein, 674 aa, unidentified
  source 1..674: note = Related to NZ_LT670818.1; note = Bradyrhizobium erythrophlei
MSILHTLRTAKTRYDVAALLGYKPSALSYIVFQIPTAEKYKTFEIKKKGGGKRRIDAPIPMLKGLQRRLADVLYECLRELEEPEKRKNKLSHAFRKDYSIITNAKAHKSRRYVLNLDLQNFFPSLNFGRVRGFFLKNNQFKLAEPVATILAQIACNDGVLPQGSPCSPILSELLTHFLDIRLVKLAAKNQCSYTRYADDITFSTNQKEFPVALAVAVGEGWILGDEVKSRIEGAGFTINDTKTRMQVRGSRQTVTGLTVNEKVNVPQRYCKLARAMTHSFLATGAYKRDGVDDSSVPRLEGVLDHIYHIKERQIDIAIDAEKNKEKRHKLHADRTKHKNEYPSAIRLIYFQLVFFKHFIDPSKPLIICEGPTDSIYLKSAIRKLAALHPKLASTKDGKLSLDIHFFKYSKQSKDLLQLRGGSPDLKFFLEAWRDKLAKFKHRPMKHPVIVLIDNDDGATQIFKLAQSKKFGVTIGHATDLPFYHLGGHLYLVKTPIKGPDNKSCPEDFSTRPCWQPRSTARPLIPTRSTTRLASSERSSLQSVSCGRRRAASTSQALIPFSLALTPYSMITPNAGLRAQRPRHRRRSQRCRHRQRRSARRQPPPWPRPNVGCASQSIDLGRNRAGGGAAGRVNPVQDSSREASMLFPNLNTALMESKMKRASAFSKKTLSWARL

SEQ ID NO: 785 - protein, 607 aa, unidentified
  source 1..607: note = Related to JADPKY010000194.1; note = Bradyrhizobium sp.
MSILQSLRAAKTRYDLAALLGYSPSGLSFIVYQIPKAAKYTTFDVKKKDGGQRRIDAPIPMLKALQKRLAGILYECLRELEESDKRRNNLSHAFRKNRSIITNAMAHRSRRYVLNLDLQNFFPSLNFGRVRGFFLNNNQFKLAEPVATTLAQIACNDGVLPQGSPCSPILSELLTHFLDMRMVKLATKSRCSYTRYADDITFSTNLKAFPASLAVAVGSGWALGDELKSRIESAGFTINEAKTRMQVRGSRQTVTGLTVNEKVNIPQSYYKLARAMTNSLLTTGTYKRDGVNDSSVQRLEGVLNHIYHIKERQIDLAIDAEKNKEKRHALHAERTTQKNEYPSAIRLIYFQLVFFKHFIDLAKPLILCEGPTDSVYLKSAIRKQAALHPKLISTKDGKTSLNVHFFKYSKQSKDLLQLRGGSPDLKFFLEAWKETLVKFKHRPMKHPVIVLIDNDDGATQIFKLLQSKKFGVTIGLATDLPFYHLGENLYLVKTPIRGPDNKSCPEDFFDPAVLSTKIDGKTFNPNKEHDAPGEFGKVVFAERIVRPQAGTIDFSGFDPLLARIDAVLDDYAKRTAPGPAAAPSPPAAGAAPKMKKRPRAATAAAQP

SEQ ID NO: 786 - protein, 577 aa, unidentified
  source 1..577: note = Related to JACIHF010000027.1; note = Bradyrhizobium sp.
MSALQALRSARNRYDVAAILGYKPSALSYIVFQIPTANKYTVFEIDKKGGGQRRIDAPIEKLKGLQRRLADTLYECLRELESTDKVKNKLSHAFREDFSIITNAKAHRARRFVLNLDLSDFFPSLNFGRVRGFFMRNRSFRLAEPVATIIAQIACNNGVLPQGSPASPIISELMTHFLDIRLVRLAARNRCSYTRYADDITFSTNLEEFPAALATAEGQSWKLSDELRSRIRDAGFEINDAKTRMQVRGSRQTVTGLTVNEKVNVQQYYYKSARAMTHAFITTGKYIRNGDEETSVQRLEGILNHIYHIKERLIDIGIEAQENDEKRHKLHADRTKQKNEYPSAIRLLYYQLVFFKHFVDPSRPLIVCEGPTDPVYLKCALRSLATSHPKLATAVDGKISLAVNFFKYSDQSRDLLQLRGGAPDLKFFLQTWKDKLAKYKHRPMKHPVIILIDNDDGATEIFKLLQSRKKFGIDISHATDLPFYHLGNHLYLIKTPINGPNNKSCPEDFFETSVRETPIDGKRFNPDKEHEAPGEYGKVVFAERVVRPQAANIDFSRFDPILARIEAVIDDYAARKS

SEQ ID NO: 787 - protein, 601 aa, unidentified
  source 1..601: note = Related to FOUS01000020.1; note = Bradyrhizobium sp.
MSSLHALRAATTRNDLAVLLGYKPSALSFIVYLTPPTAKYTTFDIAKKGGGTRRIDAPTPRLKGLQKRLADLLYECLREIEESEPRKNKLSHAYRKQFSIITNAKSHKSRRYVLNLDLEGFFPSLNFGRVRGFFLTNNHFKLARPIATLIAQIACNNGTLPQGSPCSPIISELLTHFLDMRLVRLAGRNKCSYTRYADDITFSTNQKEFPEALAVAVAEGWSLGDELRSRIEDAGFSINESKTRMQVRGSCQTVTGLTVNEKVNVPQRYYKLARAMTHSLLSTGSYLRDGISETSVQRLEGILDYIYNIRERQIDIALSAEKDAAKRKKLLSDRVEHTNEYPSAIRKIYYRLVFFKHFVDPTKPLIICEGPTDPVYLKSAIRRLASAHPKLTSVRGSDILLNVAFFKYSKQSRDLLQMRGGSGDLKYFLEGWKEELARHKHRPMKHPIIVLIDNDDGAKSIFGILRGKFGQSIGLATDLPFYHLDGPLYLVKTPTRGADHKSCPEDFFESHVLATKVDGKIFNPDKEHDAPGEYGKVIFAEKVIRPLAGSIDFSGFEPLLARIEAVIEDYSKRTATRPPPPLAAVRPTASRAKRAVVAAKP

SEQ ID NO: 788 - protein, 576 aa, unidentified
  source 1..576: note = Related to NZ_FYEH01000004.1; note = Arboricoccus pini
MAALLSYSPSAVSYIIHITRPATRYMTFDIPKRSGGVRTIDAPNDRLKGLQRSLSKLLFKCLREIEAKDPRRNKLSHAFRPGASIISNAKTHHRRRYVLNLDLKDFFPAFNFGRVRGFFLKNEHFRLAEPVATLLAQIACKDGKLPQGSPCSPIITELMTHFLDIRLVKLAARHKCTYTRYADDITISTNQREFPSALAELDGTQWKLGEELVSRIHDAGFEVNDAKTRMQLRGSRQMVTGLTVNEKVNVAQAYYKRVRATAHRFLTTGAYELDGATCNSVPRLEGMINHIYHVRERQIDIAIANEGNKEKQHKLHAERTKTKNERPSAIRVVYYELIFFKNFINPPQPLIICEGPTDPVYLKSAIRRLAAAHPLLASVVGGKPELKVNFFKYSDQARDFLQLRGGSGDLLSFLISWKEAFNRYNFRPAEHPVIVLIDNDDGAGDIFNYLKNKKNYGLDIALEKHDPFFHLHGSLYLVKTPALGANHKSCPEDFFDPALLAEKLDGKSFNKENKINPATEYGKAVFATRVVRPKAGAINFAGFTPLLERIEAVIRDYAARKAAAAAPVPAAAAPTP

SEQ ID NO: 789 - protein, 568 aa, unidentified
  source 1..568: note = Related to NZ_AXAP01000106.1; note = Bradyrhizobium elkanii
MAHLLGYQPSGLSYLLYKLPVGAKYTTFTIPKKSGGVRQIDAPAPRIKRLQRELAKILYKCIAEIEAQPGRKNTLSHAFRYGHSILTNAKAHRKRRYVLNLDLQDFFPTLNFGRVRGYFLKNRDFLLSEKAGTLIAQIACHEQTLPQGSPCSPVISELLAHFLDIRLATLAKKHRCTYTRYADDLTFSTNQKDFPAALAVETEAGWILGDGIVQKIQSAHFTIHPSKTRMQLRARRQTVTGLVVNEKTNVRSDYYKTARAMVDSLFRTGTYVIDGAPETALAPIEGILNHIYHVRESVIDAAIEAELDPERKKKRKSERAKAKRETPSAIRVLYHRLLFYKHFIAPSQPVLLGEGPTDSIYIKTAIRRLPAYHAALTELKQGKQVQRLDFFRYSKQAKEILQLGGGTGDFKYLLTAYKKFAPQYKHAPMAHPVILLIDNDSGSNPVFSVMASLFHVTASIKTDLPFYKLASNLYVVKSPPVELDGSSYIEQFFDPALLTTTIDGKTFNPNKEHEAAGEYGKVWFAEKVIRPNEANIDFTNFGPILARIAAVLEDHAASKAAVLPQAAQ

SEQ ID NO: 790 - protein, 595 aa, unidentified
  source 1..595: note = Related to JAFCMB010000001.1; note = Bradyrhizobium sp.
MSKLSLLKSASSLSDVADLLGFSPSGLSFVLYKQSALAKYKKFEIHKKTGGTRDICAPIGAMKAIQRELATVLNACRAEILEATPRRPLSHGFRESLSIITNAQNHTARRHVLNVDLADFFPTFNFGRVRGFFLKDKDFFLNEKAATVLAQIACFENTLPQGSPCSPVIADMIAHVLDVRLVGLAKKNRVTYSRYADDLTFSTNQKDFPEDLAKPGAGPADPWIVGDELLKKIEGAAFKVNPTKTRMQFRGSRQVVTGLTVNTKVNISQRYWRSIRSMCHALFQKGEYHHPAPKAGTPPGSALVMINSLEPLAGMLSHAYHVKRKSLRFPDEKKEDVVFGQTDHRRFWFYKAFVAPTRPLIVCEGPTDNIYLRNAIRRLTAYHPKLGNMTPHGFKYGVALFSYTNQIHKILGISGGIGPLLTLVHGYKKQLKEYKFRPMAHPVIVLVDNDTALGQKVCNSLKKHFGVDVTHHSPSSFFHLTDNLYLVKTPLVGILAMTCIEDLFDAATKAMPLDGKTFHTEKAGFDPTKHIGKAPFATKVVSPNAAAISWNGFVPLLDRIVAVQNDYSAKLGTTPLAALPHTPTLAPLSPAAGHP

SEQ ID NO: 791 - protein, 554 aa, unidentified
  source 1..554: note = Related to MEEX01000061.1; note = Phenylobacterium sp.
MSFVLYKQHPALKYAKFEIPKKDGGTREICAPLGPLKAIQRELATLLNECRAEILEATKRAPLSHGFREDLSIVTNAHNHTARRYVLNVDLADFFPTFNFGRVRGFFLKDKDFELHEKVATVLAQIACFENSLPQGSPCSPVIADMIAHVLDARLVGLAKKAKVTYSRYADDLSFSTNQKSFPEGLAKPSAVGSGVWVAGDDLVKKIEASGFKLNPAKTRMQFRGSRQVVTGLTVNAKVNVSQKYWRGIRSMCRALYTTGAYHLPSPKAGAPAGDPPEKIASLRVLAGMLSHVYHVKRESGFAPDGEKEEIVFGHTDHERFWFFRSFVALDRPLILCEGVTDNVYLRNAMRQKAAAFPQLAAKTPEGYKFAVALFSYDNLIHKILGITGGIGPVLKLIHGYRRRLKAFKYRPFLHPVIVVVDNDTALNAKTCNALKKHFGVDITHGSADDFFYLTNNLYLVKTPLVGTKAMTCIEDLFDDATLKKDLDGKVFHTEKEGFDASKHIGKKLFATKVIAPEAATISWDGFEPLLARVAAVLNAYAAKVAADASSSTT

SEQ ID NO: 792 - protein, 549 aa, unidentified
  source 1..549: note = Related to NZ_JAENJN010000015.1; note = Brevundimonas diminuta
MAGLLDVEPRQLSFALYKLTPQQKYDTFEIPKKGGGVRTIHAPRGVLKDIQARLAALLYDCVDEIQVAKPRRPVSHGFRRSLSIITNAARHTNRRYVFNLDLEDFFPTFNFGRVRGFFLKDQDFLLSEKAATLIAQIACRDGALPQGSPCSPIIADLIAHILDVRLLSLAKTSKVTYSRYADDLTFSTNQKIFPPAIATGGAGPEDAWVIGSPLARVIERAGFSINTRKTRMQERASRQLVTGLTVNSKVNVTQSYWRSIRSMCHSLFQTGAYYRPIRTGEPPTLLMSLSPLAGMLSHVHHVKRESGVRPDRPGKDFQFGHKEQEDFWFYATFIALTQPLIVTEGKTDGVYLRNAIRNLPAFHPALGHITPEGFSFGVRIFNYENQTHQRLRITGGIGPLSTFMIHYGARLKRYGHRPLAAPVIVLIDNDTALTKELRAALDRNYGVKVDLLTPASFYHLTDNLYLVKTPELGASGVSCIEDFFDTATRKLPLDGKTFHADGKGFDPTRHIGKSPFAKKIVAPRAATIDWTGFAPLLSRIAAVVAHYKH

SEQ ID NO: 793 - protein, 572 aa, unidentified
  source 1..572: note = Related to NZ_CP054836.1; note = Oricola thermophila
MTILKKLQDAKDLEDLAKILGFSPKGISYIIYKLEENSKYKKFKIKKSHGGEREICAPIEPLKTLQRRLANVLYASVDSIEAEKGINSTSHGFRRGHSIISNARKHKRRRYVLNLDLKDFFPTFNFGRVRGFFISDNRFGFHENVATLISQIACHENSLPQGSPCSPIIADLIANILDARLVRLAKDHKVTYSRYADDITFSTSLKKFPAALAQPVAGEGPDWKLADPLTKAIEGAGFKINPDKTRMQFRDGRQLVTGLTVNDKVNIRPEYYRYARSMCHQAFKSGKYYRPSKVSVVGEKEPEMIESLNPLEGILSHIHHVKDTIDVRIEPEKRRHGTAARQLYRRFLIFKKFVCLDQPLVICEGKTDSIYLKCALRKLTPSFPELAKIKDEKFTSKISFFNYTGRVHSVLELGGGTEDLKFFFIKTRYHEIINRFGHKPLQHPVIVLIDNDDGAKGLFKTIKQNFGITIDLQSDDKFYHITDNLYLVKTIEKGESGKSCIEDCFEPSLLETKVKGKKFNSLKYGGASGGYGKFVFAEQVVRPNADKIDFNGFKPLLERITAAIVDYKSRVP

SEQ ID NO: 794 - protein, 563 aa, unidentified
  source 1..563: note = Rhodospirillaceae bacterium; note = Related to PBKC01000100.1
MAYILYKIPDSAKYQKFTIPKSGGGEREICAPVERLKTLQRHLANALYACRDEIDRESGLRPLSHAFRRTVIVTNDRRHKLSIITNARRHKRQRYVLNLDLQDFFPTFNFGRVRGFFIHNNDFKLNDKVATIIAQIACFENALPQGSPCSPIVADLIAHLLDVRLAQLAKKHQLTYSRYADDLTFSTSRRDFPPSIAAPVTPESPEWAPGRELAKVIDKSGFVINPTKTRMQFRMSRQLVTGLTVNAKVNIRPEYYRRARAMCHSLFETGQYYRPLSVPETEAEDGEDVKLEPVTSLNPLQGILSHIHHVKDAIDDRPEPEKRMDATAARKLYARFLKYRYFVRLDRPLIVCEGKTDNIYLKHAIRQLTDFHPKLGEWEDNSFKSAIRFFNYTGQAHKLLELGGGASDLKYFFIKNRYAEDVRGFKHRPLAHPVVILIDNDDGADGKKGLLSTIKTNFNINIDLKSNDSFFHITDNLYLVKTPGKGKKVKSCIEDFFDPKLLKTKLNGKKLNLKKDHGADGEYGKYLFAEKVVRPNADKIDFSDFKPLLERITAVIDHYKPPD

SEQ ID NO: 795 - protein, 572 aa, unidentified
  source 1..572: note = Related to NZ_JAGHQP010000025.1; note = Brevundimonas sp.
MAALLGYKPKSLAYILYKIPDGAKYTTFTIPKKTGGEREICAPIAQLKLLQRRLANILYACRDEIDKSSKLGSLSHGFRRGHSIVSNAKPHRRRRYVLNLDLKDFFPSFNFGRVRGFFIKSKAFELNEKVATLIAQIACHNNALPQGSPCSPVISDLLAHLLDARLAKMAKAQGVTYSRYADDLTFSTSKKEFPAALATSKEGETNVWELGEELVSRIVDAGFAINPDKTRMQCHASRQLVTSLTVNAKVNIRQEYYRRTRAMCDALFKTGQYADVPFNKSLARRQDSVTANEGGATGSGPWAPAKAGIKSLGPLGGRLAHIHYVKDTIDTREEIDKRKHMTAFRMLYYRFLFYKNFVALDKPLVLTEGKTDNVYLSLAVRHLPKFHPKLGQPSAKGFQSALRYFNHVNKTSKVMELDGGSGNFKFFVLRYADLIAKFGHKPQLHPVIMLLDNDDGAKDILAVIKKNYGIEIKPSSTNSFFHITDNLYVVTTPHVGKKVKTCIEDFFEPSLLKEELNGKTLNLGTPNPATEYGKHIFAEKVVRPNASTLKWDGFEPLLQRLSDVLDHYEPPT

SEQ ID NO: 796 - protein, 587 aa, unidentified
  source 1..587: note = Related to NZ_LT960614.1; note = Hartmannibacter diazotrophicus
MSILKSLKAAEDVDDLAVLLGYKPKSLTYILYKLPDAAKYTTFKIPKKTGGEREICAPTDQLRLLQRRLANILYTCRDEIDHESGKGSLSHGFRRGHSIVTNAKPHHRRRFVLNLDLKDFFPSFNFGRVRGFFIKSKAFELNEKVATLIAQIACHQNALPQGSPCSPIISDLLAHLLDTRLAKMAKKEGVTYSRYADDLTFSTNKRVFPTALAIQNGDNAKLWELGEELTSRIADTGFTINPDKTRMQCRMSRQLVTSLTVNAKVNVRMEYYKRTRAMCDTLFKTGLYSDIPFNKSLARRRDNALAVAGSEKDKDGVKAAKTSITSLGPLSGRLAHIHHVKDRIDTREEWEKRKHKTTFRMLYCRFLFYRNFAALDKPLILTEGKTDNVYLSLAVKNSPKFHPKLGQLTAKGFQSNLRYFNHLNETHKIMELDGGSGNFKFFIIRYKEIMDSFKHKPMLHPVVLVVDNDGGAKDIFATIKTNYGISINHDGKHGFYHVTHNLYLVKTPHVGKKQQTCIEDMFEPALLKEELGGKKLNLGKLDPAKEYGKHLFAEKVVRPKASTLKWDGFEPLLQRVVEVLDHYKPPT

SEQ ID NO: 797 - protein, 559 aa, unidentified
  source 1..559: note = Related to NZ_PSRS01000004.1; note = Bradyrhizobium sp.
MSVLGDLKAATSLSDLAKLIGYKPSALSFLIHHAPATSKYTSFSVPKKSGGVRLINAPSPKLKTLQQHLVTLLTKCRKEIDEASNLKPLSHGFRKGQSIITNANPHIRRRYVLNLDLEDFFPSINFGRVRGYFIKNNDFKLHKDVATVIAQIACHANSLPQGAPTSPIISDLVAHLLDVRLVRLAKKNNCTYTRYADDLTFSTNVKVFPTSLALQTSPSDWELGKPLSDVITDVGFKVNPLKTRMQLRGSRQTVTGLTVNQKVNIQAGYYRRVRSMCYELFKTGLYFQQGSAPVSALPVVEGQLNHCFRVKHEVAYSRKVDIQNDKRDRGVRKLYRRFLFYKHFVQLTKPLLICEGKTDVIYLKLALRSLAASFPSLVTTTAAGEVRNVGFFNHTDIADNLLKLGGGSGGMQLLIKDYASVLKYFRSKPLAHPVILVIDNDDGADDIFAAIYNVTKTKVSRTSTADFYHIVNNLFLVKTPESGIHGTSRIEDLFKPSVLKTVVDGKIFNPAKKIDPTKEYGKIVFAEKVVRPNANKIDFSAFNKFLGRIEAILKHYKPP

SEQ ID NO: 798 - protein, 593 aa, unidentified
  source 1..593: note = Related to NZ_CP085136.1; note = Lichenihabitans sp.
MLLELRQADTLERFAALLNYTPSGLSFILYKMDAASKYTTFEVTKASGGVRMIHAPHIKLKRLQKALANILLACNVEIETATPRRPLSHGFEKKRSIFTNAWEHKNRRYVLNLDIEDFFPTINFGRVRGFFIKSHDFTLPEKTATLIAQIACRDGKLPQGSPCSPIIANLVAHLLDVRLVGLAKRSNCSYTRYADDITFSTNQQEFPAELAAEDPPRSGTWVLSEALIAQITRTGFTVNNAKTRMQCRPSQQLVTGLTVNQKVNIRAAYYARARIMCSSLFNHGHYHVEMEPAPAPAPGGTPGKPKPKLLTKTATLEGILSHIYHIKHAQELKSNPETYKAKDPEAKKKTNQKREYPGYRKLYKKFLYFRHFVSPTAPLVMCEGKTDNIYLRSALKGLDPSYPRLAEVKDGKLFTKGRFLKHSRAEHDILELSGGSGNIANFIAHYRSAVFNYKHRPMKYPVIILLDNDSGGNAVFNQAKEMFKIRVGYDTTEAFYHLCHNLYLIKTPEMGRTGESCMEDLFDEKTRKELVDGKTFNPKADKDTATQYGKMVFADRVVRANYAMINFDKFKPLLERIVAVLDHFDANKPKAAT

SEQ ID NO: 799 - protein, 587 aa, unidentified
  source 1..587: note = Related to NZ_LABZ01000002.1; note = Methylobacterium tarhaniae
MLSQLKSASTIDRFAAALGYKPAALAFILFKMTDAEKYQTFTIAKASGGVRTIHAPTEKLKRLQKRLANVLADCRKEIHDKKPLSTLSHGFEPDRSIFTNAWAHKNRRYVLNLDLEDFFPTINFGRVRGYFINNRDFQLPIKAATLIAQIACFQGKLPQGSPSSPIISNLIAHLLDVRMARLAKSNTCTYSRYADDLTFSTNQKQFPPDIATQVPDEPGNWVLGNRLTGEIVRTGFTINHQKTRMQSRPSQQLVTGLTVNEKVNIRASYYRHARKMCSSFFNHGVYYNEMEFVFGVEGPRPKLIDTPSVLEGILSHIYHIKNLQLTRSTEPEELKQKSNKIKYPAYRHLYKKFLYFRHFINLDAPLIVCEGKTDNIYLRSALKALYPAFPVLADVKKGELRSKVKFLKHSRIEHNILELSGGSGNIANFIAHYRGAVYNYKYRSMKHPVIVLVDNDSGQKGSVFPQANKLNGKIDINYSSKEPFYHLCHNLYLIKTPEIGLTGESCMEDLFDAATLATKVDGKTFNRKDDKDTSTQYGKMVFADKVVRANYDKIDFSLFVPLLERITKVIAHYKSNPSASASSHVKS

SEQ ID NO: 800 - protein, 504 aa, unidentified
  source 1..504: note = Related to SDGU01000027.1; note = Chlorobaculum sp.
MSTLLRLRTAKNLKDLSVILGYEPKKLSYILYKIPEQEKYNSFEINKKDGGKRLIEAPIPQIKKLQKHLCNILTLCSVELAKDSPNNILSHGFKKGSSIQTNAQKHKNKRFVLNFDIKDFFWSINFGRVRGFFIKNKDFLLDDKVATIIAQIACYNGRLPQGSPTSPIISNLIAHLLDIRLVGVAKKYGCVYSRYADDITFSTNQKEFPLDLVRRSSENPELLLLGTPIEEEVKRSGFCVNPLKTRLKYRDTRQVVTGLVVNKKINVRSEYYRLARAMCHSYYKTGKYLIPSKISPIDIPSTLCDSDVKADLNRLGGILNYIFYTRNYSDQRCLRDKQDNKSGIWKMYRDFIYFKIFGALERPLILCEGPTDSIYLKAAIKSLHNEYPELIEKCSERFIYNISFLKYSKTIRELLHLTGGTGELANFVGYYASMAKQYVIWNPMHPVIIVTDNDGKRKNAATKVFAAVKQNSKNSHPTTEDDSDFFHINNNLYLVKMPHINNKK

SEQ ID NO: 801 - protein, 583 aa, unidentified
  source 1..583: note = Related to NZ_LNYU01000023.1; note = Legionella santicrucis
MAYLEKLKAASTIQDLAALLNLKASHLAYVLFVLPDETKYKQFEIPKKAGGERIINAPHERLKHIQRCLAHLLQYCVLEIEHSKPQPTPRVLSHGFRKKTEVNPNRKSDISIGIHTNAYSHQNKKYVLNFDLSGFFGSFNFGRVRGFFIKNNDFGLHPSVATLIAQIACFKNELPQGSPCSPIITNLIAHILDIRLVRWAKKNRCSYSRYVDDITLSTNQEIPQKLATQSEELMKWSLNKEIENIITHSGFQINPLKTRLQMHSSRQIVTGLVVNKKINVKKEYYRSTRAMCHALYCTGSFFLLGDKSKPGTLQQLNGILEYIYFIKQKNHCNKEPCYKTNVEQHNITNLYSQFLYFRYFIALEKPLIICEGKTDVAYLKIAIKQLKKQGKYLLPHQIDFFHFTERISEVMHINAGTSLLKKFIENYKKNIAFTKQIPRSPVIVLLDNDKAAGDVIQCLENKFKKTNVNYDRKKNFIYPVIENLYVVLLPIRNPPEDIIIENFFEKSVLETKLGEKIFSPENGNGFDSQRHYSKQVLVEKVIRPKQDTINFSGFTDILDNLVTAIEQYKPGPDKIQDQAVSII

SEQ ID NO: 802 - protein, 580 aa, unidentified
  source 1..580: note = Related to NZ_CP014691.1; note = Neoasaia chiangmaiensis
MSSLAKLQSAKSLDELAAILGYKPAALAYLLYHLPTARKYTTFTIPKRDGTPRDILAPTPKLKLLQRRLANVLYLALADIDKAGAPRRHLSHGFAKHLSIVTNANVHRRRRYVLNLDLKDFFPSINFGRVRGMFIKDKRFALDPKIATLIAQIACHNNVLPQGSPCSPVISNVIGHLLDIRLVRLAKAQKCTYSRYADDITFSTNAKLFPADMAALVAGTEHEWTLGAALIEEIDKAGFAINPVKTRMQYRGSRQVTTGLLVNEKPNILPEYYRPVRAMCWSLFNNGSYYRVVPATLAGGKPGDPDVQEPATSLAPLQGMLGHIYHVRDQIDQRSSAEKKKETTATATRKLYHRFLFYRNFIVAPKPLIIPEGKTDSIYLQAAIEKLIAYHPQLGRMDKGKFKSALKFMNFSSTVHAVLQLGSGSGDLFHFIRKYHELLKHYHHRPLPNPVIVLIDNDDGAKEIFGAAKGLGAIGISLTSTDAFYRLGPNLYLIKTPETGPKGKSCIEDLFDPTLLKAEIDGKKFDVNKKHGEPGKYGKQIFAEKVVRPKKDIIDFSKFSGLLDRIVSALDDYTASPPPP

SEQ ID NO: 803 - protein, 468 aa, unidentified
  source 1..468: note = Related to AP018498.1; note = Altererythrobacter sp.
MLNLDIKDFFPSINFGRVRGMFIKDKRFALDPKIATLIAQIACHDHVLPQGSPCSPVISNVVGHLLDIRLVRFAKAQKCTYSRYADDITFSTNAKAFPPDIAAPVAGSEHDWTLGAALLKEIEKAGFEVNPTKTRMQYRGSRQVATGLLVNEKPNVRPEYYRTVRAMCWSLFNSGTYYRMVPAALAGGKAGDPDVPEPATSLAPLQGMLGHVYHVRDQVDTRPSADKKKDATATATRKLYIRFLFYRNFVVAPKPLIIPEGKTDTVYLRAAMEKLTAYHPRLGAMDKGKFKPALKFMKFSSTIHDVLQLGNGAGDLFHFIRRYPDALKRYRHRPLPNPIIVLIDNDDGAKEIFGAAKGLGAAHIARTSTDPFYRLAPNLYLIKTPEIGAQGISCIEDLFDPALLKTVIDGKVFDPNKKHGEAGKYGKARFAEKVVQPQKDTIDFSKFAGLLDRIVAALDDYVANPPPP

SEQ ID NO: 804 - protein, 578 aa, unidentified
  source 1..578: note = Related to NZ_NISJ01000021.1; note = Sphingopyxis witflariensis
MSSLAKLQAAKSLDDLAAILGYKPAALAYLLYHLPDAQKYTAFTIPKRNGNPRPILAPTPKLKLLQRRLANVLYLALADIDKAGAPRRPLSHGFAKHLSIVTNAAVHRRQRYVLNLDLKDFFPSINFGRVRGMFIKDKRFGLDPKVATLIAQIACHDHVLPQGSPCSPVISNIVGHLLDIRLVRFAKAQKCTYSRYADDITFSTNAKALPAEVAVPIPGSEHDWTLGAALLKEIDKAGFEVNPAKTRMQYRGSRQVTTGLLVNEKPNIRPEYYRTVRAMCWSLFNSGTYYRMVPAALAGGKPGDPDVQEPATSLAPLQGTLGHVYHVRDQVDTRSSVDKKKEATATRKLYIRFLFYRHFVVAPKPLIIPEGKTDSVYLRAAMEKLAAYHPQLGAMDKGKFKPALKFMNFSSTVHDVLQIGNGAGDLLHFIRKYPDALKHYRHRPLPNPIIVLIDNDDGAKDIFSVAKNFGAPNISRTSTDPFHRLAANLYLIKTPEIGAKGTSCIEDSFDPALLKTVIDGKVFDPNKKHGEPGKYGKARFAEKVVQPQKDTIDFSKFTSLLDRIVAALDDYAANPPPP

SEQ ID NO: 805 - protein, 536 aa, unidentified
  source 1..536: note = Related to NZ_CP046252.1; note = Sphingobium sp.
MPKRDGTQRQILAPTPKLKLLQRRLANVLYLALADIDKAGTPRRQLSHGFAKHLSIVTNAAVHKRRRYVLNLDLKDFFPSINFGRVRGIFIKDKRFALDPKVATLIAQIACHDHVLPQGSPCSPVISNIVGHLLDIRLVRFAKAQKCTYSRYADDITFSTNAKAFPADVAAPVSGSEHDWALGAALLKELKKADFEVNPAKTRMQYRGSRQVATGLLVNEKPNVRPEYYRTVRAMCWSLFNSGTYYRMVPAALAGGKPGDPDVQEPASSLAPLQGMLGYIYHVRNQVDTRPAAEKKKEETSTATRKLYVRFLFYRNFVVAPKPLIIPEGKTDSIYLRAAIEKLTAYQPRLGEMDKGKFKPALKFMNFSAAIHDVLQIGNGAGDLKHFIRKYPDALKHYRHRPLPNPVIVLIDNDDGANDIFSVAKNLGAPHISRTSTDPFYRLAPNLYLIKTPEMGSKGTSCIEDLFEPALRKTVIDGKVFDPNKKHGEAGKYGKARFAEKVVQPQKDKIDFSKFADLLDRIVAVLDDYAANPPPP

SEQ ID NO: 806 - protein, 571 aa, unidentified
  source 1..571: note = Related to JAACTB010000013.1; note = Erythrobacter sp.
MKAATSLEDFATLLGYSPAGLSYILYRQPPALKYRSFTIPKRSGEERLIFAPKPKLKLLQRRLADLLYAVLADIDKAGNPRKPLSHGFAKNLSIVTNAKNHKRKRFVLNFDLKNFFPSINFGRVRGVFINDRRFQFDPTIATLIAQVACHENALPQGSPCSPVISNIIGNLLDIRLVRFARAHKCTYSRYADDITFSTNAKHFPPEVAEPLSFLGDEWVVGANLEAEVSKAGFQINPGKTRMQLRGSRQQTTGLVVNEKPNICSEYYRSVRAMCSSLFNTGSYYRMVPAALSGGEPGEPDVRDQTTKLAPLQGLLGHIYHVRNQIDRRTSSEKKQKPTATRSLYQRFLFYRNFVVAPQPLVVPEGKTDSIYLRAAIERLSEYHPRLGSFEDGKFKQSVKFLNFSPAIHDVLQLGGGYGDLQFFVRQYRISLKRFRHRPLPNPVIVLVDNDSGGKQVFNAAKGLGIDGISLKSSDPFYRLTENLYLVKTPELGNEGTSCIENFFKPELFKEKINGKEFDPAKKHGAPDKYSKQVFAEKIVRAKKAEIDFSDFAPLLGRIVAVLDDYAANPTN

SEQ ID NO: 807 - protein, 580 aa, unidentified
  source 1..580: note = Related to CP030050.1; note = Bradyrhizobium arachidis
MGGRVSLLLKLKTAKSLDDIASLLGYQPQGLAYILYKIPESVKYTTFTIAKRSGELREIKAPIPHLKILQRRLANLLNSCLGEIENAGERRRPISHGFVPSLSIITNASVHKRRRYVLNLDLEHFFPSINFGRVRGVLIRDRRFELDSKVATVVAQIACHENSLPQGSPCSPVLSNIVGHLLDIRLVRFARQHKCTYSRYVDDITFSTNRTAFPTELAAQQESGSWGLSQSLVSEIERAGFRVHARKTRMQVRGSRQLTTGLLVNEKVNVRPEYYRTTRSMCAALFNKGTYYEMKPATLAGGNVGDAAVKEVANSLDLLEGRLGYIYHIRNTVDRRESAEKKKNSTATRKLFHKFLFYKNFVALERPLIITEGKTDSIYLRCAIRSLSSFHGKLTIDRGSKPRLSVSFLNFTSTVHDVLQLGGGTGDFKFLMLRYKQLLDEFKHAPLIHPVILLIDNDDGAREIFGVAKQLGVADVSLVSRAAFYRICANLYLIKTPEGTSQNPKTCIEDLFDSSVRNTLLGGKSFDPDKKHNEEGKYGKAHFAERVIRPQSTDIDFSKFEMLLDRIVAVIEDYAPAKGI

SEQ ID NO: 808 - protein, 582 aa, unidentified
  source 1..582: note = Related to JAKSYA010000167.1; note = Methylobacterium sp.
MSVVKSLKEAKSLTDLAKILNYKPSGLSAILYHIPDANKYTEFSIPKQSGGLRTIKAPVDRLNLLQKRLSDLLYSYLDEIEPKKNGFKTVSHGFIKDRSIITNAQVHKRRRYVLNIDLNEFFSTINFGRVRGIFIKDKRFEFHQDVATIIAQIACHANSLPQGSPCSPIISNIVGRLLDVRLIRLARLYKCTYSRYADDITFSTNRAQFPSELAHPDPAGSPRWVLGFALTSEITNRGFQVNNNKTRMQFKASRQLVTGLIVNDKVNIKQEYYRNVRSMCSLLFKSGKYYRVTPAVFAGGSANDPPVKVEFDTLGSLGGMLSYVYHVKNTIDRRASVEKKKEATSAAIRKLYHLFLFYKNFVDLKSPLIVTEGKTDAIYLKSAVEMLSKFHPQLGSLNGGKFVHTVRYLKFTSTVRDVLQLGGGSSDIKFFIERYAKILRKFKHGSLSHPVIILIDNDEGAKDIFSVVRGNTPHKDISLDKTDKFYRIYSNLYLVKTPEVGKVKNMTCIESFFEDIVLKTVLETKTLDLNKKHLAPGKYGKQVFAEKVVRPNKKSINFSGFDPLLERIVAVIDDYKTNPSSI

SEQ ID NO: 809 - protein, 585 aa, unidentified
  source 1..585: note = Related to NZ_FOTK01000017.1; note = Methylobacterium pseudosasicola
MTVSIVKDLKAAKSLDDLALLLGFSASGLSYILYKSNSAARYTEFQIPKRKGGTRTIKAPEPKLKLLQTRLAEILYNYLDGIEEKKKPFKAVSHGFAEGKSIITNAAVHKRRRYVLNIDLEDFFPTINFGRVRGVFIKDRRFEFDPKIATIIAQIACHDHSLPQGSPCSPVISNIVGRLLDVRLVRLAKEHKCTYSRYADDLTFSTNQSTFPAALAAPDPAAAGKWIVGNALDAEIVGTGFKINHGKTRMQFRDSRQTVTGLLVNEKVNIVPEYYRAARSMCSAFFQTGKYYHRVPAALVGGKAEDPMEDIVYDTPPVLEGILSHIYLIKNTVDRRTSAEKKKEENVTAIRKLYHHFLFYKNFVISVRPLIVTEGKTDPIYLKAAIERLPKFHPKLGAFKGGKFQTTVRFLNFTSTVRDVLQLGGGSGDLMHFIEKYFKILSKFKHAPLAAPVIVLIDNDDGAGKIFGKIQGLTKCPPISTLTTEPFYYITANLYMIKTPEIGKDKGMTCIETFFEDTVLKTVLGGKTLSLNKKHLEPGKYGKAIFAEKVIRPNKATIKFDAFEPLLDRITAVLDHHAAKAPPAA

SEQ ID NO: 810 - protein, 580 aa, unidentified
  source 1..580: note = Related to NZ_VDDA01000005.1; note = Methylobacterium terricola
MSIVNKLKGAKTLDELADLLGFTPSGFSYILYRLPNAIKYKSFSIPKRGGGARTIEAPDDRLKLLQRRLANVLYLYLDEIEKSGKEHTPVAHGFARSLSIITNAACHKRRRYVLNLDLAEFFPAINFGRVRGVFLKDKRFEFAPKIATLIAQIACHNHALPQGSPCSPVISNIVARLLDVRLVRLAKQHKCTYSRYADDITFSTNQKEFPVDLALPDPSGKGPWVVGPALTAEITGTGFVINASKTRMQIRGSRQLATGLLVNEKVNVCPEYYRTVRSMCARLFSTGEYFAMVPAMMAGGKVGDPDVRTSFKTFPLIEGRLGFIYLVRDGLDRRDGVEKKKSPTATRVLYHHLLFYKHFVAGARPLVITEGKTDRVYLRAAIEKLTSFHPRLGKIESGAFSSSIRFMNFSRIVHDVLQLGGGTGDLKFFMLHYADTLRKFKHAPLKAPIIVLIDNDLGTKDIFGVMREKTVHKTISTQTTAPFYRVHANLYLVKTPETGKDKGMTCIEDLFEPCVLATKIDGLVFDPDKKHKEPGKYGKAVFAEKVVRPNKSAIVFDGFDPLLQRICDVIDDYATHPGHI

SEQ ID NO: 811 - protein, 586 aa, unidentified
  source 1..586: note = Related to JAGWBW010000022.1; note = Candidatus Latescibacteria bacterium
MTYLKKIREAQTLKDIAHILGVQPKTVSYLLYILPDAEKYRPFEIPKRNGGKRLINAPEPRLKMVQRRLANVLYECIAEAEKCAPPRRPLAHGFARPRVIGTDASKNKKRRYALGIFSNAAIHKNRRYVLNLDLEDFFPSLNFGRVRGFFIKDKRFELNEKVATVIAQIACHRNELPQGSPCSPIISNLLGHLLDVRLFRLARKYKCTYSRYADDITFSTNRKDFPAALAKPIPEKVSYWQLGSPLVKQIQRAGFKVNNDKTRMQWRGSRQMATGLIVNKKVNIRSEYYRTARAICNRLFSTGEYYISDPEKSLDGLNKIEGILSHIHYIKDRADLREKEEKKKDPLAIRKLYRRFLFYKHFVALEKPLIVTEGKTDPIYLRAAISKLPKYHPQLGEFVNGKFSSAIRFLKYSDTIDKILRLSGGTGNLKDFILKNYKKDINSFKFQPLAYPVIILIDNDQGARDIFNMVTKRFEIKISPETTQSFYHLHKNLYIVKTPENGKNSISCIEDLFDPELRETPIDGKTFDFSKKNKADDKHGKTVFATKVIRPQADQIDFSRFEKLLDRIIVVLDDYYVRQKSSSVDS

SEQ ID NO: 812 - protein, 569 aa, unidentified
  source 1..569: note = Related to VXMB01000009.1; note = Gemmatimonadetes bacterium
MENLERLREATSLKDIARIFGVQPKTISFLIYVLPAEHRYHTFEIPKQSGGMRTINAPEPRLKMIQRRLADCLYKCTGEIYGEPPKRLLSHGFLRSRSIFTNASIHNSRRYVLNLDLEDFFPSFNFGRVRGFFIKDSRFKLHQKVATIIAQIACHQNELPQGSPCSPIITNLIGHMLDVRLVKLARKYNCLYSRYADDITFSTNLTNFPVDLAKQSDGDLSKWQLGKKLTKEIEDSGFDINKSKTRMQWKCSRQTTTGLTVNKKVNIRSEYYRRARAICHQLFTSGSYYTFDVESQSENLNKIEGILSHIYHIKQQSAVAFERSTQRTWDAKTTGLYAIRKLYRSFLIYRYFNVSVKPAIVTEGVTDPIYLKLAIKKIKAYQPQLGEFTNGRFQYKMSFIKHSGNTGEVLQLDGGVSKLNSLIKNYRKDLDRFKYTLLTNPVVVLIDNDKGAKEVFNTVKNQYGLEISHKKEKPFYHLHANLYLVKTPLTNNRSESCIEDCFDQDTLDIELDGRKFDPAKKNGSEDTYGKTTFAREVIIPNADVVSFEGFDEVLSRISAVLDDYRVRRQ

SEQ ID NO: 813 - protein, 562 aa, unidentified
  source 1..562: note = Deltaproteobacteria bacterium; note = Related to JAIPDZ010000080.1
MSRLIKLREAKSLSDLAVLLGFKPKAVSYILYKIPENNKYIEFEISKKNGGKRLIKAPTEKLKKLQRRLADLLNECFNQISKESGKKSLAHGFIENHSIVSNAKNHKNKRYVFNVDIQDFFPSINFGRVRGFFIKNRHFSLDPNVATVIAQIACHNNELPQGSPCSPIISNLIGHLLDIRMANLSKRAKCTYSRYADDLTFSTNRKDFPESIAIMQDDNNWVAGSRLIKEIDKVGFSLNTKKTSMQFKTSRQMATGLIVNEKVNIKREYYKIARSMCHELFNTGEFYLNNKDDSSGETDNNEDKGTTISQLEGILNFIYQIKRPHDTAKLGDRRFHPNAITKLHRDFLFYKHFHSMQMPVIVCEGKTDIIYLKCALKQLAKTYNEFIELNDDGTEYKINFLNFSKKLRDVFAISTGTSGLKHLMEIFEKNMCTFNVGGKSFPVVVIIDNDDGAEDIKKKLKIKNSEEIKEFYHFVENLYVLIIPKDKGKAIEDLFEPEVLMKKVDGKVFNRQKELDAEKEYGKIVFAEKVVRENQQHINFDGFKEVFDKLKTVIDDYRTKNV

SEQ ID NO: 814 - protein, 561 aa, unidentified
  source 1..561: note = Bacteroidales bacterium; note = Related to JAGGXD010000009.1
MSRLEKLRKTKSLSDLAKLLGFQPRAVSYILYKIPEDRKYIEFEIPKKNGGKRIIKAPTEKLKQLQNRLADLLNECFDQISKESNNKSLSHGFRKKHSIVTNAKNHKNKRYVFNVDLQDFFPSINFGRVRGFFIKNHHFGLEPKVATVIAQIACHNNELPQGSPCSPIISNLIGHLLDVRMVNLAKKAKCTYSRYADDLTFSTNKKNFSPLITIKQDENNWMAGDRLVKEIKKVGFTLNTEKTSMQFKTARQMTTGLIVNEKINVRREYYKNARSMCYELFRTGEFYIDKKDIPLNNEEGHKEIGTINQLEGILSFIYQIKRPHDKAKLGNRRFHPTAITKLYRDFLFYKHFYFMEMPVILCEGKTDIIYLKCALRQLAKSYTEFVEMNDDGTSYKIKFLNSSRNFRDVFSISTGTSGLNHLMEIYEKNISKFKVKGKAYPVIIIIDNDDGSKEIKKRLNIKNDEKIKDFYHFVENLYVLIIPKDKDKAIEDLFDTGVRKTKIDGKVFNRGKKIDEKKEYGKIVFAEKVIKANQQKINFDRFKEVFDEVQKIIEDYKKRNV

SEQ ID NO: 815 - protein, 553 aa, unidentified
  source 1..553: note = Related to JAKISH010000034.1; note = Gammaproteobacteria bacterium
MSQLEKLRKSTCLSDLATILGYKPKSVSFIIYKIPEDKKYIEFEIPKKNGKTRKINAPVDQLKHLQRRLADLLNNCFNEISSEAQKKSLSHGFRKNNSIITNANNHKNKRYVFNVDLKDFFPSINFGRVRGFLIKNNDFSLNEKVATVIAQIACHNNELPQGSPCSPTISNLIAYLLDIRMVNLAKHSKCNYSRYADDLTFSTNRKDFPNLIAIKKDDKSWDASKKLIPEIEKVGFCINPDKTSMQFRTSRQVTTGLIVNEKVNIKSEYYKKARSMCHAVFNTGQFYIEGDDTEKENTIKQLEGILSFIYYAKRPHEPSKDGSRKYNPTAITTLYRKFLFYKHFYSLEKPLILCEGKTDIIYLKCALKQLSNTYSDFVDTSKDKITYKVSFLNFSKNLRDVFSISTGTSGLDFIIDNYKKLSPTFKAPRKPYPVVVIVDNDDGSKEIKKKLKINNGDAITDFYHFSDNLYILIAPKNKTGAIEDFFDDNILSTKIGGKSFNREKKIDPNSEYGKMVFAEKVVAANQKSISFDKFKEVFDGMRKIVRDCDDKIV

SEQ ID NO: 816 - protein, 564 aa, unidentified
  source 1..564: note = Deltaproteobacteria bacterium; note = Related to JAFDMD010000032.1
MTKLEKLQKTTSLSKFAKLLNYQPKTISYILYKIPEEDKYNQFEIFKKNGEKRKIQAPIKKLKLLQRRLANLLNECFDEICNKNKKTKSLSHGFRKKHSIITNAKKHKNRRYVFNVDLQNFFPSINFGRVIGFFIKNNHFSLKPEVATVIAQIACHDNALPQGSPCSPIISNLIGHLLDIRMVNLAKKTKCTYSRYADDLTFSTNKKEFPEKIAIKKNESDWVAGRALTKEIEKMGFSVNAKKTSMQYRTSRQMATGLIVNKKINVKKEYYKKARAMCHNLFKSDNFYIDKNSEKEGTLKQLEGIISFIYQVKSPHYIENKKPTAITALYRKFLFYKHFFSIDKPLIVCEGKTDIIYLKCALKQLENEYKELMGKSDKGINFKIKFLNISKNFKEVLNVAEGTTGLLSLINMYKDGFKHFKGKGKKYPVIIVLDNDKATGKIKSRIQEQLKLNNDKTADKKKQKQKLDTNKYYHFAHNLHIMFAIKEDGKEIEDLFDKEVLDTNVEGKKFSRKDKIDTKQEYSKTIFAEKVIKANQTKINFEGFKPVFNKVKNIIKEYSKKNSQ

SEQ ID NO: 817 - protein, 585 aa, unidentified
  source 1..585: note = Related to JAGQKD010000345.1; note = Nitrospira sp.
MSHLENLKKTTTLAELALLLGYKPKALSYILYKIPQINKYKDFTIPKKNGGERRIQAPVDKVKHLQKRLAVLLSQCFDEISKKANHKRSLSHGFRKDHSISTNANNHTNKRHVFNIDLMDFFPSINFGRVRGFFIKNSHFGLKPKIATIIAQIACHNNELPQGSPCSPIISNLIGHLLDIRMANFAKKTKCTYSRYADDLTFSTNRKEFPEKIASQNNGNEWATSRTLKKEIEKVGFKVNEKKTSLQYKTSRQIATGLVVNKKVNIKKEYYRQTRSMCHSLFQSNEFFLGNTYSAKPAISENAKINSTSPATNSKTPLPKNPQGKIKQLESILSYIYSVKRRHDRDNAGKRKNYPNAITKLYRKFLFYKHFFSLNCPLIICEGKTDIVYLKCALRQLANEYGEFIEKTGPSFILKIDFLNLTKNLKDVLAISEGTGGLGSLMGIYEIYMKPFKGEGKKHPVIILIDNDSGSKEIIEIMKRKKKWDPSKPFAFFTENLYVVHISSESGTSEMAIEDLFDDQTQNTTVDGKKFNRKPKIDSASEYGKIVFAEKVIRANENSINFDGFKKVLNSFKAATQDYNKRITV

SEQ ID NO: 818 - protein, 386 aa, unidentified
  source 1..386: note = Related to JAGNKF010000015.1; note = Syntrophaceae bacterium
MSKLERLREAKSLSDLANLLGYKPKAVSYILYKIPSEKKYSAFTIPKKTGGDRRIKAPIDPLKDLQGRLADLLNTCFDEICIKSKHKRSLSYGFRKGESIVTNAINHRNKRHVFNVDLQDFFPSINFGRVRGFFIKNKHFELDPDVATVIAQIASHENELPQGSPCSPVISNLIGHLLDIRMVNLAKKAKCTYSRYADDLTFSTNRNEFPEIIAMPEKSGSNIWLAGETLEKEIKKVGFTINKNKTTMQYKARRQMVTGLVVNKKINVKREYYKHARSMCYSLFQSDQYYIDKHLTIPSAGTTILDDGAADKKSEPTKEYEKIVGNMAQLEGILNFIYYVKDMHDKREKREKRKNRSAMVELYRKFLFYKYFFSVERPLIVCEGKN

SEQ ID NO: 819 - protein, 583 aa, unidentified
  source 1..583: note = Related to NZ_CP087999.1; note = Geomonas sp.
MSSLEKLKKAVTLSDLAVLLGYKPKAVSYILYKLSLEEKYTVFTIPKKGGGERTIKAPTEQLKRLQKRLADHLGKCYEEIYTKGPHKNPLCHAFRKKFSIVTNAENHVNRRHVFNADIKDFFPTIHFGRVRGFFIKNVHFTLEPKVATVIAQIACCGDELPQGSPCSPVISNLVAGHLDIRMATLAKKAKCTYSRYADDLTFSTNRKEFPDLIAVLKEGSDKEWTAGPGLLKELKRADFTINERKTSLQNSTGRQIATGLVVNDKVNVRREYYKQARSMCYSLFLNGDFYRGSHHVSTIEQPVASSDVQAEASAEKHAKSGTLNYLEGVLSYIYSVKASHDQRKTCAKRSYPSAVMKLYRQFLHYKHFFVLQKPLIICEGKTDVIYLKCALRQLGKSHPSLIKLNGKEFVYEVSFLNMSKNLKEVFAMSEGTPGLASIMENFHKNMAGFEGEGKKHPVILLVDNDSGAKEIKKKIDHKNPAKTFHRYADNLYVILIPNKPGQEETAIEHLFDAKTLSTTIDGKKFNSSAELNPKTEYGKIVFAEKVIKANQQNIDFSGFDSILQQFEAVIVDYNKQQTQSVTS

SEQ ID NO: 820 - protein, 569 aa, unidentified
  source 1..569: note = Related to NZ_FNJI01000013.1; note = Desulforhopalus singaporensis
MSNLERLQLATTLSDLADILGYKPSALSYIVYKIPSTSKYTTFDIPKKSGGTRLINAPDERLKRLQKSLAKLLMKCEIEINDKLNHKNNISHGFKKKFSIITNAIPHKSKRHVFNVDLKDFFPSINFGRVRGFFIKNKHFQLCDKIATIIAQIACHDNSLPQGSPCSPVISNLVGHLLDIRMVNLAKRAKVTYTRYADDLTFSTNKKEFPCLIAYKKSGSDSEWLPSKKLTKEIDKVGFTLNSDKISMQYKTSRQIATGLVVNKKVNVKREYYKKTRAMCHSLFRNDEYYFETLDPATKTIVKSPGNFKQLEGYLSFTYQVRSSNKLRKDKQNQKKNFIGNIKKFNGTSNTAKIYRDFLFYKHCFALEKPLIICEGKTDRIYLQCALKKLASAYPTLIDTTPAVSYLITFLNKTKNFLNVCNLADGTSGLEGIMDRYEKQMGYYHGTGQKHPVIILVDDDKGAKEIKKKIIKKNGKVEPYQKYTDNLYVVFIPRVSSKNTAIEDLFDPSVLATVIDGKTFNKENDIDRDKEYSKQVFAHKVVKANQDSINFDNFRGVFDLFLDVISDYA

SEQ ID NO: 821 - protein, 456 aa, unidentified
  source 1..456: note = Related to DNTK01000207.1; note = Bacteroidales bacterium
MTRLEALHNAKSIYDLSKLLGFKAKSISYFLYHSTEEKYYTFEIPKKNGEFRKIQAPTDKLKKLQSRLATLLSDCFEEIDRNQGYPNSLSHGFRRKHSIISNANLHKNKRYVFNIDLKDFFPTFNFGRVRGFFIKNKHFQLSPKIATIIAQIACFDNGLPQGSPCSPIITNLIAHLIDVRLVNLAKHAKCTYSRYADDITFSTNRKDFPKEIAYKTNANQWVVGNNLNAEITKLGFTINDKKTNMQYRMSRQVATGLIVNEKVNVKREYYKKARACCQLLFEIDDFYLSEGKSGSLNQLDGILNFIYQVKRPHDKENIGPRRFKPNAITKLYREFLSYRHFFSGDKPLIICEGKTDITYLKCALKRLHPDFNQLIEFKDGKTKHKVSFLRFSDRLKDVFAISEGTPGLTALMEMYADLLKRFKGVGLIHPVIIVLDTDSGNKEIRKKLEEKTYEFP

SEQ ID NO: 822 - protein, 594 aa, unidentified
  source 1..594: note = Related to BLXY01000001.1; note = Geomonas paludis
MSDLEKLKSCKSLNDLAVVLKYKPSALAYILYKLPDSQKYEEFTIPKKSGGSRKIRAPKERLMALQKRLSEVLNNCYSEVIKNYGNPLSHGFRKDCSIVTNALLHRNRRFVFNIDLKDFFPSINFGRVRGFFIYNKHFSLEPKVATVIAQIVCYDNELPQGSPCSPVVSNLVGHLLDIKLVQLAKLHKCSYSRYADDITFSTNKKDFPEEIAYIAAGGDWEPGPKLTATINKMGFAVNERKVSMQSKTRRQVVTGLVVNKKVNVKKEYYRIARAMCHSLFNNGSFYISTMGNDTTQSGTIDSNNNCTAKQLEGILSYIYMIKGVHDSRTNVEKRNKPASIMKAYRQFLFYKHFYQAEKPVLICEGKTDHIYIRCALKQLHQHYPALIEKTTEGWSWKITFLKMSENFREVLSIAEGTSGLAALMDMYKKNIGIFKDGTGKKHPVVMLIDNDKGAKEIKSKLKKTEDGKGYKPYFTENLYVMTLPQGANGEEIEIEDLFDKDLLETKVAGKSFNKKTKTDTKTEYSKIIFAEKVIKPKQHIINFSNFMPVLNHLNGIILSYQHLKGSAPTEKETEALNVLLPTQTPQPPIYVPGV

SEQ ID NO: 823 - protein, 559 aa, unidentified
  source 1..559: note = Proposed Magnetofaba australis; note = Related to NZ_LVJN01000020.1
MARLLGFRPKALSFLLYKLPDNSKYTTFKIPKKSGGEREINAPDPRLKGLQKRLANLLQNCFEEIYGRERYNHSLSHAFRKDHSIITNARAHKNKRYVFNIDLIDFFPSINFGRVRGYFIKNTDFGLHPNVATVIAQIVCYNNELPQGSPTSPVLSNLIGHILDVRLVILAKKTKCQYSRYADDITFSTREKQFPSTIATQDDAGCWHPSSKLLCIIRKSGFEVNHNKTTMQHHAYRQVTTGLVVNRKVNIKASYYRQARAMCSSLFKTGAFYIGTEVRKGRSASISGKDLGSINVLRGVLSHIYNVKRLNDKRDQKERWGKPTAIHKLYEKFVLFEKFHNLRKPLIFCEGKTDSVYLKCALYSLASEYPDLIQVSNGEVNYAIDFFKHSKSNQDLLQFSGGTGDSRYLIKDYNKKMKPFLCKGKRFPVIILVDSDQGSKKVFSAAKEVIGNNENVTGDEDFYYITQNLYLIALPKINNVSSVAIEDFFEKSVRETKIDGKSLAKSNESDNRKYYSKHIFAEKVIRPNKGKINFERFKGILDRILKVIQDYESRRETKS

SEQ ID NO: 824 - protein, 581 aa, unidentified
  source 1..581: note = Rhodospirillales bacterium; note = Related to CP064988.1
MSVLQKLKDAKSLKELAILLSFKPSRVSYLLYKLDAEKKYSKFQIPKKSGGIREIQAPEPRLKALQKSLADLLYECTLEIESNGKKRPSLSHGFRKHHSIVTNARGHNGRRYVLNVDLEGFFPSINFGRVRGFFIADKSFSLNEKVATVVAQIACFENKLPQGSPCSPVISNLIGHLLDVRLVRLAKAQKCSYSRYADDITFSTNQKNFPPAMAVQDEKNPEKWIAGTTLSKTIENAWFKVNHAKTRLQSRTKRQSVTGVVVNKHVNVEASYYKNVRAMCHSVFAKGEYHKPIVKSGDPSKGAEPSGPEMLKNIAPLEGMLAHIDYVKFGRDSPRSTVENASGKSRPPATRRLYEKFLFFKHFVYLDKPLVLCEGKTDNVYLHAAIRQLKAHHSTFIGGSDQKPEMKIRFFKYSRTSNGILGLNGGSGHLANLIAYYSKNLKDYNFAPLLQPVIVLIDNDDGAPPIFKTIKQNYKVTIDHSSADLFYRICHNLYLVKTPEKATTYKSYIEELFDDTVLQKKLNGKTFTTKKDYDKATQYGKEYFSKYIVRPNEASINFTKFSPLLDRIASAVSHYGAAADK

SEQ ID NO: 825 - protein, 589 aa, unidentified
  source 1..589: note = Related to JAKSYD010000289.1; note = Methylobacterium sp.
MFKLQALRDAKKLEDVARLVGFTPKGLSFVLYKLPDSKKYNSFEIAKRGGGKRQIKAPEPSLSLLQRRLATLLTECLEELKKAAPPRRSLAHGFEKGRSIITNAQLHKRRRYVFNVDLADFFPSINFGRVRGFFINDKNFSLQPPVATVLAQIACFENQLPQGSPCSPVISNLIGHVLDGRLARFAKTHKCTYSRYVDDITFSTSRKHFPPEIGTPIAGTAAWQASNELRSRIENAGFKINDKKTRMQYHASRQVATGLVVNEKVNVRQEYFRAARNMCDALFKTGSYFRMVPATLTGGAVGDPPVKNVITSHNQLGGMLAHIYQVKNSTDLRADDVKKAKPTATRSLYFRFLFYKNFVANKTPVIVPEGKTDTVYLRAAIRYSSAYHPRLGELKSGKLETKIRFMNFSKIVHDVMQLGHGTSEQKFLIADYERNLRGYRHAPLAHPVIVLFDNDDGAKSLFGYAKNKRHSKIGLDSTDPFYYLGYNLYLVKTPEFGGGKKSCIEDLFPSGLLKTIIDGKVFDPNKEHEEAGKYGKVVFAKQVVTPNASTIDFSGFAPLLDRIVAVLDHHATLKKAPPAPLAAALVATS

SEQ ID NO: 826 - protein, 524 aa, unidentified
  source 1..524: note = Related to NZ_AUCM01000028.1; note = Gemmobacter nectariphilus
MDADHPRSGVLIASRSTRKQENSRFWFASHGFHKGRTIISNAEVHRRRRFVFNLDLEDFFGTINFGRVRGFFIHDTMFSLEPKVATLIAQIACHENALPQGSPCSPVISNLIGNILDSRLLALARDAHCTYTRYADDLTFSTNETLFPTEIAVNVHGADWEVGVKLRKTIEGTGFFINLAKTRMSLRQSRQTVTGLVVNAKANINQDYYRAARAMCNSLFQTGYYFRPGDNPASATDKLGPLDGTLSHIHFVKARRDRHPKVNKLAKAAGEFHPPRAPEELYRKFLFYKYFAAPTAPLIVTEGVSDITYLQCAIRALVKKFPLLAEEVDGKAVRLVHFLKSSGTSRELLNLGHGAAGQGALISRYENMLEDFKHKPMAHPVIILCDNDDGLKSVIKNAKSKISKIVSTTTTDPFYHLGLNLYLVKVPEGAPPVDKDIESLFDPALLATLLDGKKFNPKKEHADHTEYGKVIFAEAVVRANAGTVDFSGFEGLLTRIEDVLRHYAALMTAAAIPAAAAPGAAAAP

SEQ ID NO: 827 - protein, 589 aa, unidentified
  source 1..589: note = Related to JAGQAF010000003.1; note = Ruegeria pomeroyi
MSSLEKLQKAKSLTDLAKLLGFTPKGVSYVLYKMDAAKKYRSFDIPKKSGGVRTIHAPEPQLALLQTRLAELLYACVHEKKKTDRRFWFASHGFHQGRTIVSNAEVHRRRRFVFNLDLENFFGTINFGRVRGFFIHDSMFSLEPKVATIIAQIACHDNALPQGSPCSPVISNLIGNILDSRLLALARDARCTYTRYADDLTFSTNEKLFPTEIAVNVHGADWEVGKKLRKEIEKSGFFINPAKTRMSLRRSRQTVTGLVVNEKANINQDYYRAARAMCNSLFQTGFYFKPGDDPADATDNLNPLEGTLSHIYFVKARRDRKPRVNKLARAAGEFNPPRAPEDLYRKFLFYKYFAAPKAPLIVTEGISDITYLQCAIRALVKKFPLLGKEEDGKVIRLVHFLKPTGTSRDILNLGHGAAGQASLISSYTNNLKNYAHKPMANPVIILCDNDDGPKTVFKNAEKKGGTKITTTTIDPFYYLGENLYLVKVPEGATPHPREIEELFQPALLATKLNGKSFDPKKDHGDDTHYGKVAFAESVVRANASTVDFSGFEKLLERIEAVLKHYAALLAAPAAPAAAPAAPAAGTATP

SEQ ID NO: 828 - protein, 585 aa, unidentified
  source 1..585: note = Related to JAGIOQ010000002.1; note = Rhizobium leguminosarum
MSQLERLKQAKNLTDLAKLLGFTPTGVSFILYKMDPAKKYRSFDIPKKSGGVRTIHAPEAQLALLQSRLADLLYACVRIRKKENARFWCASHGFHQGRTIVSNAEAHRRKRFVFNLDLMDFFGTINFGRVRGFFIHDSMFGLEPSIATLIAQIACHDNALPQGSPCSPVISNLIGNILDARLLALARDARCTYTRYADDLTFSTNEKLFPSEIAVNVHGAEWEVSAKLKKAIEKTGFFINPVKTRMSLRRSRQTVTGLVVNDKVNVSQDYYRAARAICNALFQTGKYHKPGDDLADASDNLNPVEGMLSHIYFVKARRDRLPKVNKLATVAGEFRSPRAPEELYRKFLFYKYFAAPKAPLIVTEGVSDITYLQCAIRALVQKFPLLAKEENGKVVRLVHFLKSSGTSRDILNLGHGAAGQGALISQYENALKKYPHKPMSNPVIILCDNDDGLKSVIKNAKSKIGKIVSTTTTDSFYHLGLNLYLVKVPEGVPPADKDIESLFDPALLTTLLDGKSFNPKKEHADHTEYGKVVFAEAVVRSNAGAVDFSGFEGLLTRVEDVLKHYAALSAATVAAPAAGAASAAN

SEQ ID NO: 829 - protein, 411 aa, unidentified
  source 1..411: note = Related to NZ_LZYE01000077.1; note = Acidithiobacillus caldus
MSSLTQLQRAKDLADLAKLLGFTPKGVSFVLYKMGETKKYRSFEIPKKSGGFRIIHAPEPQLALLQRRLAKFLYDCVQERKKKYPRFWFASHGFHQGRTIVSNAEVHKRRRFVFNIDLENFFGMINFGRVRGFFLHDSMFVLEPKIATIIAQIACHENVLPQGSPCSPVISNLIGNILDSRLLALARDARCTYTRYADDLTFSTNEKFFPTEIAVNVHGADWQVASKLKKTIEKTGFLINPAKTRMSLRRSRQTVTGLVVNDKVNINQDYYRTARAMCHNLFHTGLYFKPGHGPADATDNLNPLEGTLSHIYFIKKRRDRCQRVNKLAENAREFYPPKAPEALYRKFLFYKYFAAPAAPLLITEGVSDIIYLQCAIRALAQKFPLLGKEEAGKVKSLVRFLRPSSTSRDVL

SEQ ID NO: 830 - protein, 590 aa, unidentified
  source 1..590: note = Related to NZ_SDEA01000026.1; note = Paracoccus luteus
MSSLENLRKAKSLTDLAKLLGFTPKGVSYVLYKIDAAEKYRSFEIPKKSGGTRVIHAPEPQLALLQSRLAEMLYACVQERQKVNRRFWFASHGFHQGRTIISNAEVHKRRRFVFNLDLEDFFGTINFGRVRGFFINDQMFSLEPKVATIIAQIACHDNALPQGSPCSPVISNLIGNILDSRLLALARDAHCTYTRYADDLTFSTNEKLFPTEVAVNLHGAEWQVGVKLKKAIEKTGFSINPTKTRMSFRRSRQTVTGLVVNDKANINQDYYRAARAMCHSLFRTGCYFKPGDDAANPTDNLNPLEGALSHIYFVKSRRDRKPKVNKVAKAAGEFNPPRAPENLYRKFLFYKYFAAPTAPIIVTEGISDITYLQCAIRALGKKFPLLAKEQGGKITRQVHFLKPSGTSREILNLGHGAAGQASLVSSYTSNLKHYTHKPMANPVIILCDNDDGPKTVFKNAKTKAGVAISTTTADPFYYLGDNLYLVKVPEKLAAIPREIEDLFQPALLGTTLNGKTFDPKKDHGDAKHYGKVAFAESVVRPNAGTVDFSGFEDLLTRIEDVLKHYAGLSAASAMTTLNTSAVAAGTSAAP

SEQ ID NO: 831 - protein, 574 aa, unidentified
  source 1..574: note = Related to JAGHRJ010000002.1; note = Labrenzia sp.
MSRLQSLQQAENLDDLAKLLGFSPTGLSYVLYRIPEDKKYRVFDVPKKGGGVRIIKAPNDRLGLLQLRLAELLSDCGEEIRKKKQNHWHSSHGFRKGRNIISNADAHRRRRFVFNLDLEDFFGTINFGRVRGLFIADKAMALRPNIATLIAKIACHDNALPQGSPCSPVISNFVGNILDSRMLALARDGRCTYTRYADDLTFSTNEKIFPKEIAVNLFGADWGIGERLRKEVEGAGFQINHGKTRMFLRQSRQTVTGLVVNAKTNINQDYYRTVRAMCHSVFKSGTYHRETPAGAKTTTNLAPLEGMLSHIYFVKARRDRTYKNNSAARDAGEFRPPEAPVRLYDKFLFYRRFVALPAPLIVPEGKTDNVYVHSAIRNLVSSFPRLGTMSGTKFECLVDFLKPTPITKDVMNIGHGASGQNALISKYAKQVKRYPHKPLDHPVIILCDNDDGPRAVFSSAGRLAGKTITKQTTDPFYYLGDNLYLVKVPEGTPATDRDMEDLFDPVLLAQKVGGKPFDKKKEHGDGTAYGKEIFANQIVRPNWQTVNFENFRELLERIDQCITDYSSRKPAGSP

SEQ ID NO: 832 - protein, 577 aa, unidentified
  source 1..577: note = Related to NZ_JAAXDY010000025.1; note = Rhizobium leguminosarum
MKRLKAAKSLDDLALMLGFTPKGLAYILYVMADAAKYSTFEIPKKTGGSRTISAPIPHLKLLQGRLADLLTKCVTEISKEKKNYWRASHGFQPGKTVVSNAEVHKLRRFVFNLDLSDFFGTINFGRVRGFFIRDKTFELDPAVATVIAQIACHDNALPQGSPCSPVISNLIGNILDVRLLALARDCGCTYTRYADDMTFSTNEVLFPTEIAVNILGAEWTIGKRLDGEIKRAGFAVNPAKTRMSLRRSRQTVTGLVVNAKANINIDYYRTARSMCHSLFKTGQYFRRDGEQIESLGPLEGILSHIYFVKTRRDRGARINKLAKEANEFRPPEAAVALYRKFLAYKYFVNPAAPVIVTEGISDITYIKCAIRSLGKDFPLLEESKDGTSKRLVNFLRSTPTTRDVLNLGNGTAGQASLVSQYAKTVAAFPSRPMKHPVIILCDNDDGPKNVFKNAKTKAHVEISHTTTEQFYYLGENLYLVKVPEGVPPEMREIEKLFTAELLATQIDGKSFDMKKDHGNENAYGKVVFAEKIVRLQWKTTDFSGFAPLLSRLEACITHYQALTSAQVETEAVAATAA

SEQ ID NO: 833 - protein, 583 aa, unidentified
  source 1..583: note = Related to JAHJTN010000036.1; note = Bacteroidetes bacterium
MDTLERLQGAKNLTDFAKLLGFTPKGMSYVLYQLPNDTKYRTFEIPKKAGGTRTIRAPEHRLALLQTRLGEMLDECVGELKQRNRKFWRASHGFQKGRTIVSNAEVHRRRRFVFNVDLEDFFGTINFGRVRGFFINDKSFSLHPSIATLIAQIACHENVLPQGSPCSPVISNLIGNILDARLLALARDEHCTYTRYADDLTFSSNEGLFPTRIAVNVHGAEWKVGRKLRQEIEGAGFKLNETKTRMSLRCSRQTVTGLVVNAKPNIKQDYYRGVRSMCHSLFRNGEYHRRVAEREDTTNALTPLEGMLSHIYFVKARRDRAYKVNKLAIEAAEFRPPRAPVELYRKFLKYKHFVAPPAPLIVTEGISDITYLECAIRALAASFPVLAKNDGGKIVRLVNFLRPSGTARDILNLGHGASGQAALIGQYRNMLKEYRHMPMVHPVIVLCDNDDGPKEVFKSAAKRSGLTISTTTTRPFYHLGDNLYLVKVPEGALPQSKEIEELFQPALLATKVDNKPFDPKKDHGDEAAYGKVIFAEKVVRPHWASIDFSNFTELLSRIEQCLTHYAAVKSATTAAPAAAASSP

SEQ ID NO: 834 - protein, 590 aa, unidentified
  source 1..590: note = Related to JAGRRC010000006.1; note = Ciceribacter sp.
MTGIDLLKQAKSLTDIAKLVGFTPAGLSYILYRMPESAKYRAFEIPKRSGGTRTIKAPMRELALLQSRLNTFLGQCAEELARDNPRFWAAAHGFRKGRTIVTNANAHRSRRYVFNVDIANFFDSINFGRVRGVFIKDRAFNLEPTVATIIAQIACFENALPQGSPCSPIISNFVAGILDARLLRLAKHARCTYTRYADDLTFSTNERLFPTEIARELAGPDWCVGPRLSEVVEASGFQLNPGKTRMSLRRSRQTVTGLVVNEKPNIKQKYYRDTRSMCSSLFSSGKWHHGTGVDEQQTSNLRPLEGRLAHIYYVKARHDRSQKQNKHAEYVPPTAPVELYRKFLFYKHFVANDLPTVVTEGVSDITYLKCAIRSLSAKFPSLIGMSRGKLKVDLQFLNPTGTSRSVLNLGHGASGQASLIQQYSNRLKNYKNRPLAMPVIILCDNDDGPKEVFKNASGKTGKTISKSTTDPFYYLGDNLYLVKVPENGTQSRDMEDMFPASVLDELLENKPFNKKKEHGDGTAYGKVIFAEKVVRPKTGTSIFNDFEDLLTRIIACIAHYAAIRATKAAASSPAPALSVPTAAAVAAPTT

SEQ ID NO: 835 - protein, 589 aa, unidentified
  source 1..589: note = Mycobacteriaceae bacterium; note = Related to JAIERP010000170.1
MSKLERLKKTKNLSDLAKLLGFTPKGLSYVIYQIPDTKKYKVFDIPKKTGGIRTIKAPVDQLSLLQSRLAELLTECVEELIKDNPRYWTASHGFRKSRTIVSNADAHRKRRYVFNVDLADFFGTINFGRVRGYFIKDNSFGLDPAVATVIAQIACHENALPQGSSCSPVISNLVANILDARLLRLAKAAGCTFTRYADDLTFSTNKSIFPSEIAKELAGANWEVGKQLQDLIERSGYTLNIAKTRMSLRQSRQTVTGLVVNEKPNISKDYYRCVRAMCHSVFTTGSWYRPVQAAGAVPVPTASLRPVEGMLSHIYFVKARRDRSQRMNKDAGFITPKTSTRLYKEFLFYKHFVASPSPMIVTEGISDITYIKCAIRALAAKFPLLASVKGGNVTPEVAFLNPTGTSRSVLNLGHGASGQGNLVDQYASSLKCYRHLPLTSPVIILCDNDDGPKEVFSKAQKKSGVPISLTTTSSFYHLGQNLYLVKVPEGVPSAKRDIEDLFPAALLGQLVDGKPFDKKKAHGDHTAYGKVIFAEKVVRPNAAKIDFTAFEELLERIEGCIKHYAAIVAAKALAATASAPAAKTSATGP

SEQ ID NO: 836 - protein, 584 aa, unidentified
  source 1..584: note = Related to NZ_ML660062.1; note = Denitrobaculum tricleocarpae
MSELNKLKAAKNLSDVAQLLGFSPKGLAYVLYKQKPEQKYKHFEIPKKTGGTRSICAPTSQLALLQERLGEHLYQSVLELKKKEPYLWAASHGFHKGRTIVSNAQVHRRRRFVFNVDIEDFFGAINFGRVRGYFIKDRAFELDPKVATIIAQIACHENALPQGSPCSPIISNLIGNILDLRLIALAKNAKCTYTRYADDLTFSTNLKRFPSKIAISVEQGKWVAGDRLVTEIGRAGFNLNSVKTRMSHRQSRQTVTGLIVNKKVNIRQEYYRTVRVMCNSVFQTGVYYRPIKDEETEPIFLNNLNPLEGMLSHIYFVKARRDRQPGVNKLAKFANELVVPEAPTQLYRKFLCYKHFVALASPLIVTEGVSDITYLKCAIKSLSNQFPNLVENNNGMRQVAIKFLKPTGISRDILNLAHGATGQASLISNYANQLKKYTHKPIDHPVIILCDNDDGPKTVFKNARSKTGKDVSKTTIDSFYHLVENLYLVKVPEGDPPGIRELEDLFPNEWFDVKINGKPFNRKKDHGDTTAYGKVIFAESVVRPNTHKIDFAGFVPLLSRIEGCIAHYKSRKLAEMTTTAASGL

SEQ ID NO: 837 - protein, 580 aa, unidentified
  source 1..580: note = Related to JACKJA010000002.1; note = Rhodospirillales bacterium
MSTLERLKNAKDLSGLATILGFTPKGVSYVLYKLKPDEKYRTFKIPKKTGGERTIQAPEPRLALMQKRLAEHLYECVAEIQHEYPHYWRASHGFQKRKTIVGNAAVHTRRRYVFNVDIEDFFGSINFGRVRGFFISDKTFALEPAVATVIAQIACHENALPQGSPCSPIISNHIGNILDLRLLALARDAHCTYTRYADDLTFSTNLKEFPDEIAVDPGTGRWEEGHRLRKVIEDSGFRLNPIKTRMTLRQSRQSVTGLVVNAKPNIDQDYYRRVRAMCNSLFGTGQYHRVVGGKDEVTSNLNPLEGMLSYVYFVKARRDRSLRVNKRSKNEGEFNPPRAPIELYRKFLFYKHFVSPPLPLIVTEGVSDIVYIECAIRALAKSFPRLAKEEDGKIKRQVNFLRPSDTTRDVLTLGHGASGQANLIGQYTSSLKKYAHQPMAHPVIVLCDNDDGPKKVFKNAKDKCDMAISTSTIDPFYYLGDNLYLVKVPEGAAAHPREIEELFKPEILAYKIGGKPFDRKKEHGDETAYGKVKFAEEVVKPNASTIDFSDFSELLSRIDQCLAHYGTVVAASPVAAAAAS

SEQ ID NO: 838 - protein, 568 aa, unidentified
  source 1..568: note = Related to NC_013440.1; note = Haliangium ochraceum
MSYLDRLKSAKNLSDIARLLGFTPKGLSYVLYKTGDTSNYREFFIPKKTGGTRKILAPERRLALLQSRLGDLLYGCVEELKRKDPYFWHSSNGFQKGRSTISNAKAHSRRRYVFNVDLEDFFGTINFGRVRGFFIHDRNFRIEPPAATIIAQIACHKNSLPQGSPCSPVISNMIGNILDVRLLALARNTHCTYTRYADDLTFSTNERVFPNEIAVTLEGKGWELGNKLREEIERAGFRVNDKKTRMSLRDSRQTVTGLVVNAKPNINQDYYRSARAMCNALFQTGKYHGADKQETANLNSLEGMLSYIYHVKIRRDRTHRINKLARQANEFRAPSAPIELYRRFLFYKYFIASSLPTIVTEGVSDITYIRCAIQSLTPSFPLLAEKVDKKIRLSVRFLKPSGTTRDVLNLGHGTSGQVKLISEYKNNLNHYKHKPMAHPVIILCDNDKGASNIFKEAARKSGTAIHLESEENFYHISNNLYLIKVPEGEPPAERAIEDLFMPELLAQTLDGKPFDRKKEHGDKAAFGKVMFAEYVVRPNRTSINFSKFSQLLSRIEACIKHDSAQRTS

SEQ ID NO: 839 - protein, 544 aa, unidentified
  source 1..544: note = Related to NZ_MZXU01000017.1; note = Bosea sp.
MKTITRLKGADKLDELAKLLSFTPRGLSFVVYKIDTMNKYRVFEIAKKSGGTRTIHAPEKQLALLQTRLANLLYSCVAELQQEKPKLWHASHGFQKQKTTISNANPHRRRRFVFNLDLEDFFGSINFGRVRGFFINDKNFKLNPKIATIIAQIACHRNALPQGSPCSPVISNLIGNILDLRLIALARETKCTYTRYADDLTFSTNEMLFPTEIATNPQGSTWEVGIKLHKEIEQTGFKINPRKTRMSLRRSRQTVTGLVVNSKVNIKKDYYRSARAMCNAVFSTGEYHIIDKDKNISDLRSLEGILSHIFFVKARRDRAPKTNKMAIEANEFKLPSAPVELYRKFLFYRLFVAPKAPLVVTEGISDITYIQCAIRALAKSFPALALEKDGKHTRLLSFLNPSGTTRDVLNLGHGASGQASLIMQYFGNLKKYKHKPLDHPVIILCDNDDGPKTVFKNAKSKSGLTISTSTTDQFYHLGENLYIVKVPEGNPATIKEIENLFDSKLLTEKLDGKSFDPKKEHGDPTSYGKVVFAEKIVRPNAGEG

SEQ ID NO: 840 - protein, 562 aa, unidentified
  source 1..562: note = Gammaproteobacteria bacterium; note = Related to PDSV01000021.1
MSRFQLLKDATTINDIASLLNYKAKTLSYILYVLSKQDDYYTSFEVPKKNGGVRLIQAPNKKLKQVQTNLSGLLNECVNEIIEKEPKYFYASHGFLADKTIITNANKHKKKRYVFNVDIENFFGSINFGRVMGFFMNDRHFRLDKKVATIIAQIACHENALPQGSPCSPIISNLIGNIIDIRLITLAKKHKCTYTRYADDITFSTNVKQFPTSIAKKRDETWEVGTKLSREIQKLGFNINEKKTRMSFNNSQQMVTGIVVNKKINFSQAYYRELRSQCHNLFKNGSYHVNNEVCSNLNKLQGKLAYLYFIQNNKKNIKIDKNEEANFGSGLNKLYRKFLFYKYFVASEKPVIVTEGATDIGHLKLAIDALDEKDMNLKFFNPSKTGIKLLNLGEGTGGQNKLIFNYRSMMNKLGKNMPAPFSPVILLCDNDEGASDIFKTINNKKNKFSCEISLSTTDPFYKLCHNLYLIKVPESKGAETSIEDLYEETVLDTKLGEKTFNKTNKKLGDNEYGKQYFLDYVVRKNKNSIDFSGFTPLLDRIKLCISNWESQEKSSHNSTNSH

SEQ ID NO: 841 - protein, 570 aa, unidentified
  source 1..570: note = Proteobacteria bacterium; note = Related to JAFECG010000019.1
MSTLQKLKNARTRSDLAKILGVTPSGLTYALFVIPQEAKYHKFQIPKRSGGHREISAPNSHIKLVQRRLASKLYECTKEIENAQPNRKKVTHGFQPGRSIITNADRHKNRRYVFNVDVKDFFDSINFGRVRGFFNKDREFLLDKEICTAIAQIACWENSLPQGSPCSPVISNLIGHILDVKMLKLAKESKCRYTRYADDMTFSTNEREFPSSIAIRDAQDPGKWSVSTKLEGLIKQAGFEINPQKTRMQIVGSRQLATGLVVNKKVNIKEEYCRQTRAMCNHLFKKDAYFLQNTKEGEAPKLIKNLDILEGKLCHIHAVKTRVDLTDQQKKSRKFDPPPGTLRLYKKFLFYKNFFAQERPLIITEGASDIIYLRTAIRHSKKKFPLLFDKTLQIRFLKNSKTVKEVLGLGDGCGGIGKLVATYAKEISAFGRPSAFPIIILIDNDDGSKKSIFKVAKDAAKATLKKDIEISIESNDCWHHLGDNLYLVKVPHGGSKSPKSIEELFPEKWLKFSVDGKIFDPSKKHGDHTSLGKVAFAKKVVETHAGEIDFGGFDSLFSLIEGAIADYRKN

SEQ ID NO: 842 - protein, 523 aa, unidentified
  source 1..523: note = Related to LOEV01000045.1; note = Alphaproteobacteria bacterium BRH_c36
MGLVQRRLATRLYECVLEIEEKQPNRRRVTHGFQKGRSIITNADRHHSRRYVFNIDIQDFFQSINFGRVRGFFQKDSTFALNDEVATTIAQIACWQNGLPQGSPCSPVIANLVGHILDVKLLKLAKQARCRYTRYADDISFSTSERNFPSLIAARADGKPAVWEPSENLASAIRQAGFAINPAKTRMQIRGSRQMATGLMVNEKVNIRPEYYNETRAMCHRLFTTGRYEIPRWPDRQETDQLGALEGRLSHIFAVKARLDLSSKRRKERHVKVPSGTIELCRRFLFYKNFVVNPLPVIITEGPSDVIYLRAALRARGKEFPKLYDARQEQKFLVRFVNHSHFMRENLLGHGVGGLGTLISRYHATLQEYAQEGQTAPVVLLVDNDEESDKAFKAAKKAIKEDGNGAASISVESNDAWHHLIDNLYLVKIPHGGAEQKKRVIEQLLPEEWLKHEVDGKRFDPSKKHGDHSSLGKVFFAKKVVEANADKINFGAFDALFSLLDGALRDFEDKRKQEAGGKVMAAS

SEQ ID NO: 843 - protein, 584 aa, unidentified
  source 1..584: note = Related to PAIP01000075.1; note = Parvularcula sp.
MGRLDELKAAKTRSDLAKLLHFTPKGLAYVLYKTPAADKYSIFTIPKKGGGERRIEAPEPRLKLLQTQLAAVLYDCLEEIESETPNRRSISHGYHRGRSIVTNAVPHRRHRYVLNIDLSDFFGTINFGRVRGFFIKDSNFALTDEAATTIAQIACHEGRLPQGSPCSPVISNLIARILDVRLARLAKSTGCTYTRYVDDLTFSTAQRTFPPKLAKKIATSPHKWRLMRSLRDEIKNAGFKINTAKTRMQICGSRQEATGLVINEKINISQPAYRTIRSMTHTLFSTGKYFVPGGELDPSGAPKWISELAPLEGRLAHLYFVKARRDRSEQLNKRENFKTPRAVKELYRRFLFYKYCVAPEAPLIVTEGKTDVMYLKSALKARGALHPQLASEEKGKSKRQIRFLPASYMNNTVLELGSSASQLTKLIESYSNRLKLYRHRPLSAPVIVIADNDDGVDRILKAANKRSELEVKAGTPQCMFHIVDNLYLVKTPHVGEKAKTCIEDLFSDRLKSQKVKGKPFDIKKDHGDETSYGKSRFAEEVVAKLAQAPDFAGFEPLLNAIEGAISDYSSRMMNKERSAALIGT

SEQ ID NO: 844 - protein, 565 aa, unidentified
  source 1..565: note = Related to WVQY01000005.1; note = Ruegeria atlantica
MKHLQALRDAKNIQDLANILGYKAKGLSYVLYKYPEDKKYTRFTIPKRSGEPRVISAPCKPLKLLQRRLADYLYICEKEIEEAQPHRKRLSHGFHKGRSIISNADLHRNRRYVLNVDIEDFFGTINFGRVRGFFIKDKNFLLNDKVATILAQIACHANALPQGSPCSPVISNLVGRIMDVRLAQLAKSCYCTYSRYADDLTFSTNKSGFPEQLAIMKADSDGSWGVGKALQNEVERAGFKVNNSKTRLQFRSSRQSVTGLVTNKKVNVSKEFWRNARSMSFQLFSTGKYNCQHKQPNVPTTSLAPLTGVLAHIYQVKSRRDLDETQIEERSFSAPKGHETLYRKFLDFKYFVALDKPVLLTEGPTDIVYLREAIKSRAAKFPSLYSGGEHQLKFLRPTDTVKELLSVGTGFGDLLGLMSEYEERVAKFPYCPLSHPVIMLLDNDDATSALSKMKYLKRKKIVIKTSSTADYYHIAKNLYVVKTPEGSPTNETCIEDCFDAATRGVTIDGKPFDPNKKHGDHSSFGKQVFAERVVKPNSSTIDFTGFDPLLDRITKVVSGYVPPAP

SEQ ID NO: 845 - protein, 584 aa, unidentified
  source 1..584: note = Related to NZ_FOSL01000011.1; note = Mesorhizobium albiziae
MSELNNLKAAKTLPQFAHLLKLKSETVSYALYWYRRRSPYSHFTISKKNGGRRHIAAPNSRLKLVQSRLAELLGRIETEMEMKRTTKVRVLSHGFKKGFSIITNANQHRNKRWVFNVDIRDFFPSINFGRVYGFFVKDRNFQLDPKIATIIAQIACYQNRLPQGSPCSPVVSNLITHILDIKLNKLANDLHCTYTRYADDLTFSTNEKEFPEQIARLVRGNDDKWVAGDGLLYLVYRAGFQLNHEKTRMQRRDSRQDTTGLIVNQKLNVRHEYYKQVRAMCHHLFNHGFAFSDPGKVPVSNHTVEGMLSFIYQIRRIRSQNLVVEKEPERNSFFQTDQAGFTELYRRFLNYRSFYGMIKPTIICEGKTDNIYLLAAIRKLAPKFPKLIDPAQKLPLKVQFFNYSHRSALFQGLSGGGDEMYKLIKDFRERMKFFKHVPTQPVIMIIDNDAASTGIFTYVGTVHGTGPVSGLDPFYHVFENLYIVPVPTTAGVKAVIEDLFDPVVKKPISGRTFNSSNKSFDQTKFYGKNEFATKIVAPERATIDFTKFEPLLQAICDVMDHFAATLAAKSIVLPAPVVVAEAAP

SEQ ID NO: 846 - protein, 359 aa, unidentified
  source 1..359: note = Related to JAHRFK010000006.1; note = Hoeflea sp.
MSELSNLKATKTLPQFARILDLDGQTVSYALYWYKRRNPYEHFTIPKKNGGVRHIAAPNSRLKVVQSRLAELLGRIESEMELKRTTKARVLSHGFKKGFSIITNANQHRNKRWVFNVDIRDFFPSINFGRVYGFFLKDRNFQLDPKIATIIAQIACYQNELPQGSPCSPVISNLITHILDIKLNKLANELHCTYTRYADDLTFSTNEKEFPERIARLVRGSDDKWVAGDGLSYLIYRAGFQLNHEKTRMQRRDSRQDTTGLIVNQKLNVRHEYYKQVRAMCHHLFNHGFAYSGPSKVPVSNHTLEGMLSFIYQIRRIKKPELLFGACPVGRRFRPEHDRHKFSKCRRIFGSDEIKCQRT

SEQ ID NO: 847 - protein, 582 aa, unidentified
  source 1..582: note = Related to JAIUHW010000003.1; note = Mesorhizobium sp.
MSELSNLRDVTTLPQLARLLDFPAENLSFALYWHRRRRPYHHFTIAKKNGGRRVIAAPNGKLKFVQGRLADLLGRIESEMELKRTTRSRVLSHGFKKTFSIITNANQHRNRRWVFNADIKDFFPSINFGRVYGFFLKDNNFELHPKIATIIAQIACYQNQLPQGSPCSPVISNLITHILDIKLNRLANDLHCTYTRYADDITFSTNEKEFPERIARLVRGSDDKWVAGDGLLHLLYRAGFQINHDKTRMQRRDSRQDTTGLIVNQKLNVRHEYYKQVRAMCHHLFKEGFAYSEPSRIPVSNHTLEGMLSFIYQIRRLRSLSIVVEDEIERNTFFKRDQPGFTELYGRFLNYRSFYGMIKPTIICEGKTDNIYLLAAIKKLAPKFLKLIDPIQKVPMKVQFFNYSHQSALFQSLSGGGDEMYKLMKEFKERIEFFKHGLSHPVIMVIDNDKASKGIFSYIGTVHGTGPVSGLDPFYYVYENLYVVPVPTTADVTAIIEDLFDPSVKRPINGRTFSDSNKKFDLTKHYGKNEFATTIVAPERDTIDFTKFEPMLQAICDVMDHFAAILAAKPEAAVPPLAATGT

SEQ ID NO: 848 - protein, 579 aa, unidentified
  source 1..579: note = Related to NZ_JACIFL010000022.1; note = Rhizobium sp.
MSELSNLKAAKTLPQLARLLNLNGETLSYALYWYRRSAPYTYFTVAKKSGGRRAIAAPNSRLKLVQSRLGQLLARIETDMELKRTTKSRVLSHGFKAGFSIVTNAKHHRNKRWVFNVDLKEFFPSINFGRVYGFFLKDRNFELDPKIATIIAQIACHDNKLPQGSPCSPVISNLIAHILDIKLNKLANDLHCTYTRYADDLTFSTNEKHFPEAIARLVRGSDDKWVAGDGLLNLIYRAGFQLNHEKTRMQHRDSRQDATGLVVNQKVNVRHEYYKQARAMCHHLFTNGYAYSRTEFAPVSNDAVEGMMNFIYQIRAVRSPDFTATDPRGFFKSDQPGFSELYGRLLNYCSFYGMLRPTIICEGKTDNIYLLAAIKQLAAKFPQLIDPAQKVPMKVQFFNYSERTALFQGLSGGGDEMYKLMKEFRERMRFFKHGPSKPVIMVVDNDDASKGIFSYIGTVMGTGPVSGLDPFYYVFENLYVVPVPKVAGTSAIIEDLFDAAVKKPINGRIFNSSNKKFDLTKYYGKNELATKIVAPERSSIDFTKFEPMLQSFADIIMDYGARLAAKPAMVPVKNAVAGP

SEQ ID NO: 849 - protein, 571 aa, unidentified
  source 1..571: note = Related to NZ_WPHT01000004.1; note = Agrobacterium vitis
MSDLTALRNARNLPQLARLLKLKGEYVSHSLYWYQQQKPYSHFTIPKKGGGKRSIEAPNSRLKLLQRRLAELLMRIEAEMEGQRTTKARVLAHGFKPNFSIMTNAALHRNKRWVFNMDLKDFFHTINFGRVYGFLLKNRNFALAPKTAAVISQIACYRNHLPQGSPCSPVISNFIAHVLDIKLNKLANKLRCTYTRYADDITFSTNEKEFPEDIARLVRGSDDKWVVGDKVLREVYRAGFKINHDKTRMQRRDSRQDTTGLIVNQKLNVRHEYYKQARAMCHHLFVHGYAHSGTDRGSVPIKNEVVEGMLGFIHQIRSLKNAEFFKADQPGFSSLYGKFLDYQSFYGILRPRIIGEGKTDNIYIKSAIKSLAAKFPALVDATEPLTTAVDFFRYNKRSSIFQDLSGGTGEMNKLLASYRHRMASFKHIARHPVIMVVDNDSGSASLFNYVSKVLGTPIGGLDPYYHVFENLYLVPIPKTSGHVAIEDLFDAALLAETIDSRTFERRNNKFDSTKFYGKNEFATKIVAPKRATIDFSKFEPLLQAFVDIMADYEKRHAAAIVAARPPVVAAA

SEQ ID NO: 850 - protein, 571 aa, unidentified
  source 1..571: note = Related to JAAMEU010000005.1; note = Agrobacterium rhizogenes
MSDLSALRNATTLPRLARLLKLKGEYLSHSLYWYRQSNPYATFSILKKGGGRRLIEAPNSRLKLVQSRLADLLMRIEAEMENKRTTKARVLAHGFKPGYSIMTNAALHRNKRWVFNIDLKDFFHSINFGRVYGFLLKDRNFELAPKTAAVIAQIACHNNRLPQGSPCSPVISNLIAHVLDLKLNKLANAHRCTYTRYADDITFSTNEKEFPEAVARLIRGSEDKWVAGDKILREVYRAGFKINHDKSRMQRRDSRQDTTGLIVNQKLNVRHEYYKQVRAMCHHLFVHGYAHSGLGAGRDPVKNESVDGMLGFIHQVRSLKNAGFFKTDQPGFSSLYGKFLDYQAFYGILRPRIIGEGKTDNIYIRSAIKRLAGKFPSLIEPSSPLAEAVDFFHYNTRSALFQDLSGGTDEMHKLLSSYRARTSSFKHIARHPVIMVVDNDAASAKIFAHLSNILGTAVGGMDPFYHVYENLYLAPIPKTTGHVAVEDLFDATVLAQTINGRTFNPSNKKFDQSVYYGKNEFATKIVAPQRATIDFTKFEPLLAAFVDIMADYEKRYAGALAALKGGIAAAA

SEQ ID NO: 851 - protein, 571 aa, unidentified
  source 1..571: note = Related to NZ_ANNO01000019.1; note = Pseudochrobactrum sp.
MSDLSALRNTKNLPQLARLLKLKGEFVSHTLYWYRPNTPYSCFTIPKKNGGRRLIEAPNSRLKLLQSRLANLLMRIESEMEGKRTTKARVLAHGFKPGFSIITNAALHRNKRWVFNIDLKDFFHSINFGRVYGFLIKDRNFELAPKTAAIIAQIACHKNHLPQGSPCSPVISNLITHLLDIKLNKLANKLHCTYTRYADDITFSTNEKEFPAAIARLVRGSHDKWVAGDAVLREVYRAGFKVNHDKSRMQRRDSRQDTTGLIVNQKLNVRHEYYRQARAMCHHLFVHGYAYNGADTRNNPIKNETLDGMLGFIHQVRSLKNAEFFKEDQPGFSSLYGKFLDYQAFYGILRPRIIGEGKTDNIYIRSAIKSLAAKFPSLVNPSIPATAALDFFHYNTRSALFQGLSGGTDEMHKLLSSYRSRISSFKHIARHPVIMVVDNDAASTKIFAHLSNILGYPVNGMEPFYHVYENLYLAPVPKTTGHVAIEDLFDASVRAQQIDGRSFNPSNKKFDLSIYYGKNEFATKVVSPHRATIDFSQFEPLLTAFVEIIADYNKRYAAILGAAKGDVLSAA

SEQ ID NO: 852 - protein, 572 aa, unidentified
  source 1..572: note = Related to NZ_AP023262.1; note = Mesorhizobium sp.
MSELSELKSATTLPQLARLLKLKGETVSYALYWYRRANPYDYFEIPKKNGGRRLIAAPNSRLKLVQTRLAGLLGRIEAELEGKRATKARVVSHGFKTGFSIVTNAAHHRNRRWVFNADLQDFFPSINFGRVYGFFIKDRNFQLDPKIATIIAQIACHNNKLPQGSPCSPVISNLIAHILDIQLNKMASKHHCTYTRYADDLTFSTNEKEFPEAVARLVRGSRDKWTAGDGILRLVYRAGFKVNHEKSRMQKRDSRQDTTGLIVNQKLNVRHEYYKQSRAMCRHLFQHGWAHTGTKRGERPVSNDSLDGMLSFIYQIRRIKNDAFFTDDQPGFSKLFGYFLDYQSFYGIVRPRIICEGKTDNIYLRAAIKSLHLKFPRLVDATPKFSLLVDFFHYNSRTARFQDLSGGGDEMNKLLSSYRQRMKPFKHGASQPVIMVVDNDSGSTKIFNHLTNILGKPIDGSDPFYYVYENLYVVPIRKVAGASTAIEDLFDGSVLAEKIGVREFNRSNKKFDQTKFYGKNEFATEIIAPKRATIDFSRFEPLQKACCDVVDHYQVLSKAAPIPTPVQVAALP

SEQ ID NO: 853 - protein, 580 aa, unidentified
  source 1..580: note = Related to JAJGNB010000034.1; note = Aurantimonas coralicida
MANEYPQATSPISELAQLRSVNTLTHLAHLMGLEGWTLSHALYQQGQKRGYTYFSIPKKRGGFRQIAAPNSRLKMVQSKLAGLLSRIEAEMEGKRARQQCILSHGFKPGYSIITNAAQHRNKRYVFNADLKEFFPSINFGRVRGFFIHDKNFQLNHKIATIIAQIACHNNQLPQGSPCSPVISNLIAHMLDVKLNKVARRSRCTYTRYADDLTFSTNEKEFPTEIARLVRGAHDKWVPGNSVVRSVYKAGFTLNELKTRMQYRDSRQDATGLIVNEKLNVPHEYYKLARARCRHLFRNGYAYDQHSGTEISDEAVEGMMSYIYQIRRARTEDFWKEQSGFAKLYKQLLDHRSFWGITKPRIVCEGKTDNIYLRAALQSLAAKFPELYEAGAEPQDRLKVCFFNHTKRAEIFQIGSGGSELAKLVGAYKSRTKSFEAGMPPHPVIVVADNDSGSTGLFSAMSKILGTSVGGENLRYYLGDNLYVVPIPKKNGHTAIEDLFDNQVLDEKIDGRSFDRKGKQADKTKWYGKNEFATKIVHAKRHELDFAGFEAVLTAFSEVIVDYERKKKEIAGAKAALKVAA

SEQ ID NO: 854 - protein, 574 aa, unidentified
  source 1..574: note = Related to NZ_VFVY01000001.1; note = Mesorhizobium sp.
MSELEKLKSCSTLPQLAHLLGIKGETLSSVLYWLKPSQKYVHFTVPKKNGTRRLIAAPTDRLKYVQGQLAELLSKIEAELEGRRTTKYCVLSHGFKKGFSIVTNADVHRNRRHVFNADLRDFFPSINFGRVYGFFQKDRNFHLSPKIATIIAQIACHDNQLPQGSPCSPVISNLIAHVLDIKLNKIASAGRCSYTRYADDLTFSTNEREFPASIARLVRGSHDKWVAGDLLLERVYRSGFSLNEAKTRMQHRDSRQDATGLIVNQKLNVPNEYYKLARSMCHQLFTDGYCYVGPDRAYVPDAKLEGMLAFIYQIRKIKIENFKADQAGFSKLYGRFLDYRSFYGLAQPRIICEGKTDNVYIRSALKALAVKYPSLIDPGKKPPLKVDLFNYTKRAATFQDLSGGSDELKKLINNYATRTARFKHGAPHPVLVIVDNDAGSVGIFQMLTKLLGKPIGGLDPFYHVIENLYVVPIPKVATPVAIEDLFDPALLARKIDGKDFDRTGKEKDGSKWYGKNEFATKIVAPERGTIKFDGFEPLLNAVVDAIQHYEGVKAAAAAKAAALKAAKPAVVAIP

SEQ ID NO: 855 - protein, 567 aa, unidentified
  source 1..567: note = Related to NWTG01000019.1; note = Bradyrhizobium sp.
MTKLSQLRGAKTLPQLARVIGVQPHGLSYALYWLTEDQKYESFTIPKRGGGRRIITAPKNYLKVIQTKLAKLLLDIHIELEGSRSKSQCRLSHGFKRGYSIVTNAAAHRNKRYVFNADLKDFFPSINFGRVLGFLTRDRNFALEPKVATIIAQIACHNNQLPQGSPCSPVISNLIAHVLDIHLNRIARNANCTYTRYVDDLTFSTNEKEFPPSIARLVSGNTSAWVPGDSLIRYVYRSGFKLNHDKTRMQRRDSRQDATGLIVNKKVNVRNEYYKAARAKCHHLFQHGFCYSDHDKTALSDAALEGTMSFIYHIRRLKTVDWKLEQKSFYQLYRQFLDYRAFYGLTRPRIICEGKTDNIYLRCAIGALSAKFPQFIHPDPKAGLNIDFFYYTDTSATFQDLSGGTGELNKLLGSYRARASSFKHGPTQPVFMVVDNDSGSNGLFRHLAGILGKPVGGMDPFYHVFDNLYVVPIPKAGVAAAIEDLFEAVLLTRTINGRAFDRTGKQKDLSKWYSKFDFATQIVKPERAKINFAGFEPLLQAISDARKDFASRVSAGAAAAAVKAAAA

SEQ ID NO: 856 - protein, 564 aa, unidentified
  source 1..564: note = Related to JAGKJI010000032.1; note = Bradyrhizobium sp.
MTKLSQLRGARTLPQLARVLGVKPASLSFVLYWLADDQKYETFTIPKKGGGRRLITAPKPRLKMIQTKLADLLLDIHVELESARSRVQCQLAHGFKPDFSIVTNATAHRNKRYVFNADLKDFFPSINFGRVLGFFTKDHNFSLEPKVATVIAQIACHNNQLPQGSPCSPVISNLIAHVLDIHLSKVARAGRCTYTRYVDDLTFSTNEKEFPASVARLVSGRSDAWVPGDSLVKHVYRSGFKLNYDKTRMQRRGSRQDATGLIVNKKVNVRNEYYKIARAKCHHLFLNGFSYSDKDKKAISDNALEGTMSFIYHIRRLKTVDWQREQQSFYKLYRQFLDYRAFHGLLRPRIICEGKTDNIYIRSAIKALGAKFPEFIHSDPSKGLTVDFFNYTEAAVIFQDLSGGTGELKKLLTSYRPRLSSFKHAAPQPVIMIVDNDKGSTGLFHQLAHIIGKPVGGVDPFYHVLDNLYVVPVPKTGTEAAIEDLFDSALLKKTIKGRSFDRTGKAKDFTKWYSKVDFATQIVKPERSTIDFSGFEPLLKAILDVRKDFSLRPPVATAVARAAE

SEQ ID NO: 857 - protein, 572 aa, unidentified
  source 1..572: note = Related to NZ_CP086136.1; note = Bradyrhizobium sp.
MTQLARLRGVKTLPQLARVLGVQPASLSFVLYWLPDQQKYEQFTIPKKGGGWRLITAPKPRLKMIQTKLADLLLDIHVELEQSRSRSQCQLAHGFKRGLSIVTNATAHRNKRFVFNADLKDFFPSINFGRVRGFFQWDNNFSLDPKVATIIAQIACRDNQLPQGSPCSPVISNLIAHILDIHLNRLARAGRCTYTRYVDDITFSTNEKEFPSSIARLVRGSTDKWVPGDSLVKRVYSSGYSLNYDKTRMQRRDSRQDTTGLIVNKKVNVRNEYYKTARAKCDHLFKNGFCFSDKDRKPIFDDALDGTMGFIRQIRGLKTKDWQSEQNSFFKLYRQFLDYRAFHGITRPKIICEGKTDNIYLRCAFQRLRARFPAFIHPDPLVGLTVDLFNYTEAAATFQDLSGGTNDLSKLLSHYAARVSPFKLSPDQPVIMIVDNDKGSADLFRKLTKMLGRVVGGLDPFYYVCANLYVVPVPKGITTLEAAIEDLFEPALLARTIKGKNFDRTGKEKDRSKWYSKVEFATEVVKPERATINFSGFEPLLQAISDACKDFTGRRAAPSKPLPSASASAGSP

SEQ ID NO: 858 - protein, 491 aa, unidentified
  source 1..491: note = Related to RPJW01000006.1; note = Sinorhizobium medicae
MGRQWLKSYRYLTIANEYPRALPPIVTQSASRLSNVKSLDQLAAVLEEQTKVLSYWLYKAEPSKKYLEYSIPKKNGGWRHITAPKDGLKRIQGKLARLLAEIYNDIEQRRSNGSFDSSRASESVLAHGFKDKYSIITNARVHVGKRYVFNTDLEDFFPSITFGRVRAFFIADNNFRLSPPVATMIAQLACYRNQLPQGAPTSPIISNFIAHILDIKLNKMARAGNCSYTRYADDLTFSTNEARFPSAIARLVAGTTDRWVAGDGLLGRVYASGFRVNHDKSRMQLPKSRQEATGLTVNQNVNVASTYYKLARSMCDHLFTGGTCFETIDGKWVEFPAHKLQGRMDFIYSVRRSRIGISLDHVSKKQHPIAYREREAEFCKRQSSFTKLYRNLLNYQSFHGMEKPVIVGEGITDGLYIRAAIQSTGGLFPKLYDPTGDGEVLVSFYRHSDKKNLSNWGGRFATQAVHHRVYEVDGAVQNKAKAARNSYRRQR

SEQ ID NO: 859 - protein, 570 aa, unidentified
  source 1..570: note = Related to JAAMCX010000003.1; note = Agrobacterium rhizogenes
MLEEQTKVLSYWLYKAEPSKKYFEYSIPKRNGGWRQITAPKDGLKRIQGKLARLLAEIYNDLEQRRLNAEFDSSRVSDCVLSHGFKDKYSIITNARVHVGKRYVFNADLEDFFPSITFGRVRAFFIADNNFRLNPSVATMIAQLVCHRNQLPQGAPSSPIISNFIGHMLDIKLNKMAKVGNCSYTRYADDLTFSTNETRFPSAIARLVVGTADRWVAGDGLLARVYASGFRVNHDKTRMQLPKSRQEATGLTVNQNVNVASTYYKRARSMCDHLFTGGTCFEMIDGKWIEFPVSKLQGRMDFIYSVRRSRLRMSLDHVSKKQHAIAYRERETEFCKQQRSFTTLYRNLLNYQSFHGMEKPIIVGEGITDGLYIRAAIKTIGASFPKLYDATGDGGVLVSFYKHSDKRKFYQIGEGASQLKPFITEYTKLMDAFKTRPKQPVILIVDNDDEGQSVLNVAGNRWKKDVKTATPFYHLVSNLYIIPIPAKTGLISTAIEDLFDAAWLAAQDIGGRKFTKDNDFNSATHFGKAELLGQIVRPSRATINWTNFQTLLQGIQGAILDYEVKLAVSP

SEQ ID NO: 860 - protein, 627 aa, unidentified
  source 1..627: note = Related to NZ_VDMN01000001.1; note = Rhizobium smilacinae
MVDYAVTVNAEYSTDRYTVKSYRHLTVANEYPRALPPIVTQSVSRLRNVKSLDQLAAVLKEQTKVLSFWLYKAAPHQKYVDYQIPKKNGGWRHITAPKDGLKRIQGKLARLLSEIYNDLEQRRIDPAFDGSHPSSCVLAHGFKDKYSITTNATVHVKKRYVFNADLEDFFPSISFGRVRAFFVADQNFKLDPAIATMIAQLVCFRNQLPQGAPTSPVISNFIGHILDVQLNKLAANGNCSYTRYADDLTFSTNEKAFSPAIARLVSGTTDRWVAGDGLVGRVYASGFRINHDKSRMQLPKSRQDVTGLTVNQAVNVSATYYKLARSMCDHLFTGGTCHEKINGEWHRFPAYKLQGRMDFIYSIRRSRLKVSIDYLPKKQQPVAFREREAEFCKQQKSFTTLYRHLLNYRSFHGMEKPVIVGEGITDGLYISAAIKSLGALFPTLFDAGGDGEVKASFYKHTDKRKFYQIGEGASNLKPFITEYTKIMEPFKTIPRHPVIIVVDNDDEGRAVLSVAGNRWKKDLKTTAAFYHLVSNLYIIKIPFGSSASSSAIEDLFDSAWLSAQDIGGRKFSKDNDFDSATHFGKADLVGQIVRPKRTTIDWAGFVPLLAAIEGAIIDYDSKLNSVP

SEQ ID NO: 861 - protein, 592 aa, unidentified
  source 1..592: note = Related to JACVAS010000003.1; note = Ensifer sp.
MPPIVTQSSSRLSNVKSLDQLAAVLGEQTKVLSYWLYKAEPARKYEQYSIPKKSGGWRHISAPRDGLKRIQGKLSRLLAEIYNDREQRRVNGSFDGSRTSPYVLAHGFKDKYSIITNAQMHVGKRFVFNTDLEDFFPSISFGRVRSFFRLDTDFRLDPAVATMIAQLTCFRNQLPQGAPTSPIISNFIGHMLDIKLNKMARKGNCSYTRYADDLTFSTNEESFPPAIARLVAGTTDEWVAGDGLLARVYASGFRVNHDKSRMQVASSRQDATGLTVNRTVNVSATYYKLARAMCDHLFTGGTCHEMKGGKWTVLPPHRLQGRLDFIYSVRRSRLKIPLDHVAKKQFPIEYMKREALFCDQQKAFSTLYKNMMNYMTFHGIEKPMIVGEGITDGLYIRAAIKTVGPAYPKLYHPSGDGEVLVNFYKHTDKRKFYQIGEGAAPLRSFIAEYPKLMGRFKTKPKQPVILIVDNDKEGRDVLKAAGSRWQKDTSVPSPFYHLVSNLYIIPLPKPGATDVCIEDLFDQTWLAAQNIGARKFTKKNDFDSATYFGKADLVGQIVRPQRATIDWSGFVPLLEAVQGAISDYEVKLSLTP

SEQ ID NO: 862 - protein, 600 aa, unidentified
  source 1..600: note = Related to SADI02000019.1; note = Mesorhizobium sp.
MAYEYPRALPPITTQSVSRLRNAHSRAQLAAILGEQSKVLSYWLYKADLSTKYTQYSIPKKNGGWRYITAPQNGLKRIQTKLARLLADIYNDIEQRRLNESFDGVTVSECVLSHGFKDSYSIITNAKVHVGKNFVFNSDLENFFPSISFGRVRGFFINDRNFRLHEDVATAIAQIACYQNQLPQGAPCSPIISNFIAHMLDIKLNKMAKKGNCSYTRYADDLTFSTNEKHFPAEIARLVAGTTDRWVAGNGLISRVYASGFRINHDKSRMQLPMSRQETTGLTVNQKVNVPATYYKAARSMCDRLFKEGYCFEIVSGKWVEVPSVKLQGRMDFIHSVRMGRLGISLDHLPKKRFPTAYRDRENIFRGQQKAFSSIYEKLLNYRSFHEMVKPIIVGEGITDGLYINAAIRTIGGLYPRLFDPAGNGTLLVDFYKHSDKRKIYQIGEGAKPLGAFVKDYAKLMEPFKAKPSNPVIVVIDNDKEGREVLTAIGKRWGKTIDGKSSFYHLVSNLYVVPVPATGGVLTSIEDLFDSTWLAAQDISGRKFTKDNDFDSSTHFGKTQFAGQIVRPKRASIKWDGFKPLLQGIQDTILDFELQSSPGT

SEQ ID NO: 863 - protein, 566 aa, unidentified
  source 1..566: note = Related to VCHT01000005.1; note = Rhizobium sp.
MSKLDALKQAKSLSDLAYILGEQPKVLSYVLYMIPSTLKYTPFLIPKKSGGTRTIQAPIDRLKRIQRALADLLQDIQEEISTKRKVDKRHAVSHGFKRKLSIITNARNHRNKTYVFNSDLENFFPSINFGRVYGFFVHNETFSLDPKVATVIAQIACHDNSLPQGSPCSPIISDYIGHILDMRLSRLASRHRCTYTRYVDDLSFSTSQPNFPKEIAYQHEGDHKWLAGDALVKNVFKTGFKLNHAKTRVQYKLSRQEATGLIVNRKVGVPTEFYHLTRAMCHSLFNQGFAFVVKDGIAQPVSDAVVRGRLSYIHHVRSMQNTLEKGPSLQGTAPFRLYQRYLNFKSFYGISQPVIIGEGVTDTIYLKAALNQLAGKFPNLIDVGHGTKEHKLTFFKYGKSSRELMGLSGGTGELKNLLGDYRKRISGFKFGGANPVIILVDNDDGAEKFFKTLGSMTKTKVTGTDPFYYVYANLYAVPIPPTGGPVAAIEGLFDPSLLNIPHEGKKLDLTNKETDGTKFYSKHTFAKSVVRPNQDKIDFTGFEPLLLAIEQVIADFAGRLAAGTAP

SEQ ID NO: 864 - protein, 567 aa, unidentified
  source 1..567: note = Related to CP050308.1; note = Rhizobium lusitanum
MSKLEALKKAKSLSDLASILGEQPRVLSFILYKIPSNLKYKSFEITKKSGGKRTIHAPVARLKRIQRSLADLLQDIQDEIKIQRKVNDNCVVSHGFKRKLSIITNARNHRNKTYVFNSDLKDFFPSINFGRVYGFFVRNQEFALDPKVATVIAQIACQGNSLPQGSPCSPIISDFIGHILDMRLSRMAARHRCTYTRYVDDLSFSTNKRSFPKAIAYQNEDNSHEWLAGDALLKNVFKSGFKLNNAKTRVQYKSSRQEATGLIVNKKVAVPTEFYHTTRAMCHNLFKDGFAFIVKDGTPKPISDAVLRGRLSYIHHVRSTQNKLENGPPLKTTAPFKLYQQYLNYISFFGSSMPVIIGEGVTDTIYLKAALNQLAAKYPNLITVVDKKKEHKLQFFKYSNSSRELMGLSGGTGELKNLLGEYRKRISGFKFGGTQPVIILVDNDDGAKAFFSTLGSITKTKVSGTDPFYYVYANLYAVPIPPTGNPVTAIEGLFEPALLNTIYDGKKLDLTNKEPDGSKFYSKHTFAKNVVRPNQDKIDFKGFEPLLTAIDHVMADYAARLVAGTAP

SEQ ID NO: 865 - protein, 567 aa, unidentified
  source 1..567: note = Related to NZ_KZ857258.1; note = Rhizobium grahamii
MSKLEALKKAQSLSDLACILEEQPKVLSYVLYKIPTNSKYKAFQIPKKSGGTRTIQAPVDRLKRIQKSLASLLQDIHLEIQKKRGVKANCIVSHGFKPKLSIITNARNHRNKTYVFNSDLKDFFPSINFGRVYGFFVKNEDFALDPKVATVIAQLACHGNSLPQGSPCSPIISDLIGHILDMRLSKVATRYRCTYTRYVDDLTFSTNESTFPKAIAYEDKDNQHKWVAGDALLKSVFKSGFKLNDAKTRVQYQSSRQEATGLIVNRKVAVPTEYYHATRAMCHNLFKEGFAFTVKDGVAKPVSDAVLRGRLSYIHHVRSMQNKLENGPSLKLTAPFKLYQQYLNYVSFFGISKPVIIGEGITDTIYLKAALNQLAGKFPSLVEVAGGENVHKLGFFKYGNSSRELMGLSGGTGELKNLLGEYRKRISGFKFGGAHPVIILVDNDDGAKAFFSTLGTITKTKVSGTDAFYYVYANLYAVPIPPTGNSVAAIEGLFDPTLLKTIYDGRQLDLTNKEPDGSKFYSKHIFAKSVVRPNQDKIDFKGFEPLLTAIDQVITDYAARRAARSAP

SEQ ID NO: 866 - protein, 569 aa, unidentified
  source 1..569: note = Related to JACIGM010000003.1; note = Rhizobium mongolense
MSFELVALKNAVDLTDVAVLLGVKPKDLSYALYIQPSSAKYRAFEIPKKGGGFRLITAPEPRLRSIQRRLADLLLTIQQELEVQRTKSKGIVAAHGFKKSLSIITNARCHRGKSFVFNGDLKDFFPSMNFGRVYGFFLKNRDFELHPKVATVLAQIACFENRLPQGSPCSPVISNFIAGILDRHLSKLAAENRCTYTRYADDLTFSTNEAIFPEQVARLVRGANDKWVAGYELAGRVARSGFQINELKTRLQYRNSRQDVTGLVVNEKLNVPSEYYKLARAMCHHLFKDGTAFRTIDGIKIPVSDERVRGILSHIHHVRTSQGGPKHPPGDPKAPGHQKLYRRFLDYVSFFGHQQPTIICEGKTDNVYIKTAMQMLAPKFPDLVEVAGNKFDLKVKFFKYGRASAQIQNLGGGSGALKTLLMEYEKRLKGFAGTASQPVIMVLDVDKGTTQIWSEISKILGTAVAGHGPDPFYHVRNNLYVVPIPAKPGVETCIEDLFDAKTLAIPHDGKVFDKESDKDKPGTYSKNTFANQVVRENRHSIDFSGFEPLLEAINAAIKNYSTKVAAMTA

SEQ ID NO: 867 - protein, 560 aa, unidentified
  source 1..560: note = Related to SIOG01000001.1; note = Rhizobium leguminosarum
MSPELKLLKAANGLSDVASLLNVRPADLSYALYILPNEVKYRTFQIPKKGGGFRVIAAPESRLRYIQKQLADLLVAIELGLEAGRTQRKFIVSHGFKKKMSIVTNAKNHRNKEFVFNSDLKDFFPSINFGRVIGFFVKNRDFGLKPKVATVLAQIACFNNKLPQGSPCSPVISNLIAGILDRHLSKMAVQHRCTYTRYADDLTFSTNERVFPEAIARRVRGAEDKWVAGHELVGRVARSGFQVNELKTRLQYRSSRQDTTGLVVNEKLNVPAEYYKLTRAMCFHLFRDGTAFAVDDNARMPISDERLRGRLAHLYHIRGLENGHKKYPQKKGPAYVKLYGKFLDYIAFYGHQRPTIICEGKTDNIYIKTAIQMLAPKFPELVDVVGAEYKLKVKFFKYGKASSNLQDLSGGAGQLKTLIMDYGNRLSGFTSGAKNPVIMVLDVDKGTTQIWAELSKILGKSVAGHDPYYHVRDNLYVVPVPVSSGAEGDMEDLFDKKTLELEYDQKKFDKKSDKDMPGTYSKNTFANHVIRDNRATIDFSGFEPLLKSIRDVIADYAAKI

SEQ ID NO: 868 - protein, 575 aa, unidentified
  source 1..575: note = Related to NZ_JABEPP010000002.1; note = Enterovirga sp.
MSVESLLLLRLRACTDLSSVARVLGLTPAVLSFVLYKIPTQARYRTFSIAKRAGGSRAIMAPNERLKMVQRRLASVLLQIQTEQERSRTKKACILSHGFKRELSILTNARNHRNKRFVFNLDLEDFFPTFNFGRVRGFFMRDQNFQLHPAAATVLAQIACHNNHLPQGSPCSPVISNLLAHMLDLRLNKIARRHKCTYTRYADDLTFSTNKKDFPEVIGATSPGDPNKWSAGNDLLASVYLSGHKINHSKTRMQYRDSRQETTGLVVNRKINVSVDYYKLVRAMCDRLFASGIAFRQDKNKIEPVSRSHLQGKLAFIYHIRGQETSHRKLQKKDQPGYYRLYSQFLDYCNLYDVDRPTIICEGKTDNVYIRSAIEALSSKVPGLLDSEKKLTVRLFKYTKITSTIQDLAGGTDQLKKLVREYANRTQMFKTTPSHPLILVTDVDKGSTEFFKAVSAILGTTVAGADPFYHLIKNLYVVPVPKIKHPETAIEDLFDDTLLNEKVDGKSFDRTNKEKDGTKFYGKHVFATRVVWPNRSTINFARFEPLLRAFEDVKSHYKTLTSTSVKSPAPIAAAA

SEQ ID NO: 869 - protein, 573 aa, unidentified
  source 1..573: note = Related to NZ_LSKN01000098.1; note = Methylobacterium sp.
MPAASPELQRLKKATDLHGVAALLNVKPSRLSYALYYMPPATKYRSFTVPKKRGGTRTISAPHGGLKYIQKQLATLLLSIEKELEGDRRKNSILAHGFKKELSIITNAIRHRNKRWVFNIDLRDFFPSINFGRVRGFFIANNQFALTPKTSTILAQLACHDNVLPQGSPCSPPISNLIARSLDYRLNRLARECNCTYTRYADDITFSTNEPEFPERIAVLAGPHAWQPSEELASRIVSSGFEINPDKTRMQYRDSRQDTTGLIVNRHLNVPVEYWKQTRAMCHRLFVDGQAYRVFDGEKEPISLDSLRGRLNFIYYIRSLTLGKANLEKPKGIPGYRKIFARFLNYNAFWSIEKPVIVCEGKTDGIYLRSAIRSLHAKFPDFFETVDGKVKIRPTFFKYTTNTREVQDLSGGNGQLKNLVAQYAHRTKGFKGTPKAPVIIVTDCDKGAVHLFEEVSKILGRTVAGADPFYYLHTNLYVVPIPKLGLPETAIEDLFDKTLLDTKIDGKTFDKTNHEKDGAKFYSKFTFATKVIAASKVPVDYSGFEPLLQAMLDVEADFAARLATVPPTVLPAH

SEQ ID NO: 870 - protein, 582 aa, unidentified
  source 1..582: note = Related to JAAXSB010000004.1; note = Rhizobium laguerreae
MSVSSLDLGRLKRAATLTDLAAVLGVEASTLSFALYIMPVHERYHTFTVPKKRGGERIINAPNERLKFIQKKLADILLRIERDLEAPLREAANNGAKKLPILSHGFKKELSIVTNAHKHKNRRFVFNLDLADFFPSLNFGRVRGFFLHNNHFQLPEKVATLLAQIACFQNELPQGSPCSPPIANLIANILDVRLNALARSCQCSYTRYADDITFSTNNKEFPSHIAAQNSDGHWVPSDKLISRISASGFRINESKTRMQFRDSRQEATGLIVNRKLNVPVEYYKETRALCHYLFHGRVPVLKIEGGSIPVTTSSLRGRLNHIFHIRGIETGHKKPEKSKYPGYFKLYAQFLDYVSFWGIEQPTIICEGKTDNIYLKNAMRALKPTFPHFWKFVDGKEQQTINFFKYTKCSNIIQDLSGGNGQLKNLVHEFEKRTRKFRSLPKAPVIIITDVDKGATDLFKAMKKILGYTVDGDKSWYYLRDNLYIVPVPKGGRAEVAIEDLFDPALLEVELEGKKFDRTNHESDGEKVYSKFTFATKVVAARRDEIDFGRFQPLLQAILDVQADYAQKIAHAVPSPAQATAA

SEQ ID NO: 871 - protein, 577 aa, unidentified
  source 1..577: note = Related to NZ_CP015318.1; note = Mesorhizobium amorphae
MTVKSLTLERLKKSTDLTEVAILLGVKPSALSHALYITPTAKKYHTFSIPKKRGGERIITAPNERLKLIQARLAALLLQIEQDLEATQSKSCILAHGFKNELSIITNAAKHRNRRFVFNVDLKDFFPSINFGRVRGFFMANRDFQLSEKAATILAQIACHQNKLPQGSPCSPPISNLIGQILDVHLNKLAKECRCTYTRYADDITFSTNQKKFPEKIAVLQAGSEHTWVPSDELSFRIIRAGFELNKQKTNMQYRDSRQTTTGLIVNQKLNVPVEYYKTVRATCHKLFTTGTAFRKLGSKLIPTTPPKIRGQLSFLFHIKGLETGHRKLPKPEMPNFYKLYAQFLNFMSFWAISQPTLVCEGKTDNIYIRSAIRALSAKFPDLVEKKDGKERIKLTFFKYTGIAKTIQDLSGGNGQLKNLVREYPGRTEKFKVQPAHPVIVVTDVDKGAVDLFKAVSDEVGKTILGHEQPWYFLRDNLYVVPVPKGAGAETAIEDLFDSALLTTEIDGKKFDRTNHEKDGDKFYSKFTFATKVISASKTPIDYGGFEPLLQAILDVQADYAARIAAPPVGTAAAAAS

SEQ ID NO: 872 - protein, 590 aa, unidentified
  source 1..590: note = Related to VFVE01000003.1; note = Mesorhizobium sp.
MTVVSLRLELFKKAKDLTDVAKILDLMPAHISFALYKLDRPGFEPKYEEFTVPKKTGGIRTIKAPHRALKAVQKRLAKDLLEIEQALETTRVKKVDCILAHGFKKRLSIMTNGENHRKRRYVFNVDLKDFFPTLNFGRVRGFFMKHKDFQLNKDVATILAQIACHDNHLPQGSPSSPVISNLIAGVLDIRLNELAQQYNCTYTRYADDITFSTSEKLFPSAIGRPEPGSINLWEAGPKLLKAITRAGFELNPVKTRMLLDWSRQEVTGVVVNQKVNVPADYYALAAAMCHHLFMDGACFTTVGGVKKPYPLTKLRGRLAYIYQVRGRGPKPKPAVDDAEDKPKLGKPWASTNLFQKFLDYADLYGIEKPVLLCEGVTDNIYLKAAIQSLAPKYPTLTTAAGELKVKLFKYTRSSAALQQLSGGGGGLGVLAYAYPQRVRKFKSGGKHPLILIGDNDEGSEKLFGAIKAKTGKKVDGSEPWYYLGQNMYVVPIPKVGGIDTPIERLFEPSLLATQYEGKTFNKTNASKDPAKYYDKKVFATQVVAKDKANVNFDGFEPFLDAIVSVINHHKAKVGSIPVPAAAVTIATAAP

SEQ ID NO: 873 - protein, 589 aa, unidentified
  source 1..589: note = Related to CP015005.1; note = Aminobacter aminovorans
MTLPLKLSLYRKARDLTDVAKILDLKPAHLSYALYKLDKPGFPPKYKEFTVPKKAGGVRTIMAPHKVLKAVQKRLANDLLEIEQVLEKTRVKKADCILAHGFKKNLSIMTNGENHRKRRYVFNVDLKDFFPSLNFGRVRGFFMKHNDFELDTDVATILAQIACHENQLPQGSPCSPVVSNLIASVLDIRLNELARQHNCTYTRYADDITFSTNEKLFPTAIGRREHGSLNLWEAGSKLVKVIERAGFELNPAKTRMLLDWSRQEVTGVVVNQKVNIPADYYATAAAMCHHLFMDGACFTMVGGVKQPFSLTKLRGRLAYIYQVRGRGPKTKPAADGTEDKPKSGKLWASTDLFQKFVDYADLYGIERPVLLCEGVTDNIYLKAAIQALAPKYPALATAAGELNVKLFKYTKTSAALQHLGGGGGDLGKLANVYAQRTRKFKSGGKYPLILIGDNDEGSEKLFGAVKAKTGKKVDGSDPWYYLGQNMYVVPIPKVGGIDTPIERLFEPKLLATQYEGKTFNKTNASKDPTKFYDKKVFATKVVAKDKANVNFDGFEPLLNAIVSIINHHKAKIAPIPAPAPAVLVAAVGP

SEQ ID NO: 874 - protein, 588 aa, unidentified
  source 1..588: note = Related to JAIUGR010000007.1; note = Mesorhizobium sp.
MTVVSLKLELYRKAEDITDLAKILGLKPAHISYALYHLPLGDRYEEFTVPKKTGGVRTIKAPHRTLKAIQKRLAKDLLEIEQALEQSRVKKTNCILAHGFKKKLSIMTNGENHRKRRYVFNVDLKDFFPTINFGRVRGFFMKHNDFELKPAVATVLAQIACHDNELPQGSPCSPVISNLIASVMDIRLNELAHRHNCTYTRYADDITFSSSEKIFAPAIGRRNVSSINLWEAGISLSRVIKKAGFKVNAAKTRMQLDYSRQEVTGVVVNQKVNVPANYYAEAAAMCHHLFMDGECFVKIAGVKQPLPRRKLRGRLAYIYQVRGRGPLIKAAPEDQEERPKGGKLWASSKLFERFVDYVDLYGIERPVVLCEGVTDNIYIKSAIQALAPIYPTLTNPAGELKIKLFKYTKTSAALQQLSGGAGELGKLANTYPSRIRKFKSGGQHPLIIIGDSDDGSKKLFAAVESKTGKKVDGSQTWYHMGANLYVVPIPKIGNKDTDIERLFDVALLKTNYDGKTFDKTNAEKDGTKFYGKKVFATKVVAANKATVNFDGFKPLLATIAEVIDHHKTTVVSPTVAAVSSSAVAAGGP

SEQ ID NO: 875 - protein, 591 aa, unidentified
  source 1..591: note = Related to CAAF010000028.1; note = Mesorhizobium sp.
MTVVSLKLEQYRKAEDITDLAKIFDSKPAHISYALYKLDQAPAPSKYTEFTVPKKSGGVRTIKAPHPALKAIQKNLAKDLLEIEQVLEETRVKKPDCILAHGFKKKLSIMTNGENHRKRRYVFNVDLKDFFPTINFGRVRGFFMKHKDFELKPAVATVLAQIACHDNQLPQGSPCSPVISNLIASVLDIRLNELAHQYNCTYTRYADDITFSTSEKNFPTAIGRRYVGSINLWEAGPKLLKAISRAGFELNPAKTRMQLDYSRQEVTGVVVNQKVNIPADYCATVAAMCHHLFMDGECFIQVAGAKQPFPLKKLRGRLAYIYQVRGKGPKVRITPEDAEEKPKTPKPWASTKLFEKFADYADLYGIERPVLLCEGVTDNIYIKAAIQALALKFPSLTNAAGDLKIKLFKYTKTSAALQQLSGGAGELGKLAFTYASRIRKFKSGAKHPLILIGDSDSGSQKLFDAVEKKTGKKVDGSQAWYHLGSNLYVVPIPKVGNKDTPIERLFDQALLDTPYESKKFDKTNAEKDGNKFYGKKVFATKVVAANKGTVNFGGFEPLLTAIAEVIEFHKTKVAPPANSVQAIAPVAAAGP

SEQ ID NO: 876 - protein, 587 aa, unidentified
  source 1..587: note = Related to NZ_JHQU01000117.1; note = Mesorhizobium mediterraneum
MNIVSLKLEQYRKATSLIDISHVLALEPAHISFALYKLDKPGFAPKYTEFSVAKKAGGERTIKAPHKALKAVQKRLAQDLLMIEQQLEATRVKRSDCILAHGFKKKLSIMTNGENHRHRRYVFNIDLKDFFPTINFGRVRGFFMKHKSFELQESVATILAQIACHNNQLPQGSPCSPVISNLIASVLDIRLNELAHQYNCTYTRYADDITFSTSEQNFPTAIGRRDVGSVNLWEAGPKLLKTIQRAGFELNPTKTRMQHSYSRQEVTGVVVNQKVNIAADYYDEVAAMCHHLFMDGECFIKISGAKQPFPIKKLRGRLAYIYQVRGKGPKVIQKGEDGESKGTQKFWASFNLFERFLNYADLYAVDRPLVLCEGVTDNIYIKSAIQALAVAYPTLTSPSGELKVKLFKYTKTSTAVQQLGGGSGELLKLITKYHLRTNKFKAGGKHPLIVIVDLDEGSKTIFKEVEKKTGKKIGTQPWFHWDKNLYIVPIPKVGGADTPIERLFPQALLEATYDGKTFDLTNSEKDGSKFFGKKVFATKVVAADKGAINFGGFAPLLAAIVEVIEHHKTKMSLPLAAAAAPVAAAAP

SEQ ID NO: 877 - protein, 591 aa, unidentified
  source 1..591: note = Related to nan
MTTAAALKLDLYRKAEDIRDLAAILGLAPAHISYALFKMPDANKYKVFTVPKKTGGVRTIKAPHKTLKAIQKRLAQDLMGIEAHLEAVRVKKRDCILAHGFKKKLSIMTNGENHRHRRYVFNVDLKDFFPSINFGRVYGFFQKNQSFNLKPKVAAAIAQLACFENQLPQGSPCSPVISNLIAGILDVRLNELAQQYNCSYTRYADDITFSTSEQNFPSAIGQRHPGSINLWEAGPKLLKAIKRAGFELNATKTRMQLSYSRQDVTGIIVNQKVNIPVDYYETVAAMCHHLFMDGACFTKVGGVRHPFPLKRLRGRLAYIYQVRGKGPKPKTVDEAGEPKGGAKFWASTNLFERFLNYADLYGAERPVLLCEGVTDNIYIRSALHALAAKYPTMITPASELKVKLFKYTKTSAAIQQLGGGSGELVKLLREYRKRTAKFKSGAKHPLILIADSDEGSKELFKEVTKRTGHKVDGTHAWYRIMTNLYVVPIPKVGAADTPIERLFEQVVLDKTYDGKKFDMTNSETDGSKFYGKKVFATKVVAANRGAIKFDGFEPLLTAIAEVIEDYKTKVAPVLALIPAAAAPAPPAPVPA

SEQ ID NO: 878 - protein, 595 aa, unidentified
  source 1..595: note = Related to SAKE01000022.1; note = Mesorhizobium sp.
MTIVSLKLEQYKKADTLTDVARILDLKPAHISYALYKLSNTSKYDEFTVPKKSGGDRIIRAPHKTLKAVQKRLAKDLLLIEQELEASRVKKRNCILAHGFKKKLSIITNGENHRDQRYVFNVDLKDFFPAINFGRVFGFFTKHKDFAIKRKVAAVLTQIASFENQLPQGSPCSPVISNLIASVMDIRLNELARQNHCTYTRYADDITFSTSEQLFPSPIGRRVNGSINLWEAGPKLVKMIARAGFELNHAKTRMQYYYSRQDVTGVVVNQKVNIASDYYATVAAMCHHLFMDGSCHVKVNGTKQPFSLAKLRGRLAFIHQVRGRGPKLCQVPDEKDEQTKAPPQKVWASFKLFERFLNYADLYGADRPVVLCEGVTDNIYIKSALHNLAAKYPALTSPAGELKIKLFKYTRSSAAVQQLGGGCGDLTKLARMYSARIKGFKSGGKHPVIMVVDSDEGSKDLFKHVQHVTKKKVDGTDSWYFLESNLYVIPIPKIGGADTPIEKLFEQALLDKPYEGKKFDMKLKETDGATHISKKTFASKVVAVNKATINFGGFEPVLNAVVEVIEDYKKRVGSVIPSAPTAAVVALAIIAGGPQ

SEQ ID NO: 879 - protein, 585 aa, unidentified
  source 1..585: note = Related to RZTV01000003.1; note = Mesorhizobium sp.
MTVVSLKLEQYRDAEDLSDIAHILDLKPAHISYALYKLPTHQKYREFTVPKKSGGVRTIKAPHNTLKVIQKRLAQDLLLIEQQLEQARVKERDCILAHGFKKKLSIMTNGENHRGRRYVCNVDLQDFFPSINFGRVFGYFSKNNDFALKPKVATVLAQIACHENQLPQGSPCSPVISNLIGRILDIRLNELARRYHCRYTRYADDITFSTSEKHFPIAIGMRELGSINLWAAGPKLLDAIARTGFEINPKKTRMQYHYSRQEVTGVVVNQKVNISADYYATVSAMCDHLFKKGECHIDVGGTKQPFSIRKLRGRLAYIYQVRGKGPKHRQTADDKDDQVKGSQQRLWSSFKLFERFLNYADLYGVDRPVILCEGVTDNIYIKSAIQALAAKYPTLTNAVGDLKVKLFKYTKTSASVQQLGGGSGELLKLVNTYSSRTRKFKIAPKNPLILVADSDDGSKPLFKVIENRTGKKVDGSHAWYHLESNLYVVPIPKVGAADTPIEGLFEQILLDTTYEGKKFDRTNSEKDGTKFYGKKTFATKVVAANKGSINFGRFEPLLTAITEVIEDYKPKIAPSPVPALAPALV

SEQ ID NO: 880 - protein, 584 aa, unidentified
  source 1..584: note = Related to NZ_AJQB01000700.1; note = Bradyrhizobium japonicum
MAHLTKLRAASSLNDLAFLLGVKPSSLAYVLYKIPDEKKYTQFPISKKTGGERIISAPDPRLKMIQRRLAKLLAKCQIEVEEKLKVKPQCTLAHGFKSGFSIQTNAANHRGQRWVFNADLHDFFPSINFGRVNGFFVKNQYYSLNSKIALLIAQIACHEKTLPQGSPCSPIISNIIAHLLDIRLNELASANGCTYTRYADDLTFSTNEKTFPTSLAKRDPANLNKWTVGSGLAKRIAKAGFIINSKKTRMQYRDSRQEATGLVVNEKVNVKSDYYKLARSICWQLMKEGKAFTKVNGDSVPLKLKSVRGMIAFIYHVKRWDDERKQVPIDEIEKRAYFRLYAEFLNYMWFFGQSRPTIVCEGKTDNIYIKCAIRSLAQSYPSLVKSSGEKRGLLVQLFGFTKTADQVQKLSGGAPQLNILLRDYRKKTANCKGMPQQPTILVVDNDSGPQSLYSHLGNILKTKVDGSEPFYWAYGNLYVVPVPKIGGAPTAMEELFEQEVLATKLNGRTLDLSNKEADGTKFYSKNEFSIQVVQKKQKSIKFDGFKPLLDNLVAVQKDYASKVEAAKKLSAAKKVAAAPTAAMP

SEQ ID NO: 881 - protein, 583 aa, unidentified
  source 1..583: note = Related to JACIHC010000005.1; note = Bradyrhizobium sp.
MTHLAKLKAASSLNDLALLLGVKPSGLAYVLYKIPDENKYTRFTVPKKTGGERTISAPDPRLKMIQRRLAKLLAKCQVEVEEKLKVKPRCTLAHGFKSGFSIQTNAANHRGQRWVFNVDLHDFFPSINFGRVRGFFIKNKYYALNSRVALLIAQIACHEKKLPQGSPVSPIISNIIAHLLDIRLNELASANGCTYTRYADDLTFSTSEKSFPTSLAKRDPANLNKWTVGSGLAKRISKAGFAINSQKTRMQYRDSRQEATGLVINEKVNVRSDYYKLARSICWHLMKEGKAFKKIDGDSKPLSLKSVRGMMAFVYHVKRWDDERKQVSVAEIEKRAYFRLYADFLHYMWFFGQTRPTIVCEGKTDNVYIKCALRSLAQSYPTLVKTAGKKTSFLVQLFGFTKTATQVLKLSGGAPQLNNLLRDYRRNTANCKGMPQQPTMLIVDNDSGSQSLYSHLGRILKTDVDGSEPFYWVYGNLYVVPLPKIGSGPTAIEQLFEKEVLDTELEGRTLDLTNKETDGTKFYSKHEFSIHVVQKKQKSITFDGFRPLLDNMVAVQKDYASRVAAAAKPRTASKVLAAATASP

SEQ ID NO: 882 - protein, 582 aa, unidentified
  source 1..582: note = Related to NZ_AP022641.1; note = Bradyrhizobium diazoefficiens
MAHLTKLKSAATLNDVALLLGVQPASLAFILYKIPEHQKYTKFPVPKKSGGERIISAPDPRLKMVQKRLAKLLKNCQLEVEAILKVKSQCVLAHGFKPGLSIQTNAANHRGQRWVLNADLQDFFPSINFGRVYGFFIKNQHYMLNKKVATIISQIACHENTLPQGSPCSPVLSNMIAHMLDIRLNELASSNRCTYTRYADDLTFSTSERVFPSRIAKRDPSSLHKWVAGAGLSKRVEKAGFAINGKKTRLQYRDSRQDATGLVVNEKVNVKSEYYKLARAMCWHLMTKGSAHLKVGSIPVPVDAKKVRGMLAFIYHVKRWDDDRTKVPKEEIEKRAYYRVYADFLNYISFFGQPHMTIVCEGKTDNVYLRCAVRSLAALYPSLIQVKGKKRNFLLQLFKFTKTADAVQHLSGGASQLSNLLSEYRKRIKNCKGTPQHPTVLVVDNDSGPEKLFKHLSSLLKKDVDGSDPFYFVYENLYVVPVPKIGGAFTAMEQLFESHVLKEKLNGRILDLTNKEPDGTKFYSKNEFSVEIIQKKQASIKFDGFKPLLNALVAVQNDYAGKIAAKKAAIPAPAPVPALAAP

SEQ ID NO: 883 - protein, 611 aa, unidentified
  source 1..611: note = Related to NZ_JHQS01000008.1; note = Mesorhizobium amorphae
MLGWIAHLRFLQFIDVSSCLGVSASRLPSGVSVTGSTLKTLQAIQNLHGFAAFLGVTPKALGHAIHGIPEVSKYTKFEIAKKSGGKREICAPVPHLKRIQRRLANKLKEIEMSLEGELTTNEHVLSHGFKPNLSIATNARAHRGRRWVFNIDLADFFPSINFGRVYGFFLKNSRYGVSKTVATLIAQIACYENQLPQGSPSSPVISNIVAHILDIRLHELAASLNCTYTRYADDLTFSTNEKGFPGAIAKRSQDEDDVWKIGKKVKSIIKQSGFEINPKKTRMQYRISRQDVTGLVVNEKVNVRAEYSRTARAMCHQLWTKGAAFQKDGKLKLAKTPEQVRGIMNFVYHIKECEEVRQSDGAEFDPSAPLPGYARIYAKLLDYLSFWGTDKPVLLCEGKTDNIYIKCAIENLAASFPTLIESSGGVIEPAVRFFNRSDVKDTKDSLTWKLQKLAGGVTELTSFLGEYRERIKDFKHGGKYPLVIVVDNDQESKGMFSHIKNIIKSAAPVDGSAPFYYIYANLYVVAIPKIGSKDTYIERLFSDKVLKKTLDGKTFDVTGKKNNKTHYFKSDFAKKVIKKNKANIDFKRFKPLLERIAAVKADYATRIKTTP

SEQ ID NO: 884 - protein, 570 aa, unidentified
  source 1..570: note = Related to NZ_KB913026.1; note = Mesorhizobium loti
MLLGMKPAALAYILYKLPAGAKYKSFEIEKKSGGVRKIMAPEPRLKMLQRRLADLLLACQSEIEASMKIKDDCALAHGFKPRLSIFTNAEKHRNRRWVFNADIEDFFPTINFGRVYGFFQKNHHFALPKPVATIIAQIACHENQLPQGSPCSPVISNIIAHILDIHLNDLAYRHNCTYTRYADDLTFSTNEKQFPRAIAKRQVGDIHEWIPGSGLKKALKSNGFKLNGSKTRMQYCDSRQEVTGLVTNEKVNVKQQYYKQARAMTRELVTGKKPFVTVAGKKVEVARDHLRGMLNFIYFIKSKENKRIGFTFDKENDKLPTFHAIYKQFLDYIWFYGIDEPTIICEGKTDNIYLKAAIKARAAHFPELVKTVEGVTKIRPRFFKYSDTAAELQDLSGGTGELNNLLAHYRNRITTFRGGANQPVIIIVDNDSGATAIFSHIYNILNPKIKSTGGKKGGATPAAPVDGSEQFYYLYENLYIVPVPKVAGAETPIERLFDPKLLKTVWNGKQLDLTGDKDPAKYYFKNDFAVHVVKEGGAGVKFDDFDPLLSAIVAVKADYAKRVALLAAVA

SEQ ID NO: 885 - protein, 312 aa, unidentified
  source 1..312: note = Related to JACIZA010000145.1; note = Phenylobacterium sp.
MNTPLSKIKSCTNRSDLALLLGVKPAALSYILYKIPDENKYYSFSIPKRNGDQRQISAPIPALKMLQRRLSEHLYECLNEIEYLEAVDPQCVVAHGFKKHLSIATNGSHHRSKRWVFNCDIEEFFSSINFGRVKGYFERNRHFQLQPEVALVVAQICCHEGVLPQGAPTSPIISNLIGSILDDRISRLANELRCTYTRYADDLTFSTNMAHFPRQIAVADEKSPSRWRIGDKLLSRVAQAGFRINHEKSRMAMPNSRQTVTGLTVNKTVNVATTYYKMTRAMCHHLFTTGSYSSGGLNDAPKGRELAALEGR

SEQ ID NO: 886 - protein, 579 aa, unidentified
  source 1..579: note = Related to JACJIU010000009.1; note = Rhizobium leguminosarum
MKVEIYKFGLKELKACVDLSDVAFLLDVEPKFLSKQIYKTDAAVKYHSFTLPKKDGSSRLINAPNKNLKFIQSRLSRLLYQCYFDIHGKPEFPGRVISHGFQKQRDLSIYTNAIRHIGKRHVFNVDLEDFFPSFNFGRVRGYFIKNERFALNPTVATVLAQTACHDNVLPQGAPTSPIISELISQVLDYRLQAVASKYRCTYSRYADDITFSTNLPEFPHQIGSQDAGVWTAGLSIEKAVSSCGLKLNADKTRMQLGQQRQATTGLTVNRKVNVGRHYYKGVRFCAHAMMTTGKADAPSYLKIPEKQLNSHQIWGMLCHIDDIKGRENNHAPIRHFSSSHPAPHYLRLMRDFFHFHRIHTNPKPVIICEGKTDYIYLKEAIRWNVGDPMVATLLDVVPHTKKSKGDHWNVDFVRHSDTAGDLLELAGGGGDLPKFAEYHLGRVDKLYNGEAAKPVIIIVDNDGGSDGMWTWIKRVTESATKIDGSKPYYHIGKNLYVVPIPSGGQADFYIEKLFPQPWLNAKLGTKTLKLIQKKGDKLSPNEYGKGEFATKVIRANRGKVDCSSFLPLLHTLFEIIHLK

SEQ ID NO: 887 - protein, 518 aa, unidentified
  source 1..518: note = Related to CP090117.1; note = Rhizobium leguminosarum
MKEKIYKFGLKELKSCIDLSDVAVLLDVEPKFLSKQIYKTDAAVKYHSFALPKKDGSSRLINAPNKNLKFIQSRLSRLLYQCYFDIHGKPEFPGRVISHGFQKQRDLSIYTNAIRHTGKRHVFNLDLEDFFPSFNFGRVRGYFIKNERFALNPTVATVLAQTACHDNVLPQGAPTSPVVSELISQVLDYRLQAVASKYRCTYSRYADDITFSTNLPEFPSQIGSQDAGVWTAGPSIEKAISSCGLKLNAAKTRMQLGQQRQATTGLTVNRKVNVGRHYYKGVRFCAHAMMTTGKAEAPKYLKIPEKQLNSHQIWGMLCHIHDIKGRENNHAPIRHFNNGHSAPHYLKLMRDFFHFHRIHTNPKPVIICEGKTDYIYLKEAIRWNIGDPMAAPLLDVVPHTKKSKGDHWNVDFVRHTDTAGDLLELAGGGGICRSLRNTIWADLKSSTMAMQQSQSSLSSITIVGVKACGVGSRSSRNPRRRSMDRSRTTTLAKTSTLFPSRVRGKATFTSRSSFPHNG

SEQ ID NO: 888 - protein, 579 aa, unidentified
  source 1..579: note = Related to NZ_CP054023.1; note = Rhizobium sp.
MTKKIYRYGLKELKSCIDLSGVAFLLDVEPKFLSKQIYKTDPGVKYHIFQVPKKDGSSRLINAPNKNLKFIQSRLSRLLYQCYFDIHGKPEFPARAISHGFQKKRDLSIYTNAFRHTGKRHVFNADLEDFFPSFNFGRVRGYFVKNKHFALNDTVATVLAQTACFDNALPQGAPSSPIISELISQALDYRLQAIARKHRCTYSRYADDITFSTNLPEFPEQIGLADAGGWIAGSSLEKAVTSSGFKLNAKKVRMQFGDQRQSTTGLTVNRKVNVGRHYYKGVRFCAHAMMTAGKAEAPAILKLPEKELSSHQIWGMLCHVHDIKGRQSDHAAIRSFTKSHPAPHYLRLMRDFFHYHRIHTNPKPLVICEGKTDYIYLKEAIRWNITDPKVAKLLNVSPLTKTSKGDHWHVDFLRHTDMAGDLLDLAGGGGDLPKFAAYHLDRFEKLHKAEATKPVIIIVDNDNQSAGMWSYIKEAIGSKGVIDGSQPYYHVGKNLYVVPIPSAGKKDFYIEKLFPPKWMKEKLGTKSFKIMQKKGEKLGPDEYGKGEFATKVIRANRGKVDCSNFLPLLQTLSDITDIE

SEQ ID NO: 889 - protein, 584 aa, unidentified
  source 1..584: note = Related to JAHIXO010000053.1; note = Alphaproteobacteria bacterium
MTKQIYEYGLADLKLCNDLGDLARLLHVRPKFLSKQIYHTPDSVKYSEFELPKKDGSKRSISAPNKNLKFIQSRLSRLLYQCYFDIHGVPENTGRVLSHGFQKGRDLSIYTNAKKHINRRYVFNTDIENFFPSFNFGRVRGYFIKNQHFDLKPTVATVIAQTACFQNALPQGAPSSPVITELITQTLDYRLQALARKYRCTYSRYADDITFSTNLKEFPAAIAFRPEGENTWREGPSLIKAVESSDLKIKVTKSRMQQSYQRQATTGLTVNDKVNIAVYYYKGVRFCAYAMMTKGKAVATNKLLVSKNGDLSKQQIWGMMCHVNDIKRRELPYEALRAFKPAPIPSYLKLMKDFYHFYRIHTAEKPLIICEGKTDYIYLKEAIRWNVSDTRVAKTLLNGPPLQNVTSDKGDHWAVDFVNHSEMAGNLLDLAGGGGDLPKFATYHLERVQKLFSEKPPVPVIIIVDNDSQSAGMWTTIKKLTEASKPIDGSAPYYHVGKNLYVVPIPSNGAKDFYIEKLIPKNWLDQKLDGKTLKLNQQKDEKLKPSEYGKMDFATKVIRANRGKVDLSSFLPLLHNICDIIDSA

SEQ ID NO: 890 - protein, 584 aa, unidentified
  source 1..584: note = Related to JAALYX010000005.1; note = Agrobacterium tumefaciens
MTKKIYHFGLAELTSCVDLGDLARLLEIQPKFLSKQIYHTPYGQKYTHFPMPKKDGSTRNISAPNKNLKFIQSRLSRLLYQCYFDIHGAPEFPGRALSHGFQKGRDLSIFTNAKRHTNRRFVFNTDIENFFPSFNFGRVRGYFIKNQHFQLKPTVATVIAQTACFMNILPQGAPSSPIISELISQTLDYRLQALARKYRCSYSRYADDITFSTNLKEFPSAIAFCPPGEVNWREGPSLEKAVLSSNLKLNSKKARMQQSYQRQATTGLTVNDKVNISTYYYKGVRFCAHAMMTKGKAVANNKLSVAPNGKLSKYQLWGMLCHINDIKGRELPHKALRAFKSSPVPSYLKLMKDFYHYYRIHTAEKPLIICEGKTDYIYLKEAIRWNVSDARVVKNLISGPALINFTSDKGDHWGVDFVNHSNMAGNLLDLAGGGGDLPKFATYHVERVKKLFAEKPPMPVIIVVDNDKQSEGMWTTIKSLTGSPTPIDGSAPYYHVGENLYVVPIPSAGKKDFYIEKLIPSKWLKKTLNGKTLKLNQKKDEKLKPTEYGKMDFANKVIRANRGNVDLTSFLPLLHTICDIIELP

SEQ ID NO: 891 - protein, 586 aa, unidentified
  source 1..586: note = Related to NZ_RPKX01000022.1; note = Sinorhizobium meliloti
MTNAIYKYGIKELKTCVDLSDIAFLLEVEPKFLSKQIYKTSDEIKYYSFEIPKKDGSKRAIYAPNKNLKFIQSRLSRLLYQCYFDLHGEPKFPARSISHGFQKGRGLSIYTNAIRHTGRKYVFNADIEDFFPTFNFGRVRGYFIKNKHFELNETAATVIAQIGCFQNMLPQGAPSSPIISEFITQHLDYRLQALAKKHRCTYSRYADDITFSTNLTEFPAQIGVLSTDQEAWTAGAGFEKAISSCGFKLNVKKIRMQQGYQRQATTNLTVNRKVNIGSHYYKGVRLCAHAMMTKGKATAPGKVSTPPGDELNSHRIWGMLCHIHDIKGRGLPHRALRNYSPTHPAPHYLRLMRDFFHYHRIHTSPKPLVICEGKTDYIYLKEAIRWNMADERVGKLLVKADQLPHLKKSSKGDHWLVDFVNHSDMAGDLLGLAGGGGDLPKFADYHLDRIGKLHADAPPGPVIIIVDNDSQSEGMWTFIKKATGSTTKVDGSKPYYHVGKNLYVVPIPSGGAKDFYIEKLFPDNWLKEKLAGKSFKIIQKKGEKLGPNDYGKGDFATKIIKANRGKVDCSNFLPLLHTLCDVIQGK

SEQ ID NO: 892 - protein, 584 aa, unidentified
  source 1..584: note = Related to WISN01000076.1; note = Sinorhizobium meliloti
MTKRIYDYGLEELKACGNLSHLAFLLGVEPKFLSRQIYKTDDQLKYHSFEIAKKNGTKRTINAPNKNLKFIQSRLSRLLYQCYFDIHGKPDFPARATSHGFQKNRDLSIYTNAVRHIGRKYVLNADIENFFPTFNFGRVRCYFIKNKHFTLSETVATVIAQTACFQNALPQGAPSSPIISEFITQALDYKLQSLAKKYRCTYSRYADDITFSTNLSEFPSHIGFLSPDTENWSVGKSFEKSVLSSGFKLNATKIRMQQQNQRQATTNLTVNRKVNIGSYYYKGVRFAAYSMMKNGKAIATGKLSLTAKELNSHQIWGMLCHVHDIKGRGLHHTALRNYTNAHPAPHYLRLIKDFFHYHRIHTSAKPIVICEGKTDYIYLKEAIRWNVANQRIGKLLVKSGKLSDLKNTKGDHWLVDFVNHSDMAGDLLDLAGGGGDLPKFMTYHLDRFDKLHSDAPPKPVIIIVDNDSQSDGMWSTIKRITGSKAAVDGTKPYYHVGKNLYVVPIPAGGAKDFYIEKLFPDHWLKEKLGGKSLKIIQKKGEKLTADHYGKTDFANKVIKANRGKVDCSAFLPLLLTLCDIIESK

SEQ ID NO: 893 - protein, 580 aa, unidentified
  source 1..580: note = Related to NZ_FOPG01000001.1; note = Sulfitobacter dubius
MSIYRYGIKDLKGCADLGDLARLLEVQPKFLSKQIYHVDDADKYHVFPIPKKNGSLRQIHAPNSNLKFIQSRLSRLLYQCYFDLHGKPKNLSKVLSHGFQRDRDLSIFTNANRHTNKRYVFNADIDNFFPSFNFGRVRGYFIKNEHFKLTETVATVIAQTACFQNSLPQGAPSSPIITEFITQVLDYRLQSIAKRNRCTYSRYADDLTFSTNLGEFPSKIGYPFPLPEVWVAGPGLERAIAKSGFKLNEKKIRMQHAQQRQATTNLTVNQKVNVGSYYYKGVRLCANAMMRHGAAVRPKKAIEPGTPLTANQILGMLAHVHDIKGRELEHKALRKYGKFQPAPHYLRLMGDFYHYKRIHINPRPIVICEGKTDYIYLKEAIRWNVADPRVSSRLVDPVRLLAPTGKGDQWLIDFLKHTKTADNFLGLAGGGGDLKNFVNIHLGRIKIFHDNPLLQPVIIVVDNDSQSTEMWSTIKKASGSTNKIDGSEPFYHVAKNLYVVPIPSGGKSNFYIEKLFDDSWLKEDLNGRTFKVLQRKDEKLKDTEYGKGEFADKVIRANRGKVDCSSFLPLLHTICDIIDK

SEQ ID NO: 894 - protein, 588 aa, unidentified
  source 1..588: note = Related to NZ_SAUW01000046.1; note = Sinirhodobacter populi
MTKIYNYGLAELQQCSDLSDIAHLLGVKPKFLSKSIYKTPGENKYQAFKIKKKNGTDREILAPNPDLKFIQSRLSRLLYQCYFDIYGAPKNPMRVLSHGFQKKRDLSIYTNACRHTSRRFVFNTDLEDFFPSFNFGRVRGFFLKHNKFKLGEKAATTISQLACFENSLPQGAPSSPIISEFLAQPLDVALQKLAKDHRCTYSRYVDDISFSTNLREFPSKIAFPFPIPEKWIVGPKLEHEINRCGFKINTSKTRMQARTHWQSVTNLTVNQGVNIKKHYYKGARFCAHAMMTNGKAYAGNKLNIAYNELSSDQIWGKLRHICDVKDRSGAVQPLRNYNGSNPAPHYLRLSGDYFHYHRIHISPKPLVICEGKTDYTYLKEAILWHKGDARVAANLVDISRFPTKWKKTKGDHWGVDFVKHSKSADRFLDISGGGGNLVKFCKLHIERTKKFHSVTGQNPVIVIVDNDNQSEGMWSFIKDETNSSTKVDGSKPYYKVSNNLYVVPIPKPKGFAGDVYIEMLFPDPWLKYEIDGRKLKIKQKKGEKLKPSEYGKGEFADKVIRANRGSVDCSAFAPLLGTLCDIVDGTAT

SEQ ID NO: 895 - protein, 627 aa, unidentified
  source 1..627: note = Related to NZ_QNQP01000022.1; note = Pelagivirga dicentrarchi
MFIVMVGRNAGQICSSSSFAVLRIVEILACVRVPEGYFLEVELVNKLVQLQATKSRSDLARLIGVKPKHLSFTLYKIPENSRYTQFTIPKASGGTRDIHAPNSHLKAIQSRTSGLLYECYHIIYPKNDIANLELSHAFQKNRGLSIASNGSKHRNKRFVFNMDLKDFFGSFNFGRVRGFLLSNNQFGLNAEVATTVAQICCHENKLPQGAPTSPIVTEFITRILDIRLSKIAKRNGCTYSRYADDLTFSTNKREFPVEVAFLGLDGQWTAGSAIANKIHTSGFEINPNKYRMQFADSRQETTGLVVNKKVNVSKNYTKQVRYMAHSLFQKGECFIQEPQTKLPIMVSNHVLGGKLAHQFHIKSQEYLDSKGKAFPVARFEKEGKKAPAYYRKYADFIYFQNFFHSSKPTILCEGVTDNIYIKCAIKSLYSKVPSLGYASKAASKIQLLCGFYNYSPTAQAVTKLTGGANPLKTFIETYGITFARFKAASIEVPVIVVVDNDAANNGLWKMLQEKFGIAGADGSHDFYHVTKNLYVVPIPKIGGADTFIEHLFDAKTLASQLKGKSFDFGQKGKKIAPNKYGKMAFAKDVVRKKRASIDFSGFLPVLVNVEKALSEHKKMLSTQKATS

SEQ ID NO: 896 - protein, 575 aa, unidentified
  source 1..575: note = Related to NZ_MNBL01000032.1; note = Nioella sediminis
MSKLASLKSVRTRGELADLLNYSRSALAYAVYKVPEEQRYKEFKVAKRSGGERIIHAPCPELKGLQKRLSNYLYDCHREIWPPLEFPRHSYSHGFQKNRGLSIFSNAWKHRNKRFVFNVDLKDYFPSFNFGRVRGYFQKNRSFELHQDIATLIAQIVCYDNSLPQGAPTSPIVSELITSILDQRLGRLSKKHHCTYSRYADDITFSTNQAGFPEPIADFSPQADGAWKAGSELVGLVERSGFEINPNKTRMQLATSRQSATGLVVNRKVNIPKQYYDDVRAMSNSLFKTGVCHHPDTKEAASLAVLKGKLEFVLAAKTYPKGLVSFSDLELASKAPGGTPVPSHYKLYRRFLAYEKFHANARPLVICEGKTDNTYIRCAIASLNSKFPLLQPTTDAEGSVRQALSFFKHSDKHAKLLSISGGAGELHKFVGKYGSLLKDFHSGGEQQPVIVIVDNDNAAKPMWSVIKEKMGSEDKVDGSANFYHVKRNLFVVPIPIKSGKFASIEDLFDKKTLATVNKGKKFNPHLKSHQTTNQYGKEIFAKWVIEANAENIDFSGFEPLLGRLEEVLKVELQGS

SEQ ID NO: 897 - protein, 574 aa, unidentified
  source 1..574: note = Related to LMGC01000024.1; note = Ensifer sp.
MTLSSFRACKDLADLAHLLRVSPKGLSYILYKIPSHLKYTHFEIPKKSGGVRTISSPDRRLKFVQSRLAELLYTCQREILPVEKNIKKVLSHGFQKNRDLSIHTNAYKHTNRRFVLNLDLEDFFPSLNFGRVRGFFLKNRDFQLKEALATVVAQIVCHGNELPQGAPTSPIISDLMARVMDVHLSKMAASYGCTYSRYVDDLTFSTNLAEFPPALATEDPATGAWSAGAELRSRIWRQGFALNNKKTRMQARTSRQEVTGLVVNKFVNVRTEVEASNRILVHTLVKKGNCFQKDPVSGTTKALSLEQIGGRLSYQFQTKAARHSFRSAREFEKAGEPIPRFYRDYASYINYCSFHANDLPTIVCEGKTDVIYLKTAIRVLYAKFPKLAGISAGEYASDVRFFGHSRHHTAATKLSGGAGDIQQFVREYSKIVHPFHPGGQLRPVIVFVDNDKATNGIWSFIKERTGSKTLIDGSAPFYHIERNLYVVAVPGKVGTTERIVEDLFDAKTKSMTWNGKTVDLKQKRGHPPGKGKMSKERFATKVIRDQRDNIDFSGFEPVLQAFSDIIDIKLPAST

SEQ ID NO: 898 - protein, 574 aa, unidentified
  source 1..574: note = Related to AGVV01000148.1; note = Sinorhizobium meliloti
MTLKTFRACKNLSDLAHLLRVSPKGLSYILYKIPSHLKYTKFDVPKKSGGTRTISSPDRRLKFVQTRLAKLLYACQREIVPVENNTKKVLSHGFQKKRGLSIHTNANKHTSRRFVLNVDLEGFFPSVNFGRVRGFFMKNRDFQLSEACATVVAQIVCHDNELPQGAPTSPIVSDLMARVMDVHLSKMAASYGCKYSRYVDDLTFSTNLAEFPTALAVEEPRTGTWSAGSELRGRIWRQGFALNDQKTRMRRRTSRQEVTGLVVNKFVNVRAEVEASNRVLVHTQVKKGSCFLKDPKSGATTPLSLEQLGGRLSHQFETKAARHNFMSAREFEKAREAIPKFYRDYSAYIYYRNFHVNDLPTIVCEGITDAIYLKTAIRVLHAKFPNLAGTSAGKYVSDVRFFGYSRHHTAATKLSGGAGDVQHFVKEYGKIVHPFHAGGQLKPVIVFVDNDKATNGIWSYIKEKTGSKTPIDGSDPFYHIERNLYVVAVPGKVGGAERVVEDLFDAATKSMAWEGKTVDLKQKRGHPPAKGKMSKERFATKVIRDQRDKIDFSGFEPVLEAFSEIIDIKLAGSK

SEQ ID NO: 899 - protein, 574 aa, unidentified
  source 1..574: note = Related to NZ_SIQZ01000001.1; note = Rhizobium leguminosarum
MTLKNLRACKDLSDLAHLLSASPKGLSYILYKIPPHLKYTRFEVPKKSGGTRTISSPERRLKFVQSRLTELLYACQREIVPVEENIKKVLSHGFQKKRGLSIQTNAGKHTNRRFVLNVDLEDFFPSLNFGRVRGSFLKNRDFQLPEPVATVIAQIVCHDNELPQGAPTSPIVSDLMARVMDVHLSKMAAAHGCTYSRYVDDLTFSTNLAEFPPALALENPLTGKWDAGHELRGRIWRQGFTINDQKTRMQTRASRQEVTGLIVNEFVNVRTEIEARNRVLVHALMKKGTCFQKDPKSGAATPMSLEEVGGRLSHQFQIKAARHGFKSAREFEKAGDDIPKFYRDYAHYINYCSFHVNPVPTIVCEGKTDVIYLKTAIQVLHAKFPKLGGLSGGKYASDVRFFGQSRHHTAATRLSGGAGDVQHFVRDYNKIVLPFHAGGQLSPVIVFVDNDKATNGIWSFIKERTGSATPIDGSDPFYHIERNLFVVAVPGKVGNTERIVEDLFDAATKAMTWDGKTVDLKQKRGQPPAKGKMSKERFATKIVRDQRSKIDFSGFEPVLKAFSDIIDTKLTPSK

SEQ ID NO: 900 - protein, 571 aa, unidentified
  source 1..571: note = Related to NZ_CP053347.1; note = Sphingomonas sp.
MLDDLKSCTSRSGLAVLLGVKPSELSYTLYKIPDAAKYTSFCISKKSGGTRQIQAPCPPLKWLQGRLLDLLYQCEDDISAASGLKRNLHSGFRRGVNIYENANAHRGKRFVFNIDIESFFDQYNFGRVRAFFINDRDFALQPAVATTIAQIVCFNNVLPQGSPTSPHIANLLTQFFDNRMARFLRPRRCGYTRYADDITISTNVREFPADVAIMTPADPQGWSIAPELAAIFGRANLPPNPSKTRMSAYSSRQTVTGLVVNQRPNVTREYYLHTRAMCDRLFKTGTIQIPDITSSYGKNCPVSDDAEPEADVDPLKVLEGRLSHIHHIREKSDLRNIQEKQDNPTQFWNMLQDFFLFKYFVANSKPLILTEGPSDIFYLRSAIINNTTLLVPELKKVVSGKPEILPTFFRFNTVAAKVIGLTGGAGNIKRFLYLYHKQEKRFNRSLRHKPVIIIIDNDSGGADVINMVNGIYKTNISLSDPIMAHKITDGLILVKTPHVGSKTHTAIEDLLPASVKAVKLNGKSFSAAKKFDATKHFGKIALGSYVQANASSISFQGFDDFIVAINGAITM

SEQ ID NO: 901 - protein, 569 aa, unidentified
  source 1..569: note = Related to NZ_BJVS01000002.1; note = Asaia bogorensis
MLDDLKACRNRSDLAHLLGVKPSSLAYTLFKIPDVSKYSKFCISKKRGGTRQIMAPCVRLKNLQTRLLAILYQCEDDIEKASGIHRSLHLGFRREVNIYDNARLHRKRRYVFNIDIEKFFDNYNFGRVRSFFIKDHDFSLHPDVATTIAQIACFNNVLPQGSPTSPHIANLLSQFFDNRMSRFLGHRRCAYSRYADDITISTNLKEFPSDIASVTTTVPQGWVIAPELLSILTRSGLPPNLAKTRMSLRSSRQMVTGLVVNKHPSVPREYYLQTRAMCDYLFKGKIPHIPDITSDYGENCPSSLGHKKKKPDYMRVIEGRLSYISYIRKRSAKFSTEYKNDKNSQFNNLFIDFLIFKNFYMNEKPIILTEGPSDILYIKSAIRSSTLSLPHLKRINSGKLEIIPRFFRFHSASSKTLGLTGGTGNLKNFLNLYKKRSSKFRVSPNENKIIIVVDNDSGGKDTICAINSLYKKNIQISDPTIIHKITEKLTLVKTPHVGIKKETTIEDLLPDDVKSVTINGKTFSAEKILDETKNFGKIKLASYVHDNASVIDFTAFNDFLSELDSGFTT

SEQ ID NO: 902 - protein, 569 aa, unidentified
  source 1..569: note = Related to NZ_CP019511.1; note = Sphingomonas sp.
MLSDLKACQDRKGLAILLGVSPKEFAYTLFHIPGDQKYESFCVSKKNGGTRNILAPVPRLKWLQRRLLEILYQCAEDISVSAGESPNLHFGFRPQFNIYENAFVHRRRRFVLNLDIVDYFDQFNFGRVQGFFLKDKNFELVPAVATAIAQIACFDNKLPQGSPCSPHIANLVSQFFDNRMARFLRSRRCSYSRYADDITISTNLRVFPSDVAEASDSPQGWQISPILTDIFQRSGFAINDTKVRMGVFHSRQTVTGLTVNKHPNISRDFYLNSRAMCNSLIKSGSFIVQDISGSFGNSCNPDLPPPIKSPLMVLEGRLSHIHNIKEKNDGRDLKYKQASPTQFWKLLRKFYQYKYFVINDYPLIITEGPSDIFYLKSAIRNTKLLVPNLYADEKGGRRILPQFFNLSNLPSKVLALNGGAGNIKKFIHQYSIEMRNFFTLNRTNPVVMVVDNDSGGEDVFGQIKKSFGLSVKTSDKDCMVKVSDYLYLIKTPHIGPQDKTSVEDMLPSAVRGVALNGKTFSTASKFDTSKHFGKVALASYVHANSGSVDFSGFDPLLLALDRAIADSKS

SEQ ID NO: 903 - protein, 569 aa, unidentified
  source 1..569: note = Related to NZ_CP032570.1; note = Tsuneonella amylolytica
MLTDLKDCTTRAALASILGVEAKELAYVLYKIDQGSKYTSFCISKKNGGTRQIQAPIPKLRFIQSRLQQISMACCDDIADLGIYKGKLSFAFQKDRNIFENARPHVGKRFILNLDIRDFFHQCNFGRVRGYFIHSKEWKLDPAVATVIAQIACVDEGLPQGSPSSPIIANLLGQILDVRLTRFLHPRRCTYTRYCDDITISTDMRVFPRDVAVQDDSWPSGWALAAPLEDIFVRADFPINYNKLRMSFDCSKKVVTGLTVNRFPNIDRKFYRDTRLLLDRYAQTSSCKYIEFTGNFGNNCDNTETKNKNPILRLGGRLAFIHHIKSRTSLIGYPGIVHPQNPQFYGMVQTYAFAKDFVFNSIPTVVTEGPSDIIHLKAAIRANPAWAPHIFDSKENRFLVKFARHDGLFATVLGMSGGTGNIGRFLDLYYSRFKRINYKIRTQPSVIVVDNDKGSHGILKRLSNIHKMKLSTGDGLVVKKLQPFFYICKTPQLAGKAETAIEDLLPSAITGMVVGGKTFEPDTKKFESSKNFGKIFLAKMVATQHSATAYANFQQFITGLDDAVAGVAK

SEQ ID NO: 904 - protein, 444 aa, unidentified
  source 1..444: note = Related to JADBDT010000001.1; note = Sphingopyxis sp.
MLIDLKACKDKRDLAHLLGFQLKTITYQINIAPDAEKYKKICISKKNGNSRTVFSPNPILKSIQNSLLEIITSCYDQIHGGMNYPVSFGFIPNLNIYDNAKRHIGKRWVFNVDIKDYFDSINYGRVWRYLQKNKNFLLNAEIATMISQIVCFDGRLPQGAPTSPMMANLVSGSLDYRLRSLASEHKCTYSRYADDITFSTNLRDFPEEVARYDEPSGSWLPGKGLLSCVSRAWFSLNDGKTRMSYRRSKQVVTGLIVNKKVNVDREYFKLVRANIHHLLTGRPVILQEFCDPYGENCDGKEVKNKNGMSLIEGRINFCFEINDQGDERTDNAKFFKPSSVRKTYRDFLIYKYFIHGDRPILITEGESDIVYMAAYLKARSLPLANLVDVSPPDNRKILIDFYQFPKRPSKIIGMTGGTSGVAFALKWVGEILPRLGKNVSRRKF

SEQ ID NO: 905 - protein, 613 aa, unidentified
  source 1..613: note = Related to LXYU01000002.1; note = Bartonella apis
MTEPKNLEKLKSITKREELADLLGLSRRRLFCTLYMEPMSSKYNTFSIPKKSGSDLRIIKAPNSHLKFIQWRLAKYLSECLEEIKKKEKFPHLSFAFQKKLSIKDNALKHINKRWVLNLDISDFFSSISFNRVNRFFLKNKFFQLNDEIATTIAQIACDEQALPQGSPCSPIISEFITQSLDVRLLKLAKQYHLTYSRYADDITLSTNQKVFPREVAYPDSSAENGWQVSETLRSIIQRSGFKINEEKTRMQKNCVRQVATGLVINKKPNVADNYYRTVRSMCHHVFEKGAYYRSPEDKDNPTCDLNPLAGKLNFIHDIKKNSDETNSSSLRGGNNLTLSGFDGLYKKFLFYRLFLCLNKPMIVTEGKTDPIYLRCAIKHGNKIKNAYGKTVGRYITQSILFFSRERSYAEAFNFKEGGSNNLLDIIKLYKEYLHSSKKRQIQSRPCAFPVILLFDNDDGIKTTSSYVKKNFDIILTTETTDDFYYLFDNLYIVKTVEKKYNTEYEKNDDKNHQYDNIKNKVKNKKNLIKNSESCIEDCFFKKTLEKTLHGKKFTKNNNGHSNTEYSKDKFATEIVSAEPWSIDFSGFDGLLDRIRKVIEDYKKLHNHPTINR

SEQ ID NO: 906 - protein, 568 aa, unidentified
  source 1..568: note = Related to NZ_JABVZR010000003.1; note = Novosphingobium sp.
MALKAATNRHDLAALLRFQTKMMTSIVYATHESLKYKTFKVPKKSGGDRTIAAPIPQLKLLQRRLADLLMDCHAAIMDTHPHRKGLQFGYLPELSVVDNAYRHRRRRMVLNVDLADFFSSINFGRVRGFFLSDAAFQLHPVVATTIAQIACWNNELPQGSPCSPIISGLIGGILDRRLGALAREHGCTYSRYVDDLTFSTNADTFPNELAALDPATGRWAVGGKLSHAVGKAGFLVNPDKTRLFGMTGRQTVTGLVVNDKVNINRDYEMRTRAAVHHFIRKGVYTVPASLESVAAGKPPEKETSPHRLEGMLQWIYSVRDFSDDRKDGSKRHHPTSFSKVYREFLFAKHFLFMDKPLILCEGKTDNVYLNSALKRLAASYPSLGSWVGADFKSNLRLFRYTSKSLQILHLGGGCGDIVQLVRDYRRLWTRLVHRQIAQPVVLVVDNDEGGASVFKAIKEVGGPDIKIAEPKILFHVFHNLYIIKTPCGSGTPKSCVEDLFDAATLGQTLGGKTFNPACDEETAKHYGKKIFAEGVIRPNWKTIDFAGFHSILASLEDAIKGYYGMLVP

SEQ ID NO: 907 - protein, 646 aa, Vibrio parahaemolyticus
  source 1..646: note = Related to NZ_CP013248.1
MSQLQQLKNCKSLSDFALLLGYNAKGLSYILYKIDDSAKYTSFQIDKKSGGKRTISKPCLKLKMLQRKLANLLYDCIEEKKPNGERLTDFKGSDKTLPKRKRAAKSISHGYEKGLSIATNAEMHIKKRYVYNIDLESFFPSFNFGRVRGFFIKNKQFKLHPKVATIIAQIACHQNQLPQGSPCSPVISNMICKNLDYYLLGIAKENGCVYTRYVDDLTFSTNKKKFPVAIAENRLKFFGKQSWSLGKEVEEAILKAGFKVNRKKCRMQTSYSRQEVTGLTVNRKVNTSSAYYRNVRAMCHSVFKHGYYTLPQQKEPPKKQGWLSKLTSIFGLKIGVNEPNIAQLEKQTSLESLQGKLAHIYNIKSYRNKFSRRGYRPTKHDGIRTNNSKNPFPPLDRSETYTDDNHIVALDGIKNLYGKFLFFKHFYANKKPTIICEGKTDNIYLKCALESLVAKYPRLSKDKNGNFQVHFFNRTETSSEMLKLVEGSPGLVYLVEIYKRFTKLFNSNGQEYPVIIVVDNDDAGRGVIKKADKIRQENRNAKSIKKVRRSDYFFENLYIVKVPSTAGEKDKEIEDLFDPILLQTKLNGKTFHRNNTGLDPNKHFGKAHFSEYVVTPNKGSIDFRGFEPLLDIINDIVNNFNPNDLD

SEQ ID NO: 908 - protein, 653 aa, unidentified
  source 1..653: note = Related to NZ_CP058972.1; note = Pseudoalteromonas sp.
MSQLEALRKSKSINDLAPILGYKPKSLAFILFKIPDQDKYTCFNVAKKSGGKRTISKPCDKLKALQRKLADLLYSCSDELKPINQSIKSFKGGNKQIPLSERAKKSISHGYEKGLSIASNASMHTNKRYVYNIDIKSFFPSFNFGRVRGFFIKNKNFRLHPKVATLIAQIACFENELPQGSPASPVISNLICKSLDIELLSIAKRYSCIYTRYVDDLTFSTNQKLFPKEIAIKPRFGFGRENWRLGKEVEATIIKSGFQINTKKCRMQYKTSSQEVTGLTVNKKVNVRNLYYRNVRAMANSLFKYGFYYRPAPSTSKIRDESKKSLYQRIYSIFFRRVVRAAPTKKKVKQIESADPLIGMLAYIFNIKSYRNKFVRRGFRPDIHNGIRTKSNGSITFPTVDRSESYEDDNHVIALDGIKNLYGKVLFYKYFYALEKPLIIGEGKTDNIYLKCAIEGLANTFPQLAKNSSGSQQVSFFNRTPTNTDMLRLAEGTPGLEYLISIYKRFMSFYKCEGKQHPVIFIVDNDDAGRGFINKASKIRDQIRSAKKVKTQRHKYYYFENVYIVPIPKQKFNGNKVKDIEDLFDDSVLAEKLEGKSFYNNNKGLDTSKHYGKAYLSEYVIKPNKNKINFNEFQPILADIADIIKSYDNNNLD

SEQ ID NO: 909 - protein, 651 aa, unidentified
  source 1..651: note = Related to NZ_VJWL01000003.1; note = Aliidiomarina halalkaliphila
MSKLTQLKQSSSLSDVASLLGYKPSALAFILYRMDDVDKYFTFDVPKKSGGHRVICAPCDKLKKLQRKLADLLYDCIEEDKPSEETLGEFRGENSDLPLRKRARKSMSHGYEKGLSIATNAEMHVGKRFVYNIDLTSFFDCFNFGRVRGYFLKNSRFRLNSKVATILAQIACFQNKLPQGSPCSPVISNLISKHLDYHLLSIAKNHSCTYTRYVDDLTFSTNQKAFPKAIAKRRFLTLEKGSWRLGSAVKGAIENAGFSVNENKSRMQYRDSRQEVTGLTVNKRVNVSSSSYRQIRSMCHSMFKFGYYFKSSARTVSKPKTNSILTRLYNKFALKYFRVHTQDDELGDTQGQECTSLASLDGMLAHIYHIKSYQNRFSRKGHRPSSHDGIRTKFNESSSYPPIVRGDTYASDNHRVALDGIKNLYRKFMFFRYFYYNEKPLIICEGKTDNIYLKAAISRLGNAYPELYDATTKRCRISFFSKSDRNLEILKMAEGTSGLSYLIKSYKRLCSKYKIKGGSHPVIVIVDNDDAGRGVIKKAEKIKNDTIKSKGIAANYRLDYFFENLYILAVPSGAGDADIEDLFDSSVLNRELSGKKFSRKNKKSDGSTYGKAWFAERVIKAEREKINFAKFAPLLDQVRDIIKAHDSRNLI

SEQ ID NO: 910 - protein, 647 aa, unidentified
  source 1..647: note = Related to JABWTP010000017.1; note = Photobacterium damselae
MTTSLNSLKKCSSLNDFALLLGYQPKSLAYVLYKIEDKKKYTSFEIPKKSGGVRVIQKPNVKLKLLQKKLAVLLYECIEELKPEGEKLVDFNGGKNKLPIRKRAKKALSHGYEKGLSISTNAEQHINKKYVYNIDIESFFPSFNFGRVRGFFLKNKNFRLNPKVATVIAQIACFENCLPQGSPCSPVISNLIAKNLDYMLLSIARRNSCTYSRYVDDLTFSTNMREFPKSIAYQRILTLRKNPWILGHEVENAIKDAGFKINPKKSRMQMNHSRQEVTGLTVNKKVNISSGYYKMVRAMCHQFFMEGYFYKPQKEKKNISKSYFNKLIDIFKKERFEVINDESIERVKLDSPDILQGMLAHIYNVKSYRNRFARRGYRPTRHDGIFTKHKNPSPFPPLDRCDSYTDINHIVALDGIRNLYGRFLFFKYFYLLKKPLILCEGKTDITYLRCAIDQLATSYPYLRNDKGNNQVSFFNKTKINVEMLKLAEGTSGLTYLIDIYKRFSSQYKCEGQLHPVILLVDCDAAGNGVLNKAAAIRDSNRKAKKIEKQRHADYYFENLYIVKIPAKNKGKTDIENLFPDEVLNMELNKKKFNPKNKGADSDTEYGKAYFAEYVVRANKNKIDFSGFKPLLDNIQDIITTYDHNELD

SEQ ID NO: 911 - protein, 647 aa, Vibrio sp.
  source 1..647: note = Related to PIEV01000027.1; note = Vibrio splendidus
MTTSLHSLKKCSSFNDFAILLGYQPSSLAYVLYKIQEKDKYTTFEIPKKSGGVRTIQKPNPKLKLLQKKLANLLYGCIEELKPQGEKLEEFKGSFKSPPLRKRAKNALSHGYEKGLSISTNAERHVNKRYVYNIDIESFFPSFNFGRVRGFFLKNKNFRIHPKVATVIAQIACHDNQLPQGSPCSPVISNLIAKNLDYMLLSIAKNNSCTYSRYVDDLTFSTNLNEFPKAIASKSVLTLRQNPWLLGKEVEKAISDAGFKINPKKSRMQLNNSRQEVTGLVVNRKVNVSSGYYKMVRAMCHQLFTEGYFYKPKEEVKLTKKTLFSRLIRILKTSTAEKVKEEIETVKLDSPDMLQGMLAHIYNVRSYRNRFARKGYRPTQHDGINTKHNNNNKFPPLDRCDSYTDVNHVLALDGIRNLYGRFLFFKYFYFLKKPLIVCEGKTDNIYLKCAIDSLAKDYPILCKSKENDNQVSFFNKTKTNSEMLKLAEGTPGLTYLIEIYKRFSSQYKCEGQHFPVIILVDCDKAGLGVLRKAASIRDNNRKAKNITQARHKDYYFENLYIVKVPSEDEKKVDIEYLFPDEVLKKELNGKKFNPNNTGGDNEHEYGKAYFAEYIVKANKKDIDFSGFKPLLDNIQDIITSYDPTKLD

SEQ ID NO: 912 - protein, 587 aa, unidentified
  source 1..587: note = Related to NZ_CP025583.1; note = Paracoccus sp.
MSSLSRLKSCKSLSNLAHLVGYEPKKLSYILYKIPDEAKYTEFEIPKATKGVRKISAPIPELKLAQSRLAKVLQNCLTEIEKEQANGENCILSHGFKPHLSISTNGAQHVDRKWVLNFDLKDFFPSINFGRVRGFFMKNKHFMLEEKVATIIAQLACHNGSLPQGAPTSPVISNLVANHLDIRLSRISGKNRCTYTRYADDITFSTNKSEFPEGIAANRDDENSAGDWKLSKRIRTEVKRSGFEINPDKTRMQYRRSRQDVTGLVVNKKVNVKRELYKQVRAQVQNFIKNDTCSKKVKIGGVESEVEVTEAALQGFLSHIFWVKGAEFEYKRLNKATGPAEPGFYKEYRRFLDYKTFVASQQPVVLCEGVTDNIYLQCAIKRSKTARPKLQDSGSSNGLAVKLFQYPKIGSKLRVPSSVQHLNGGTGDLKELIHKYKVRTADLGKRGFISPVILLVDNDQGSRDGLWGAIKTTSGSKKNVDGKKKFYHVTKNLYVIPTPKLAGGKDSMIEDFLPPAVVSQVLGGKTFNPDEKTFDKKKHYGKRILAEKVSKDQATINFDAFSPILDIMEEILDHFSALPKKQGRVVF

SEQ ID NO: 913 - protein, 587 aa, unidentified
  source 1..587: note = Related to NZ_KE557310.1; note = Litoreibacter arenae
MSSLSRFRSCKNVSDLAYLVGYQPKKLSYILYKIPDESKYMEFEIPKATKGVRKISAPIPELKLAQSRLAHVLQDCLAEIEKGQASGENCIISHGFKRHLSISTNGARHVNRKWVLNFDLKDFFPSINFGRVRGFFMKNKHFLLDEKVATIVAQLACHKGALPQGAPTSPVISNLIANHLDIRLSRVATKNRCTYTRYADDITFSTNKKDFPKGIAANRDDGSPSGDWELSKRIRSEVRRSGFEINAKKTRMLFRRSRQDVTGLVVNTKVNVKRELYKQVRAQVHSFIKDDVCFKKVKIGGVKREVKVSEAALEGMLSHIFWVKGAEFNYKRLNRPTGPNEPGFYREYRRFLDYKTFVASPQPVVICEGITDSIYIKCAIKRSKAARPKLQDAKSLSGLAIKLFQYPKIGSKLRVPSSVQHLNGGTGDLKELIHKYKVRTNSLANRGFVSPVILLVDNDQGSREGLWGAVKTASGATKKVDGTKGYYHVTKNLYVVPTPKLTGGKDSMIEDFLPSSVVTQKLGGKFFNPDEKTFDRKKHYGKRILAEKVSRDHASIDFASFSPVLDRIEEVLDHFSAFPMVQGRVKF

SEQ ID NO: 914 - protein, 568 aa, unidentified
  source 1..568: note = Related to NZ_JABVAX010000004.1; note = Jannaschia marina
MKSIEQLKAAAGLSDIAHIIGFKPKSLAYVLYVLPPASRYAQFSIPKSSGGTRDILAPVPQLKLAQRRLCEHLQNCLHDIEAQLTVKSDCILAHGFKRDLSIVTNASIHVGRRWVLNLDLKDFFPSINFGRVRGFFIKNKHFCLQPDAATVLAQIICHDNQLPQGAPTSPVVSNLIAGLLDIRLNKMATQNRCSYTRYADDITFSTNTRDFPQSLAKIDQDGVWTLGNRLHKRIKQSGYAINSKKTRMQFRRSRQEVTGLTVNTEVGIKRERLKNTRAQVDNLVRNGVCHARGNPMQPVGSVSLQGHLAHIAWVKGRYVDHSRSDGHWKREPAYVQTYRKFLDHQTFVASPQPVIICEGKTDNTYFRCSINRIAGAPANLTDKANPTGLAVRLFQFTRTTSWVQRLNGGTGDIKNFIEWYAERMRVLSATKFISPVVLVVDNDSGVKKGGLNSLVKSKTKSAVAIDGSSDFYHVGQNLYLVHTPKSATGGDTMIEDFLPAAVKGQTLGGKTLELDESKFDPKKNYGKVPLAETIVKRQQDKINFDAFLPLLMRVSKALDHFDKSAFKA

SEQ ID NO: 915 - protein, 563 aa, Vibrio parahaemolyticus
  source 1..563: note = Related to AAXMXP010000003.1
MSSLAKLKSCSSRSDLAKLLEIELKHFTYLLYGLSDSEKYFEFSIPKKTGGLREIVAPIDELKDLQKKLSNILQECLSEIEAKSSRKSPSHGFKKERSIITNAKSHTRKRYVINIDLENFFHTFNFGRVRGFFLTNKHFELNEEVSTSIAQIACYKRHLPQGAPSSPVITNLICNILDVRLSNLAKKNKCKYSRYADDITFSSRSKVISKELVRQENHKWSVSGKLKKEIKRADFIVNDKKTRVQYKNSKQDVTGLVVNEKISIPSKYWRTVRAMVDNLLYCGHFTITKRVLEEEELKEVKIEGKIEQLNGMLSYIDSVDLHNAKKGSVQVDLNQRERTYRDFLYFNKFYANNKPTIICEGKTDHVYLRCALKKQYQDHNILIEKSGDDLVSKVSFYKYTELETRLLGVTGGSSLLKAFIANYPKVIRKFSVPASNNPVIILIDNDKGAKEIFSQIKSITDSRSTIDGSELFYKLYDNFYVIATPAEKGKMSMIENFFPKSLLKTELGGKTLELDEKKFDKSKHYGKAYFADRVIAPNYKKIDCSEFSKIFYRIEAAIRDSRR

SEQ ID NO: 916 - protein, 562 aa, Vibrio sp.
  source 1..562: note = Related to NZ_JAHAMV010000022.1; note = Vibrio metschnikovii
MSDLATLKECQTKFDLAKLLQIEPQNLTYLIYGLSDEEKYNEFTIPKKTGGVRRIHAPIKELKDLQRRLSNILQSCLIEIESESKRSPPSHAYKKECSIITNAKSHTRMKWVLNLDLEDFFPSLHFGRVRGYFITNKHFELTEEVSTIIAQIACYDKKLPQGAPCSPVITNLICNILDVRLSKLARENKCKYSRYADDITFSSRSGDISKNIVKNNDHLWEISGKLKKEIVRAGFSINKKKTRVQYKNSRQDVTGLVVNEKVSIPSKYWRTVRAMVDNLLYCGFFTINKIVEEEGERKEVKIMGKLSQLEGMLSHIESIDSYNKKINPTKTLNQREKTYRDFLYYKKFYANDKPVIICEGKTDHVYLRCALKNLSLDFPKLIEKVDGKLRSNLSFYKYSDLEMKLLGITGGSDLLRAFISNYPKVIKKFSAKASSNPVIIVIDNDKGAKEIFSQIKSITRSASPIDGSSNFYQLYDRFYVIATPAAKKSMSMIEDFFPKALLRTKLNGKTFEPDEKKFNKDIHYSKAYFADHVVARTYKTIDCSGFKAIFNRIEAAIEHSKT

SEQ ID NO: 917 - protein, 602 aa, unidentified
  source 1..602: note = Related to NC_016026.1; note = Micavibrio sp.
MSKLAALKSANSVSDLARLLKSKPDTFAYFLYKVPEKNKYTSFSIPKKTGGERKIDAPSDQLSYIQKQLAKYLQDCIEEIGELEKQKLGKKKFSSAAHGFTKDRSIITNARPHRRKRWVLNLDLKDFFPSINFGRIRGFFIKNKNFNLDPDVASAIAHICCYEGKLPQGSPCSPIISNLIGHLLDVRLIKIAKKYSCTYTRYADDITFSSDLRKFPKEIAHKKLFSKKSWELSNSIKQEIEKSGFFVNEKKTRMQYQESRQDVTSLVVNKKVNVKRELYKTLRAQCHTLFRTGGCYEIAYQRPENEKISYLQRILDKIFYRPKKIKEKKEDRKYKTLDQIQGMLNFVYQVRHDRDKKLGIAERKEIESSIKSLYRKFLFFINFYYIDRPLIICEGKTDPIYLKCALKSLHLKYPGLIEKTSEGFDFRIKFFTYSDTTLDILNLGGGCGDLAKLIREYNESCTPYKCSGLLHPVIIIVDNDNEPTEKLFPAIKGITHSKTPILGDKPFYTVTRNLYVIPIPQKNGKSTCIEHYFEESVFDKDINGRKFHPDKGPADGFSCSKNDFAEKIICKQQGSINFSMFSDIFDKIVDVTIHYRTRRSSP

SEQ ID NO: 918 - protein, 570 aa, unidentified
  source 1..570: note = Related to NZ_WTYR01000001.1; note = Alteriqipengyuania halimionae
MNEKKIEQLKACVDRKDLARLLGFKPKALSYILYQRTPCQNYRTFKIPKRKGGERVIDAPNPELLFLQKRASNLLQDCLDEIVQDEGHKRTIHHGFQRKKSIITNARVHRARKFVFNVDLTDFFPSVNFGRILGFFQKNRHFTLEREVAVTLAQICCYDGQLPQGAPTSPVVSNLICQPLDIRLSRLAEKFGCSYSRYADDITFSTSTRKFPRAISRKSLISSKWYSGRILKKEIKSAGFAINPKKTRMQYAQSRQTVTGLIVNDKINVPADYTRLCRAMVDAYVKSGTYFIRKEKLSKSGKVKVTKEPGTDLQLIGRYSFIHNVKSSNFSKENPRPKDLFSYEKDYRRLLLFSKFHFSKIPLILTEGKTDTIYIKAALRRLHKSYPTLITKKGRSFEYNFDFFKFSPTNRRILGIDGGTSHLAGFLSTYRKEAKSFCPILNQKPVICIIDNDNGAKKFFKWTDSSGNKINRDGEVYHLFENVYLLLTPLKNGTEDSKIEDFFTKHTLNEKIGGKSFNPENVGVTEAEYGKAWFASKVVWPKKSTINFNNFKPLLDLIENTAMKVHNPKK

SEQ ID NO: 919 - protein, 556 aa, unidentified
  source 1..556: note = Related to NZ_AUBC01000017.1; note = Salinarimonas rosea
MTSKLTSLRSAKTVYDLASLLGFSPSSITFILYNLPPATKYKTFSIAKRSGGTRLISAPEPRLKSLQRRLADLLQECRDEINALPENKKSRSHGFERQRSILTNANIHKRKRYVFNIDLENFFPSFNFGRVRGFFIKNKKFQLEPKIATLIAQIAIHNNELPQGSPCSPVISNLVADALDRRLDRLARQNRCRYSRYADDITFSARVRDFPADIAVPTGANFDPSAVLQSIIASSGFAINPNKTRMQYSMSRQIVTGLVVNEKPNIRKEYRRTLRAQVDSYAKTGSFTYVDSSGTPIPGRARQLEGKISHACAVKMHNAGPLNDSMRVGEIFKIARKFWLSHLFARRLKPVILCEGKTDNAYLRAALKSLALQYPSMVDSSARNATFKVEFVNLNSLAAEVIGLGGTANLCKLIHNYDKEVLKFSRSRPLHPLIIVVDNDSGAKGVFGKIKEATGKTVDINTKEHFYRIKDNMYVVKVPEGRLNEERAIEHLFDPPVLNTPLHGKIFHPGDKNFDPTKHYGKEAFAQNVVRPQANTLNFRGFVPLLDRIEEVLKDY

SEQ ID NO: 920 - protein, 507 aa, unidentified
  source 1..507: note = Leptolyngbyaceae cyanobacterium SM1_4_3; note = Related to JAAUTN010000370.1
MLGRNNGDSASDNQAKTFSQVSHGFKRKLSIRTNARKHRNRRYVFNIDLTDFFGSINFGRVRGFFIKDKRFRLNSKVATIFAQIACFKKSLPQGSPCSPVISNLIGNILDTHLVRLAARTGCTYTRYADDLTFSTNKRCFPRSIAIQSDDDNHVWIPGPELLRLVNQSGFEINPKKTRMQYHSSRQEVTGLVVNKKVNIRREYRHNVRAMAHRLFTKGSFLLPIYEKDENGDYLLEMKPGSLNQLHGRLGFIDGIDRYNIEILSASKESQIKSKETIYRRFLFYKEFYAASKPVLICEGWTDYVYIENALLKLAPNYPSLVSLDDNGKGSFLIKRFKYSRSHTTKILGIKGGVGDFINFINSYKREFERFSVPGMREPVILLIDNDDGGKKVFNCIRSILGTDLEEMRKAPYIHVHRNLYLISTPLQGNQQKSQIEDLFDFSTLEVKIDGKSFDRSDEKVTETTYSKAVFAQKVVKEMASSINFQGFMPLLDRIAKVIESHYAQRKE

SEQ ID NO: 921 - protein, 304 aa, unidentified
  source 1..304: note = Related to JAAUQZ010000187.1; note = Leptolyngbyaceae cyanobacterium RM1_406_9
MSALKKLRDAESIADVASILGFRTKALSYILYVQPDSLKYKEFDIPKKSGGVRRIAAPQSRLKLLQKRLADLLQDCLDEINGDSASDNQAKTFSQVSHGFKRKLSIRTNARKHRNRRYVFNIDLTDFFGSINFGRVRGFFIKDKRFRLNSKVATIFAQIACFKKSLPQGSPCSPVISNLIGNILDTHLVRLAARTGCTYTRYADDLTFSTNKRCFPRSIAIQSDDDNHVWIPGPELLRLVNQSGFEINPKKTRMQYHSSRQEVTGLVVNKKVNIRREYRHNVRAMAHRLFTKGSFLLPIYEKMK

SEQ ID NO: 922 - protein, 585 aa, unidentified
  source 1..585: note = Oscillatoriales cyanobacterium SM2_2_1; note = Related to JAAUUH010000063.1
MSALKKLKDATTIAEIADILGFKTKALAYILYRQPDSLKYKEFDIPKKSGGVRHIAAPQGGLKLLQRQLADVLQECLDEINNATVGDQARPFVDISHGFKRKLSIRTNAKKHRNRRYVFNVDLIDFFGSINFGRVRGFFMKDARFCLSPKIATILAQIACFKQSHPQGSPCSPVISNLIGNVLDMHLVKLAARRGCIYTRYADDLTFSTNKRCFPKSIAVQSDDDNHVWIPGSELFRLVKHSGFEINPKKTRMQYHCSRQEVTGLVVNKKVNIRREYRHNVRAMAYRLFTKGSFLLPVYEKNANGDYSLEMKPGNLNQLHGRLGFIDGIDRYNIERVSTAKESQIKSKETIYRRFLFYKEFYAASKPVLICEGWTDYVYIENALRSLASNYPSLISLNDNEKVNFLIKCFKYSKSHTTEILGMNGGVGDLKRFIPLYKSEFERFSAPGMEQPIILLVDNDRAGNEVLGVVNNMVKGNKRTKTKVDNNEPYVHIHHNLYLILTPLQPGQSESQIEDLFDASTLAIKIDGKSFNRSDESVTETTYSKAVFARKVVEERASSINFEGFAPLLDRIAQVIESHYAKGKK

SEQ ID NO: 923 - protein, 579 aa, unidentified
  source 1..579: note = Related to PHCH01000051.1; note = Betaproteobacteria bacterium HGW-Betaproteobacteria-4
MFFLHSLKSATSLKDVADLLGFKASALAYILYKKDGASKYKSFEIPKKHGGIRKILAPSDELKLMQRRLSDLLLDYNSEIKAHDGLKNQISHGFEPDKSIVTNAECHRNRRYVFNADIKDFFGTINFGRVRGFFLKDKNFELHETVATILAQIVCHDNSLPQGSPCSPVISNLIGHVLDVHFVKLAARSGCYYTRYADDLTFSTNLKTFPKAIATNVDGENHSWIPGKELARLIKHCGFELNPQKTRMQYRDSRQEVTGLVVNRKVNIRNEYRHHVRAMVHRLFSTGNFDFEQTVVDEKGNSTKTKTPGTLSQLHGMLGFIHGIDVYNKDRLHTPHYDHQHSKLPRSKETIYRRFLLFKEFYAASAPVIICEGKTDNVYLVHAIRRLASDFPKLAAIEKDGAIKLMTRIFRYSDTSTGKILGITGGGPCLKNFINLYRAEIKQFTAPGRFHPVILLVDNDSGANEIYSTLKQIVKPPPSRNDPFVHVFGNLYVVPTPLLPGGGQSMIEDFFDSGIKSSVVSGKTFHPDSDADTETHYGKVIFAHKVIRTNADTIDFSGFKEILANLTAVIDEHAKRFPS

SEQ ID NO: 924 - protein, 586 aa, unidentified
  source 1..586: note = Related to NCKJ01000107.1; note = Halothiobacillus sp.
MTHLDGLRSAKSFHDIASLLGFKPRALAYIIYKIPVDQRYESFDIPKKRGGYRKISAPNSKLKLVQQRLANILQNCVEELNKSKRINDHISHGLKRKRSILTNAKKHRNRRYVFNIDLNDFFGSINFGRVRGFFIKDTNFKLEPNIATILAQICCHDHSLPQGAPTSPVISNLIGHILDIHLVKLASTNGCSYTRYADDITFSTNKRNFPENIAKQENINIHDWAPGHDLDQLIKISGFTVNPTKTRMQYCDSRQEVTGLIVNKKINVRSDYRHTVRAMVHHLFTHGFYYLPQNKPPKETEISEENKGTMDQLHGMLGFIDSVDLYNKKNASSAVVPRTEKQKLTSKESIYRRFLLFKLFYKAKAPVIICEGKTDNIYITHAIRSLAKNHPNLASINNDGSIQLKVRLFKYSETSTGRILGINGGTGELTKFIPLYHNETKKFKALGCDQPIIIIVDNDSGSNGNGRTFNAVRAIKKDADPKHAPFTHITQNLYLIATPLSLDGSDSMIEDFFTPETLSIEVGGKTFNRGNGINLNKEYGKNIFAQHVVKTMADSIDFRGFNPILSTIETVITTHAKTITSESEET

SEQ ID NO: 925 - protein, 572 aa, unidentified
  source 1..572: note = Related to JYOD01000041.1; note = Burkholderiaceae bacterium 16
MSLLAELKEATTIHDIASLLGFKTAALSYILYVKSDASKYKTFDIPKRSGGVRQISAPYSDLKLLQRRLADLLQNCADEITKNQGRGDEGKNPDRISHGFRRRRSIITNAKQHCKRRHVFNIDIENFFGSINFGRVRGFFIKDNNFDLNPKIATILAQIACTNGSIPQGSPCSPVISNLIGHILDTHLVRLAKRAGCTYSRYADDLTFSTSLRDFPDTIATRCPVNEHDWQPSHELERIITQCGFSLNNSKTRMQYQEARQEVTGLVVNKKVNVRSAYRRTVRAMVHQLFTTGKFHIPGTPETQGSLNQLHGMLGFVDGIDLYNRSLRAKNSGSLGDKEKMYRQFLLFKEFYSADVPVLLCEGKTDNVYITHAIRSLADKYPKLATKKTDGSVTIDFRRFRFTGTSTGRILRLQGGTPDLKAFAELYREESVRFKAPGMKHPVILLIDNDDGARRIYGFIQGITGKRPDGSESFVHVFKNFYVCATPLLAGAKESKIEDFFDPKTLDTKIGAKTFNSKNEIDTAMHYGKAVFAYKVVEAHADKIDFSAFAAIFDNLVKILDYHAAKFVTETA

SEQ ID NO: 926 - protein, 605 aa, unidentified
  source 1..605: note = Burkholderiales bacterium PBB6; note = Related to NKIH01000004.1
MSQLTALKSASTLHDVAAILGFKPSALSYLLYVCSEATKYRTFDIPKRSGGTRQIAAPVGPLKLLQRRLADVLQNCVDEINRTNKRSDDDKQPDCIAHGFKRKRSIITNARQHRNKRFVFNLDLEDFFGTINFGRVRGFFLKDKNFALQPKVATILAQIACYQRALPQGSPCSPVISNLIGHVLDIHLVRLATLTGCTYTRYADDLTFSTNKQAFPSMVARSAVGNEHVWEPGKELGRLVTKSGFAINTNKTRMQYRDSRQEVTGLVVNSKVNVRQEYRHTVRAMVHRLLSTGSFDFEYTTTDSAGVKSTIKTLGRLTQLHGMLAFIDGVDLSNKSVLPKASGISLTSKELMYRRFLLYKDFYAATTPIVMCEGKTDNVYIAHAIRSLATLYPKLATVGSSGKITLTIRRFKYPGKKTRKHQSRNAGNSTGRILGVNGGSNDVGNFMRTYAAEIGRFRAPGKLHPIIVLIDNDSGAAPVYNTIQRLTGTKPTGTEPFIHIIGNLYVVPTPLLTTKASMIEDFFDSATRAIQYKGKPFDPSNKFDSKTHYGKADFAYKVVQPNADKIDFNGFKAILDRFSDVIDQHAKTHNAVPLSIPAVAAAAAP

SEQ ID NO: 927 - protein, 602 aa, unidentified
  source 1..602: note = Burkholderiales bacterium; note = Related to JACZJU010000112.1
MSQLNALKTATTLADIAKLLNSEASGLAYVLYKVPEALKYKEFDVPKRYGGTRKISAPSDALRLLQQRLSNLLQNCLKEIEESGGRRHDVSHGFKRGRSIMSNGESHRRKRYVFNVDLKDFFPSINFGRVRGFFIKDKNFLLSPKAATFLAQIACYKNALPQGSPCSPVISNLVSHVLDTHLVRLAAKEGCRYTRYADDLTFSTNKTEFPKSIAKRTDGAPHDWIPGAALVKLVEKSGFAINPSKTRMQYHDSRQEVTGLVVNRKVNVRSDYRRTVRQMTHRLMTKGNFESVHKMVNSDGTKSVTKIPGTVPGLHGMLAFIDQIDLYNLKQVEKGLADSDKVKERIKLATKESVYRRFLLFSQFYAAPKPIVLCEGSTDNVYLVHAIRSLVADLPTLATKLPSGEIEINVRFYRYFKRRKKKLANEHSKAISSTGRILDLKGGSGELLKFAKVYKTHLAKITAPGAYQPVILLIDNDKGANDMFGYIKGVTQIKEPKNEPFVHLLRNLYVVPTPLTPDKPNATMIEDFFSDDWKKTLVEGKPFNPEKDHEDHTCYGKVIFAHRVVRPNAEKIDFSQFKQLLLNISSVIESHRKTHPPPGKAS

SEQ ID NO: 928 - protein, 344 aa, unidentified
  source 1..344: note = Betaproteobacteria bacterium; note = Related to SHXF01000114.1
MSQLKAIKTATSLAEIAKLLEFETSSLAFILYKLPDALKYKEFDVPKRYGGTRTISAPVDRLRLVQQRLSNLLQNCLSEIENNGGRKHDVSHGFKRWRSIMSNGENHRKQRYVFNVDLQDFFHSINFGRVRGFFIKDKNFLLNVKVATFLAQIACYKNVLPQGSPCSPVISNLVSHILDTHVVRLASKEGCRYTRYADDLTFSTNKTKFPASIAIRAGSAPHNWIPGTTLVKLVEKSGFAINQSKTRMQYCDSRQEVTGLVVNRKVNVRNDYRRTVRAMTHRLMTKGDFEFVHKTVSGDGTESVSKIPGAATRLHGMLAFIDQLDLYNMNQVKKGLIDTDKVTE

SEQ ID NO: 929 - protein, 589 aa, unidentified
  source 1..589: note = Related to JADJFI010000002.1; note = Sulfuritalea sp.
MPRLAILKGAANLSDVAHLLGFKPSSLSYLLYKLPAPLKYTEFDIPKRHGGLRKISAPIDSLKNLQQHLSQLLQDCLDELEEAGLRKNNSAHGFTRHRTIMTNAMEHRNRRFVFNADIKDFFPSINFGRVRGFLIKDKHFALNPAVATVIAQIACHNNALPQGSPSSPVISNLIAYVLDTHLVSLAQHTGCHYTRYADDLTFSTNMPNFPNAIAVCVGGNAHNWAAGQSLTAIVSKSGFSLNSAKTRMQYRDSRQEVTGLVVNEKINVRSEYRHKLRALTFRLINKGEFSIIHKSVDILGNITTNVIPATPAQLKGMLAFVDAVDIAQRDDAIRQFHDKHQDGQIKYERYKLVRKENTYRRFLMFNEFFATPKPVVLCEGPTDRVYLRCAVKRLAADFPTLATINAAGEVSLNFRRYKYADSNTNRILKIHGGASQLMGFISEYRSAAEKFLAPGPFEPVIVLVDNDDGPEELFKYLAKVNKVKAPRTEPFVHVCANIYVVPTPLGPNGEPTCIEDFFPSHLFKEEVAGKTFNPKKKHGDNEKFYSKEIFAEKVIAKKAGTIDFDAFKPLLSNIERAINTHRKNHPKPK

SEQ ID NO: 930 - protein, 590 aa, unidentified
  source 1..590: note = Related to FAOS01000003.1; note = Janthinobacterium sp.
MILLAKLRSAKTIHHLAAILGFKASALAYILYGKGGASNYKKFDIPKRYGGARHISAPMPELKLLQSRLSDVLQNCLAEINEAAGRSDKIFDRVNSRADRISHGFRRHRSIITNAREHRNRKFVLNVDLKDFFGSINFGRVRGYFIKDKKFLLSPEIATMIAQIACYENTLPQGSPCSPILSNLIGHVLDVHLVGLAAKKGCVYSRYADDLTFSTSKPVFPSSIASSDPTNEHLWLPGKELVRLVEKSGFEINPSKTRMQYRNSRQEVTGLIVNKKVNVRSEYRNTVRAMVHHLFTTGTFEILQRVSDGKGGVTISQVPGKVNQLHGMLGFIDGVDLYNKKLIGVAKGASNLPSKETMYRRFLLYKEFYATTSPVIVCEGKTDNIYILHAIRSLAATYPKLATTNADGTIKLNVRIFKYSGTSTGRILKMHGGTGDLGNFMLDYRTECARFKAPGQQSPVIFLVDNDSGASSIYNIVKQITKKKVTGTEPFVHVTGNLYLCATPLIAGATESMIEDFFDSATKAITIGGKTFDPDLDDETAKHYGKVVFAHKVIRANANKIDFKEFNPILSNIVAAIDAHSEKVVSAGVP

SEQ ID NO: 931 - protein, 576 aa, unidentified
  source 1..576: note = Related to NZ_CP036357.1; note = Bordetella trematum
MWATHPPPFMTQLKKLKAAKDIYDISTLLNYKAGKLSYILYVIDESDKYSSFEIPKKGGGTRTIKSPIPKLKRLQKNLSNLLQNCLDELRSENSYVDPMSHGFEKKRNIITNAEVHRAKRYIFNIDIKDFFGSINFGRVRGFFIKDNRFELDPKIATIIAQICCHENSLPQGSPCSPVISNIIGHILDVRLLSLAIKNGCSYTRYADDITFSTNKKKFPSSIAAKDDDGHGWSVGKELSDILKTNKFSENKNKTRMQYKTSRQSVTGLVVNKKINVRSEYRKQVRAMVHSLFSKGTFFIPKAGVAPMDEFPEGTLNQLHGMLGFIDSIDQNNVLRQGLEAASITQKEKTYRKFLLYKDFYLSTRPIILCEGKTDNIYLKCAIKSLAGQHQLLGERVGVDSFKMKVRFYKYAETSTGRILGLSGGTGDFPKFINSYLSGISKFTALELNHPVIMIIDNDSGAKGIYSKLREILNRQISPAEEYIYAGENLYIVPTPIAKHGQHSMIEDCFDKDTKKILVDGKKFNPDDKASIDMFYGKSVFATQVIERFSEKINFNGFSVFLSRIESAINHFHNMKG

SEQ ID NO: 932 - protein, 558 aa, unidentified
  source 1..558: note = Related to NZ_NEVN01000010.1; note = Bordetella sp.
MATILSFQPKTLSYLLYVASDTQKYRSFELPKKTGGTRTISAPTDKLKRLQSNLADLLQRCLDDLKISAEYSDSASHGFQRGKSIISNAAQHRAKRYVFNIDIANFFGAINFGRIRGFLIKDTRFALHPTIATIIAQIACRENSLPQGSPCSPIIANLVGNILDRRLIALAAKYGCTYTRYADDLTFSTNKKVFPPRIASRTTDHTWAAGEELLAVLQASRFSPNPQKTRMQYKTSRQEVTGLIANKKVNVRSDYRKRVRAMVHRLFSTGSFNLPENPTPGAGRTRDAEPGTLNQLHGMLSFIDSVDQYNIQRSKLKLDQLSQKEKTYRKFLLYKDFYLAEQAIILCEGKTDNIYLRNAIKGLPNDFPLLGSNDSPDQFKINVRFYRYAESSTGRILGLSGGTGDFPNFINAYLTALAQFPALKIRHPVIILIDNDSGARPLYSSLAQRLHRKIDPRESFIHVESNLYVVATPIIEPASESMIEDFFDETTKKLVVKNRHFDPRDDADQRYFYGKNTFATEVVERFSDSIDFSGFSELLCRIEMAIRHFHSAHSPANS

SEQ ID NO: 933 - protein, 577 aa, unidentified
  source 1..577: note = Related to NEVU01000001.1; note = Bordetella sp.
MTQLQKLKEAKNLHDVATLLNFKPNKLSYLLYIAEDEEKYKTFEIAKRSGGTRSIAAPDPRLKQLQRNLSVLLLNCLDELREKKLYKDDMAHGFLRKKGIVTNAVTHRAKRFVFNIDISDFFGSINFGRLRGFLIKDDRFELNPNVATILAQIACRNHTLPQGSPCSPVISNLIGHILDVRLAGLAAKNGCRYSRYADDITFSTNKKEFPQAIAMREPDSHAWVVGAELEVVLSANNYSLNTKKTRMQYCDSRQTVTGLVVNRKVNVRSEYRRRVRAMVHRLFTTGQFAVPSTKVAATAAGAVSSEEPGSLPQLHGMLGFIDGVDQYNIRKHGLRLEELSEKEKTYRKFLLYKDFFLAERPVVLCEGKTDIIYLKNAVRQLAAKYPKLGEQTGENKFQHNVRFYKFADSSTGRILGLSGGGGDFQKFAHAYLSEVGQFPTHPIAGLKHPVIIMMDNDSGANAVCSYALKRTKISVDRGGDFFRLGENLYLVLTPFLHGEKPSTIEDFFDDAVKLRTVEGKAFDPGDEHDTGTHYGKAIFAKEVVEKYADEIDFNAFRGILSRIEGVMSDYYASRLAL

SEQ ID NO: 934 - protein, 572 aa, unidentified
  source 1..572: note = Related to NZ_JACHGB010000002.1; note = Quisquiliibacterium transsilvanicum
MSKLESLRKASTLHDLARLLGFKAKALAYVLYVIPEAKKYTEYKIPKRSGGARTIQAPVAELKLLQRRTSNLLQDCIGELADKGQRSDPFVHGFRRHRSIITNASRHRNRRLVVNLDISDFFGSINFGRVRGLLIKDDAFSLNPSVATVIAQIACHENALPQGSPCSPVLANLVARPLDLRLLAHAKRRGFVYTRYADDITFSTRLKNPPAAIVQHKPGTGLHAWEAAPTLVRAIEKSGFSVNASKTRAQYRDSRQDVTGLVVNRRVNVPREYRRQVRAMVHRLTTTGAFEIRKNVLAAGSTTLRAIPGNFEELQGMLGYIASIDAAAEHNRKDNAIAARSQRETYRRFLFYREFFCVDRPVIVCEGKTDNVYLRSALRKLAPLFPSLASVTASGELRMNVRLYKADGKKTSSLMGLTGGAAPLLAFLREYRKASETFVSKGNRFPLIVVVDNDGASKDIFSFIKKITGSHKMIDGSEPYYRLMPMVFVVPIPKPPSSTTAAIESLFDSSLLSTIHKGKIFHGSDKGFDEDKHYTKSVFAKEVVEPHFDKINFDGFKPLLDAISEVVGLSSP

SEQ ID NO: 935 - protein, 579 aa, unidentified
  source 1..579: note = Related to JAAZTX010000005.1; note = Acidithiobacillus ferriphilus
MSRLAELKASTTLSDVAHLLGYKPKAVSYILYMLPTDQKYTTFEISKRNGGQRTINAPVEKLKVLQRRLADLLQDCLDEINNAKGLKDRAAHGFKRKLSIITNARQHRHRRWVFNVDLENFFPSINFGRIRGFFIKNRDFQLHEKVATVLAQIACHDHSLPQGSPCSPVISNLVAHLLDMRLVKLAQIAGCTYSRYADDLTFSTNKKQFPLEIGWPATDQGPDSHIWLPGDALRKTINRAGFTINPNKTHLMYRTSRQRVTGLVVNKKINIRWEYRHNVRAMVNKLVNTGEFELNGIVHKDGNVSIEKRPGRLNELHGMLGFVNDIDVYNSRQTNDKPPGFSSTERVYREFLIYSIFYAAQMPVILCEGDTDNVYITHAIRSLAREFPDLAEVRADDKIVLKVRLYKYPKSSTSHLLGLGDGGSSVLSKFISEYKKEISRFKAPGLAHPVIIVYDNDDGARSIRNTIKQITKSTPKVTNPFDHVTKNMYAVPTPIPEGEAASKIEDFFGEMIKSTVVNGKIFNDGNNIDATQHYGKRVFAHKVVRPKAQMIDFTGFRQLLSNIVEVIKYHKAAVVMPPP

SEQ ID NO: 936 - protein, 582 aa, unidentified
  source 1..582: note = Blastocatellia bacterium AA13; note = Related to QHVH01000010.1
MSRLASLKAATSLSDVAKLLAFKPKAVSYILYKQPAATKYRTFQIPKRNGGERTIKAPDEALKLLQRRLSELLQDCVDEINTVKQRKDRTAHGFKRKRSIITNARQHRHRRWVFNVDLEDFFPSINFGRVRGFFLKNRDFELHEDVATVIAQIACHENALPQGSPCSPVISNLVAHLLDMRLVRLASDAGCTYSRYADDLTFSTNKREFPANIAVSSGNEGDASHLWLPGEALRKVIKRTGFRINAKKTHQMYRASRQNVTGLVVNKKINVRWEYRHNVRAMVHSLVRTGAFQILGVTSKDGHAVLEKRPGDLNELHGMLGFIYSIDVYNKTHPSDAFAEGMSASEKVYREFLIYSTFYAAEAPIVICEGETDNVYLTHAIRSLAAEFPSLAEVRSDGKIHLRVRLYKYPHSSTARLLGLNDGGSGVLSKFIAAYKKETKHFTAPGLTDAVVILYDNDAGAKGIRQAIKNVSGVKATGDEPFVHVIKNLYAVSTPVEAPATQSKIEDFFDATIKATVIDGKMFNEGDGFNADQHYGKKVFAQQVVRSKADIIDFTGFRALLTNLTEAINSHKASVVPQPPEP

SEQ ID NO: 937 - protein, 576 aa, unidentified
  source 1..576: note = Chloroflexi bacterium; note = Related to JADBLS010000169.1
MSRLAALKASTSLSDLARLLDFKPQALAYILYKQPEAKKYTTFQIPKRNGGQRTIKAPVDALKLAQRRLSHLLQDCLEEINTNQNRKDRTAHGFKRKRSIITNARQHRHRRYVFNLDLEDFFPSINFGRVRGFLIKNRDFALHEHVATVIAQIACHENSLPQGSPCSPVISNLVAHLLDMRLVSLASAAGCTYSRYADDLTFSTNKKEFPTEIAVPLGTEGGESHLWGPGDELQKVIERMGFRISAAKTHLMYRTSRQDVTGLVVNEKINVRWEYRHNVRAMVHRLITTGAFEIYGVTQRDGKAALEKRQGPLNELHGMLGFIDSIENYNKKNTHDSPSDRPSSMELVYRQFLIYRNFYAAESPVVICEGDTDNIYLTHAIRNLAAEFLDLAEVKEGKIRLKVRLFKYPHSSTARILDLGDGGSGVLSDFIGTYKREIGHFTAPSSQSPVVIIYDNDSGARGIRSAIRSVSKVQPTGTEPYVHVVKNLYALATPLVGTTTESKIEDFFDDAIKATVIDGKTFNDKNKIDAAKHYSKTVFAHRVVRPNADTINFSGFRPLLTNLVAVINAHKASIAV

SEQ ID NO: 938 - protein, 590 aa, unidentified
  source 1..590: note = Candidatus Nitrospira kreftii; note = Related to CP047423.1
MSRLAGLKAATSISDLATLLGFKPKAISYLLYKQPSEYKYTTFQIPKRSGGQRTIQAPVERLKLLQRRLSDLLQDCHDEINASAKRKDQIAHGFKRDRSIITNAKHHRNRRWVFNIDLEDFFPSINFGRVRGYFLRNRDFMLQERVATVIAQISCHENSLPQGSPCSPIISNLVTHVLDMRLVKLASECGCTYSRYADDLTFSTNKKDFPFQIAGPSAISADRAHLWLPGEPLKQVIERTGFRVNSKKTRMMYRDSRQNVTGLVVNKKINVAREYRHNIRAMVHRLVTTGQFEILGPVTRDKKVVLEKRPGTLNELHGMLGFVDSVECFNHSRTDEYSASLKATYRRFLFYSTFYAASAPVLICEGETDNVYLTHAIVSLASEFPELAELAGAGKTRLKIRIYKYPRTSTARILGLKDGGSAVLCNFIKDYPKEVARFSGPGLAQPVIVIYDNDEGCKGIRSVIANISKVKPTGTEPFTYVYKNLYAVPTPLQEGVTSSKIEDLFEARIKETIIEGKTFNEGNSLDPHKHYGKKVFAHKVIRPNADKVDFTGFRSLLTFPRFHRHLYKEEFDEIGGQHEHQDQTAVYGRV

SEQ ID NO: 939 - protein, 579 aa, unidentified
  source 1..579: note = Related to JACQSX010000029.1; note = Acidobacteria bacterium
MSRLNNLKSTATLSDLARLLQFKPSGLSYILFKQPAATKYKTFEILKRKGGTRTIKAPSNPLKLVQQRLSILLQDCVDEINKAKNRKDRIAHGFKRKRSIITNARQHRNRRYVFNIDLEDFFPSINFGRVRGYFIRDRSFALNEDVATVIAQIACHENALPQGSPCSPVISNLIAHVLDMHLVRLASKVGCTYSRYADDLTFSTNKKDFPADIAKPSETEPHLWLPGAELQRLIAHAGFRINTAKTHMKYRTSRQEVTGLVVNQKINVRREYSHNVRAMVHSLLKEGSFELYAATEKAGAVTIEKRRGTVNELHGMLGFIDSIDLYNKKNAPESKDSGRLSSKELMYRQFLIYKDFYIAEAPVIICEGKTDNVYLTHAIRRLVAEFPDLAEITTQSKIRLKVRLYKYQRSSTARILGLRDGGSSCLTKFIETYKKETDKFTAPGQKNPVIILYDNDSGASNIRSLLKQTFKLTVGTEQFVRVVRNMYVVPTPLLNGANESKIEDCFDAATKATVIGGKTFNDKNGLDTAKHYGKKIFADQVVRDREDSINFEGFRQLLTNLVAVIQSHTTAVSGASAPQ

SEQ ID NO: 940 - protein, 578 aa, unidentified
  source 1..578: note = Related to JADZCM010000017.1; note = Bryobacterales bacterium
MPRLASLQSAATLSDLARLLRFEPSGLSYILYRKPAAKKYSTFEIPKRHGGTRTITAPDDDLKLVQQRLSDLLQDCVDEINTAKNRKDKLAHGFKRKRSIITNARQHRKRRWVFNLDLEDFFPCINFGRVRGFFLRDHNFQLQKHVATTIAQIACHANGLPQGSPCSPVISNLIAHVMDMHLVRLSSKVGCTYSRYADDLTFSTNKKEFPPEIAKPSATDPHLWLPGPDVQALVNHAGFRINNSKTRMNYRTSRQDVTGLVVNEKINVRHDYRHNVRAMVHRLFSTGEFELWGIIDKGGTKTLEKRPGSLDELHGRLGFIDSIDQFNKKIASDVNYTRYPAGRESMYRQFLIYRDFYAASKPVILCEGETDNVYLTHAIRSLAASFPELAEIDSNGKRHLKVRIYKYARSSTARILGLKDGGTGHLKHFIGTYSRETDRFKAPGLKQPVIVLYDNDNGANPIRSAIREVSKKAVKATDAYTHVVRNLYAVPTPLLNNAKESKIEDFFDAAIKATVIGGKTFVAANDYDSTKHYGKKIFAHQVVRPKADTINFKGFGPLLTNIARIVKDHAAVVGATAP

SEQ ID NO: 941 - protein, 633 aa, Achromobacter sp.
  source 1..633: note = Related to JABBJN010000001.1
MTKLEQLRRATTLRDLAELLGVTAPGLAYILYHKPRDQLYRAFEIPKRKGGTRSISAPADELKTIQKKLSSLLQECWAEIGDGKNSGRHPGRKGRVAHGFLPGRSISTNARQHRRKRFVFNVDLEDFFGSINFGRVFGLLRQDNNFKLQPRVAAVIATIACFENKLPQGSPCSPIISNLVARILDARIAGLAAKVGVNYSRYADDLSFSCNGRIFPPEIAKKIEGDDHSWVVGKALNSVIEKTGYRVNLSKTRMQYEDSRQEVTGLVVNRRVNVRSEYRRAVRAMGHRLFSTGAFDVPKVALTKGNDFPMQSVQGTIPQLHGMMSFVASIDRLHREAALSRGDAIEETSAEKLYRNFLYYRFFYKNDAPIILCEGITDNIYLRCAIRALRESYPLLVKPKAEPGDLLIKFYKYRGAAVDTVLKLKDGGAGNLQNFMVAYKKACQLFLGAGKENPVILIVDNDEGGRKVMGAAKELSGKAYDGSQAYLHVFGNLYLIATHPTAVVDGGQKKMAQKGARPSDSCIEEYFSSEVRSTKLNGKTLTLKNDSSGVAHYGKMDFAKHIVENLRGADSFSGFARLLDRINLVVTAHASSSTEAAVSGAAASQLSNGGLGAAIPPTGETIAGFTEIAEAAD

SEQ ID NO: 942 - protein, 593 aa, unidentified
  source 1..593: note = Related to NZ_CP088952.1; note = Massilia sp.
MTQLAALKKASSLNDVADLLGYKPAALAYILYQISDENKYTSFSIPKRSGGVREIKAPIDKVKALQKKLANVLDHCLDELNAVHQYRYQSSHAFRKNKSIFTNASNHRAKRWVFNIDLENFFTAINFGRVRGYFIRDRQFELAPSIATILAQIACSGNSLPQGSPCSPVISNLIGHILDVHLAKLAARVGCRYTRYADDITFSTNDPQFPSAIAICDVEDSRVWHIGNELQCLIESSGFAVNIKKTRMQFKDSRQDVTGLIVNRKINVKKEYRRTVRAMVNRLLTVGHFERKRRVKNNAGEWVLADVAGTAEELHGMLGFIESVDKYNSSLPLKKGGKRKEGEKTGVDEKRLTASTGKDNLYRRFLLYKEFFAAPCPVILCEGETDNVYLIHAIRSRAADFPMLAKVSETNEITITPRLYKYVKTNSGRMLGLGSGGTGDLGKLIKNYLSELHRFVRPKQQHPFIILIDNDAGAIGGGRPLEVLRKKGVDIDRTAPYIFVMGNLYLVPTPLLGKEESMIEDLFGQNVLDESLDGKTFCRKNKADNGRHFGKTVFAHKIVRPNADHIDFSGFDPLLINITAVIEDFYKKHPRVA

SEQ ID NO: 943 - protein, 606 aa, unidentified
  source 1..606: note = Related to NZ_CP080379.1; note = Massilia sp.
MTQLAALKASTSLIDIAHLLGYKPSALAYILYKIDDEVKYANFEIPKRSGGKRLVSAPIPELKALQRKLAELLENCSIELTEAGKHDDKSSHGFKKGKSIFSNAKGHRNKRWVFNIDLENFFGTINFGRVRGYFIKDRNFQLSPTVATIIAQIACHKNCLPQGAPSSPAISNLIGHILDIHLSKLAAKFGCHYSRYADDLTFSTNKPSFPHQIASPDSIDPQAWTPGSELSRLIDNSRFSINSLKTRMQYRDSRQDVTGLVVNKKLNVKAEYRRLVRAMVNRLLTLGHFEREKRLSDEKGNLVLTKVPGKTDELHGMLGFIDSVDRYNLNLSIPAGGKVHDEKKKAAADEKNTRPGLTGKDHLYRRFLIYKEFFAPSRPVILCEGDTDNIYLIHAIRSLSAKYPLLAKLQNEKLEILPRIYKYVDTSTGRILGLNSGGTGDLGKLIRSYLAEINRFIRPANQHPFILLVDNDKGAIGGGRPPDVVKKVVGKEMDRSAPFLYVAGNLYLVPTPLLDGKLESMIEDFFDDKTRSRDIDGKVFNPANKADNSKYFGKKVFAHKVIRPNAEDIDFSRFSSLLDNITLALEDFYKKHPHSATVDKPAKKAA

SEQ ID NO: 944 - protein, 605 aa, unidentified
  source 1..605: note = Related to NZ_RXLQ01000009.1; note = Massilia atriviolacea
MTQLAALKAASSLHGIAHLLGFKPAALAYILYKLNDSQRYKQFEIPKRSGGKRTIKAPTAELKLLQRKMASLLENCISEINVANKRADLFAHGFKKGRSIFSNARPHRNRQWVFNIDLENFFGSINFGRVRGFFLKDRDFALHQGAATIIAQVACVDNALPQGSPCSPIISNLIGHLLDVHLAKLAASCGCHYSRYADDLTFSTNAPQFPSRIATRTRGAAGDEWMPGAELHRIIQHARFAINPQKTRMQFKDSRQDVTGLVVNKKLNVKTEYRRSVRAMVHRLLTHGHFERTKRVDDGAGNHVLDAVKGTTAELHGMLGFIDSVEHYNRNLVLPKGGKPKVEKKKKGTEPNKPRVALTGKEVLYRRFLLYKEFFATSNPVLICEGETDNIYLVHAIRSLATHFPLLATVVKPGEIKIIPRIFKYVETSTGRILGLGSGGTGDLGNLIRQYDKEIKRFVRPATQHPFILVVDNDAGAVGAGRPLQASKQVTGLDVNRHAPFTNVCGNLYLVPTPFLAGAAQSMIEDFFTKETLDETIDGKSFCASNKQDSAKQYGKKVFAHKVVKVKADTIDFKGFFKLLENITLAIEDFYKKHPSAPITSAQAI

SEQ ID NO: 945 - protein, 570 aa, unidentified
  source 1..570: note = Related to JAHCDN010000001.1; note = Variovorax sp.
MSQLIALKSCINLSDVAVLLGYKPSTLSYLLYKIGEESKYSSFEIPKKGGGTRRIEAPQKELKLLQRKVADLLQNCFESADLTSPKYKSNPVSYGFIRGLSIIDNAQNHRSQRFVFNIDIQDFFGSINFGRVRGFFIKDRDFSLQPQVATVIAQIACFKNRLPQGSPCSPVISNLVGHILDMHLIKLAARTGCRYSRYADDLTFSTSKRDFPRQVAFYDEEKGLWHVGDELKRLLELSGFTLNSGKTRMQNRDSRQQVTGLVVNKRVNVSKEYRKTTRAMVHRLFTKGSFFFTDESNLEVKAQKESSDIGRLHGMLGHIYHVDTKCKTKIESSTNPPQKNASTYRRFLIYKELYATNKPIIICEGKTDPVYLVHAIRSLHRDFPMLAYRDAENQIRLSVRLLKYADKSMASILGLNGGVGDLRTFIDSYRSDIKRFNAPGKFHPVIILIDNDDGAKPILSIVKSINPNSTFDRDSFSHIVGNLYVVKTPLLGSEKSCIEDFFDGDLKSTMIDGKQFSLEKDANPEHYFGKVVFAHKVVRPQADKIDFSNFRHILKSMQDIITEFSSQKRI

SEQ ID NO: 946 - protein, 585 aa, unidentified
  source 1..585: note = Related to NZ_JAGSTT010000006.1; note = Burkholderia cenocepacia
MSQLALLTSATELHQVASLLNFKASALSYVLYKLPAAQKYTTFQIPKRSGGMRTIQAPCPQLKILQHNLSNTLQNCLEEINAREKRKNSFSNGFTRNRSIVDNAAPHRTKRFVFNIDLRNFFGTINFGRVRGFLIKDRNFRLEPKIATILAQIACHNNELPQGSPCSPVISNLIGHVLDVHLVGLARRSGCTYSRYADDITFSTNKPEFPADIATRTEPSHQWEIGEELKRLIKLSGFDVNSEKTRMQYCDSRQEVTGLLVNKKVNVRPEYRRTVRAMVHRLFTTGEFHIPEVVDDGTGKASITMTPGEMSKLHGMLGFVDQIDLYNKKNRPSGSNNDNLSSKESIFRDFLFYREFYSCDKPVLLCEGKTDNVYLKHAIHALAAHFPSLASVNAKGEVTRNIRIFKYTDSSTGRILGINGGTAPLSGFMRTYADATSRFKAPGENNPLILVLDNDSGVKGKGKIFNAVKQICKVEMTGAEKFVHVAGNMYVTLTPLLPGGADSMMEDLFDLNTKATIIDGKSFNPNNNLDSASHYGKHVFAQKIIAANPQSVDFGGFTQLLDNISAVIDAHKIKVSERQTANAIN

SEQ ID NO: 947 - protein, 583 aa, unidentified
  source 1..583: note = Related to SORC01000001.1; note = Paraburkholderia sp.
MPNLANLKAAASRQDLAELLGVKAGMLSYAIYKIPEANRYSRFEIPKRHGGIREILAPTPELKLIQRRLSVLLQDCAAEINSAHGHAEDGTRFGIAHGFKRHHNIMTNGRVHVTRRFVFNVDLHDFFGTINFGRVRGFFLKDKNFALHADVATVIAQIACFDNKLPQGSPCSPVVSNLLAHSLDIQLVRLAAKNGVSYTRYADDLTFSTNKPSFPAEIAAPGDTHSWKPGADLERIVANSGFSFNPSKTRLQYRDSRQEVTGLTVNRKVNVPATYRYTVRAMVDCLFRTGKFQFIYKKKDEQGKVVLELSHAGRNEQLHGMLSYIDQVDLFNQKVCKENGREPESTTGRVELFRRFLYFDTFYAAPEPIVVCEGKTDNVYLKCAIKSLVAKYPKLVAAGSPPKLKLRFFKYAETRTGQVTDLTGGVGGICKLLKSYDEDVKEVFKAPVSKFPVIVLIDNDSGAHGIYQVIAGINKKPKPQGLADFIHVTSNLYVVPTPFGPSKSHTAIEDFFDKPTLETKLNGKTFSRESKLDETSEYGKAAFARDVVAKNAGTIDFSGFQAILDRVIKVLDDYEIRFKNAKK

SEQ ID NO: 948 - protein, 618 aa, unidentified
  source 1..618: note = Related to FXAT01000001.1; note = Paraburkholderia susongensis
MACEIKVPGFAPRISSALSELRRLRKSIREPLPLRHMSSLQKLKAAAARRDLAIILDVSPRNLAYILYKTAPDTKYTRFTIPKRHGGEREILAPSLGLKLVQQKLASVLQDCSDEIALSHVKPGNGRRHGIAHGFKRHHTIMTNGRVHVTRRFVFNADLHDFFGTINFGRVRGFFIKDRNFALHPDVATVIAQIACFENKLPQGSPCSPVISNLLAHPMDILLSSLAAKHSASYTRYADDLTFSTNNPTFPPEIAALNGDHTWVPGAELDRLVSRSGFAFNPSKTRLQYRDSRQEVTGLTVNQKVNVPATYRYTVRAMAHSLFTTGAFEFVYKKRDTNGTIILENRKAGENKQLLGMLSYIDHVDRFNHKLAIENGREFESTAGRVALFRRFLYFDLFYGLREPIIVCEGKTDNVYLRCAMKALSATYPSLVEAGAPPKLKVRFYKYAETRTGEITELTGGVGGICKLLKHYHTDVQHCFKAPAPRFPVIVLIDNDKGAHSVYEAIAGITKKKKPQGLADFIHVTSNLYVVPTPRGPNNSETAIEDFFDEATLKEELNGRKFDRSNHTDDKPGFYGKGHFARDVVAKKAGTINFDGFTAILDRIIKVTDDYQAKLAKP

SEQ ID NO: 949 - protein, 581 aa, unidentified
  source 1..581: note = Related to SMOD01000073.1; note = Paraburkholderia guartelaensis
MRMINLTNLKSTTSRRDLSKLLDVKPGMLSFAIYKNPEAVRYRRFEIPKRHGGTREILAPASELKLLQQRLSVLLQDCVAEITAARGFAEDGAHFGIAHGFKRYHTIMTNGRVHVTRRFVFNVDLHDFFGTINFGRVRGFFLKDRNFALHPEVATAIAQIACFENKLPQGSPCSPVISNLLAHSLDIQLARLAARHGASYTRYADDLTFSTNKPAFPAEIGVLDDAHNCSPGAELERIVTRSGFSFNPAKTRLQYRDSRQEVTGLTVNRKVNVPASYRYTVRAMVDRLFKTGAFEFIYKKKDAQGNVVLERRVAAKNGQLLGMLSYIDQVDRFNQKICETNGREPESTAGRVELFRRFLYFDTFYATRQPVIVCEGKTDNVYLRCAIKSLAAKYPNLVTPGVQPKLNVRFFKYTETRTGQVMDLTGGVGGICKLLKSYSEDIEGIFRAPAPTFPVIVLIDNDKGAHGVYEVIAGITKKPKPLGLADFIHVTSNLYVVPTPFGPKKAHTAIEDFFDAFTLETELNGKKFNRNNKLDDSKEYGKAAFARDVVAKNAATIDFTKFHAIFDRVMKVLDDYEARRK

SEQ ID NO: 950 - protein, 580 aa, unidentified
  source 1..580: note = Related to NZ_LMNW01000004.1; note = Duganella sp.
MSSLQALKAASARRDLADLLGVKPGMLTYAIYITPEADRYTRSTIPKKHGGDREICAPNNDLKLIQRRLSTLLQDCLDEINVARGHKEDRVRFGIAHGFKRNHTIMTNGRAHITRRFVFNADLHDFFGTINFGRVRGFFLKDKNFSLQPEVATTIAQIACFENKLPQGSPCSPIISNFLAHPLDIRLVRLAAKHGVTYTRYADDLTFSTNKPAFPVEIASPIDSHGWIPGPELECVVTESGFSFNPSKTRLQYRDSRQEVTGLTVNRKVNVPATYRYTVRAMVNTLFKTGSFEFIYRKRGDDGKVTSENREPGTMPQLLGMLSYIDQVDLFNEKLCKDNDREPQPVVGRTALFRRFLYFDTFFSAQRPTIVCEGKTDNVYMRCAIKSLAAAYPRLIGGEKLLVRFFKYTESRTGRVMDLTGGVGGICNLLKSYHEDLKFYFKAPISKFPVIVLIDNDSGAHSIYEAVAGITKKKKPQGVADFIYVTGNVYIVPTPFGPGKSFTAIEDFFDAKTLATELNSKKFNRKNKKEDSEDFYSKAAFARDVVAKGASTIDFGNFKVILDRIEKVLDDYAVRRKTMT

SEQ ID NO: 951 - protein, 595 aa, unidentified
  source 1..595: note = Related to QMFZ01000026.1; note = Burkholderia sp.
MRRSIRESFLLPIKMSSLKDLKAATARRDLAALLHVKPGMLTYAIYKSPEANRYRKFEIKKRHGGEREILAPENGLKLLQRRLSTLLQDCIAEINSLHGHVEDEGRFGIAHGFKRNHTIMTNGRAHVARRYVFNVDLHDFFGTINFGRVRGFFLKDRNFALHPEVATVIAQIACFENKLPQGSPCSPVISNLIAHSLDIHLVRLAAKHGATYTRYADDLTFSTNRPEFPPEIATLKDTHSWIPGVDLERIVTRNGFSFNPSKTRLQYRDSRQEVTGLTVNRKVNVPATYRYTVRAMVDKLFKTGQFEFVHKKRDAQGNVVFENRCVGENKQLLGMLSYIDQVDRFNHKLCTDNGREPASTEGRIALFRRFLYFDTFYAAREPIIVCEGKTDNVYLRCAIKSLATEYPRLIDKGTPPKLEVRFFKHAETRTGHIADLTGGVGGICKLLKNYHEDVTEWFKAPVSKFPVIVLIDNDNGAHSIYEAIAGITKKPKPEGRADFIHVTSNLYVVPTPFGPKKKQTAIEDFFDEHTLATQLNGKTFNRSNKSDDSDKFYGKGAFARDVVAKQANTIDFTKFRAILDRVMKVLDHYEESQKK

SEQ ID NO: 952 - protein, 582 aa, unidentified
  source 1..582: note = Related to JAAOZT010000003.1; note = Glaciimonas immobilis
MPSLKQLQATTSLRELAPLLDIKPGMLSYLLYKKPKLDLYKKFTIPKRHGGVREINAPEGDLKLLQYRLSLLLQKCIVEINAEHGHAEDDEHLGIAHGFKRYHSIMTNGRAHVTRRYVFNVDLHDFFGSMNFGRVRAFFLKNNNFKLHANVATVIAQIACHENKLPQGSPCSPVISNLIGHTMDIPLARLARDEGATYTRYADDLTFSTNNPSFSHKIAVQGCDQKWLPGESLQRIVTKSGFSFNAQKTRMQYRDSRQEVTGLTVNRKVNVPATYRYKVRSMVDKLFKTGEFEFIYKKLDTLGKEVAFNYQGKRKQLLGMLSYIDQVDRFNSKLCEKNGLEPHPTTGRTTLFRRFLYFDAFFAPVEPIIVCEGKTDNVYLRCAIKNLAAAYPKLVVAGTKPLLKVRFLKYAERRTSQITELTGGVGGVCNLLKHYHDDVRTKFKAPAPKHPVIVFIDNDSGADSIYGAIAGITKQPKPAGRASFIHVIANLYVVPTPLGPKNKKTAIEDFFDKTTLATKLSDKTFSRDNKMENLKHYGKAAFAINVIAKNANTVNFNKFAPLLDRMVAVIDDYAKRLKVPLN

SEQ ID NO: 953 - protein, 580 aa, unidentified
  source 1..580: note = Related to NZ_JXQM01000003.1; note = Nitrosospira sp.
MSNLKQLQDATSLRQLAKLLNIQFGMLSYLLFKKPKSKLYKKFDIPKRHGGMREIHAPERDLKLLQYRLSVLLQKCADEIKASHGHVEDEKHWGIAHGFKRHHSIMTNGRAHTARRFVFNVDLHDFFGSLNFGRVRGFFIKDKNFKLHESVATGIAQIACYENKLPQGSPCSPVMSNLIGHTMDIPLAQLAASEGVTYTRYADDLTFSTNNSSFPEKIAYKSGNHTWELGRQLLRIVQRSGFSFNDKKTRMQLQDSRQEVTGLTVNRKVNVTATYRYTVRSMANALFNTGNFEFIYKKLDDSGVEQVYRSKGKPKQLIGMLSYIDQVDQFNRKLWVENGLEPDPTLGRIKLFRRVLYFDKFYALNQPLIVCEGVTDNVYLRCAIKSLAALYPKIVAAGAPPKPMVGFLKYADRRTSEITQLTGGVGGICKLLKNYHEDLGTRFRAPAPKHPVIVLIDNDGGADSVYGAIAGITKKPKPNKKASSIHVTGNLYVVPTPQLPGLSKTAIEDFFDAPTLATVVNGRTFSKENNYDGSKHYGKATFAHEVVAKNANVIDFKNFAPLLERIVAVIDAYGAKLKAK

SEQ ID NO: 954 - protein, 585 aa, unidentified
  source 1..585: note = Related to NCTK01000001.1; note = Ralstonia solanacearum
MSILKKLQEAKTRGQVAALLDVKPAMLSFILYKKPKATLYTKFSIPKKHGGTRDILAPEGNLKLLQHRLCQVLQDSLDEINVANGHGESRERQGVAHGFKRLHTIMTNGRPHVARRYVFNVDLHDFFGSINFGRVRGFFIKNKNFLLHEDVATVIAQIACHENKLPQGSPCSPVISNLISHSLDMKLVQLAARVGATYTRYADDLTFSTNNPDFPQYIALRKGTHEWVAGRGLEKIVMKEGFSLNPSKTRMQYRDSRQEVTGLTVNRKVNSPAAYRLTVRAMVNSLFKTGLFEHVRKKKGAAGGISVTKFAGEKKQILGMLSHIDQVDLFNRRLREKNGLEPHNTSGRVALFRRFLYFENFYALDAPLIVCEGKTDNVYLKCAIKSLASSYPKLATSDSLPKLKIRFFKYSERRAGDVIGLSGGVGGICKLLKNYHEDVREKFKAPSPKHPVIVLIDNDSGANSVYEAIAGITKKPKPAGMADFIHVTGNLYVVPTPLGRGGKKTAIEDFFDDKTLSVALNGKTFSRDKNIDETVHYGKVPFAINVVAKNADTIDFTKFKKILDRVVRVIDDYAIKMLASSHSAS

SEQ ID NO: 955 - protein, 582 aa, unidentified
  source 1..582: note = Related to JAJTWU010000005.1; note = Pelomonas sp.
MSQLKQLKAATTLSDVARLLEVKPGMLSFVLYKKPKAALYSKFDIPKRHGGTREIWAPDKDLKLVQHRLANLLQNCVEEINSSRGHVEDGKRHGVAHGFKRKHTIMTNARVHVTRRYVFNVDLHDFFGTINFGRVRGFFLKDKNFALHEKVATVIAQIACHENKLPQGSPCSPVISNLIGHVMDIMLVRLASATGCSYSRYADDLTFSSNKSKFSSRVARQDDADKDLWLPGQGLKRLVAKAGFSFNDKKTRMQYRDSRQDVTGLVVNRKVNVPATYRYTVRAMVDHALKTGAFERIFKKLDAAGVETTFKQPGTNRQLIGMLSYIDQVDLYNRKLREDNGLEPHDTSGRTEQFRRFLYFDAFHAIGSPVIVCEGPTDNIYLRHAIKRLAPKYPMLAAGTPPKLLLRLFKYGQRRTSEITQLTGGVGGLCHLMKHYHSDFINKIKASAPKYPVIVLVDNDAGAKDIYGAISGITKKPRPTGREQFIHVVGNMYVVPTPLGAGGAKTAIEDFFDAKTLAETLGTKTFSRAPKFDDTKHFGKAAFAREIVDKKADSIDFSGFSAILDGVVAVVADYAKRHPPVP

SEQ ID NO: 956 - protein, 582 aa, unidentified
  source 1..582: note = Related to JAGREY010000320.1; note = Ottowia sp.
MSQLTRLKAATSLSDVARLLEVKPGMLSFLLYKKPKAALYAKFSIPKRHGGTREIWAPDKDLKLVQHRLANLLQNCVDEINAARGHAEDDKRHGIAHGFKRKHTIMTNARVHVTRRYVFNVDLHDFFGTINFGRVRGFFLKDKNFTLHERVATVIAQIACHDNKLPQGSPCSPVISNLIGHMMDILLVRLASATGCSYSRYADDLTFSSNRSNFSPRVARQDDDDKDLWLPGQGLKRLVAKAGFSFNDRKTRMQYRDSRQDVTGLVVNRKVNVPATYRHTVRAMVDHAIKTGSFERIFKKVDAAGIETAFRQPGTNRQLIGMLSYIDQVDLFNRKLREDHGLEPHNTSGRTELFRRFLYFDSFHAIESPVIVCEGPTDNIYLRHAIKRLAPAYPTLASGTPPQLSVRLFRYGQRRISQVTQLTGGVGGLCHLMKHYNSDFTTKIKAPAPRYPVIVLVDNDAGAKPIYGAISGITKKPRPTGAERFIHVVGNMYVVPTPLGAGDAATAIEDFFDAKTLNEKLGTKTFSRAAKFDDTKHFGKAAFAREVVERKADFIDFSRFSDILDRVVAVMSDYAKRYPSLP

SEQ ID NO: 957 - protein, 480 aa, unidentified
  source 1..480: note = Related to WSYX01000004.1; note = Ralstonia solanacearum
MSNARAHVTRRYVFNVDLHDFFGTINFGRVRGFFLKDRNFSLQPKVATVLAQIACYENKLPQGSPCSPVISNLIGHMLDIALVQLAAVSGCTYTRYADDLTFSSNKPTFPIQIARQIDKSADKWAPGRSLERIVTKAGFTFNDKKTRMQYRDSRQEVTGLVVNRKINSPAIYRNTVRAMVDSALKRGTFDFIHKKVDAKGVATVVKQPGRNSQLLGMLAHIDQVDLFNKRLCEKADIEPPSTAGRIELFRQFLYFDAFYDISMPVIVCEGPTDNTYIRHAIRSLAFGYPMLVTGNAPPKLNVRLFKYAERRTSEVTQLTGGVGGLCHLIKSYHTDVTEKIKAPPPKHPTIVLVDNDSGANAIYGAISGITKKPRPTGKEPFIHIVGNMYVIPTPLGLHGEKTAIEDFFDAATLATKLGTKSFSREKKIDETTQYGKAAFAREVIEKNAGSIDFSRFSAILDRIAAVLADYSKKHPTSAVL

SEQ ID NO: 958 - protein, 580 aa, unidentified
  source 1..580: note = Related to NZ_CP034395.1; note = Herbaspirillum seropedicae
MSSLADLKNTKTLSDLGALLDIKAGMLSFQLYKRPKEVLYTKFSIPKKYGGLREISAPDPTLKLIQHRLSDLLQECLLEITKINGHVNDAKSFGISHGFKPGHTIMTNARGHVGMRYVFNLDLHDFFGSLNFGRVRGFFIKDRNFQLTPAVATVIAQIACADNKLPQGSPCSPVISNLIGHTLDIPLVRLAATLGMRYTRYADDLTFSTNQRIVPDEIALMDPVHKWIPGRELVRIIKRNGFAINESKTRMQYCDSRQEVTGLTVNHKVNVPATYRYRVRAMAHRLFTTGEFEFIYKNNEKTVVSSSKGSPQQLLGMLSYIDHVDQYNEKIKLENNLPVTETAGRTELFRQFLYFDAFFAPERPIVVCEGKTDNIYLRCAIKKLAAKYPDLATVARGVSLNVRFFKYSEQRTGSVIGLTGGVGGICKLLKHYHEDVSTRFKAPRPQHPVIVLIDNDSGANSIYEAIAGITKRKKPLGRAPFIHVFSNLYVVPTPFGPKNAYTAIEDCFDAATLARPLDGRTFSRDNKHDSSKHYGKKDFATRVVAKNVNTLNFHGFEPLLEQMVAVIKDYKTRISGAVVA

SEQ ID NO: 959 - protein, 592 aa, unidentified
  source 1..592: note = Related to JAJFMU010000006.1; note = Xanthomonas campestris
MALIYSTPVLDSLKAATSLHDLAQLLKLKPAVLAMQIYKKDKRTDWYTSFEIKKKHGGVRKINAPEKHLKLIQSRLSKILQDCQLEIALLNGHKEGPDRQGIAHGFKRHHSIMTNGRPHVNRQFVFNVDLQDFFETINFGRVRAFFQKNKNFALNPKVSEILAHIICYKGSIPQGSPCSPVVSNLISHSMDTLLAKAAKINGATYTRYADDLTFSTNRKVFPALIAKKISANEWEPGATLLGVVTKSGFCFNKNKTRMQYKDSRQEVTGLSVNKKVNVTADYRYTTRAMVHKLFTDGKFVFCYKVKNSHGEKEIFQEIEGRASQLLGRLTHIDHVDQFNELIRKKNGLPSALPEGRLKLFRNFLYFYHFYMPDQPVILCEGKTDNIYLKCALKANAAAFPKIVEVSTGSPPTLKVRLFKYSERRTGVVTDLSGGVGGICKLLKNFDSNLSMWNSGPKPAHPVIIVIDNDSGAQKIYQAIAGITKKPKPSGRNKFIHVIENIYVVPTPPAKGITNTDIECLFADATLNEELSGKKFNKSKEIEDSSEYGKTAFAINIVAKKSGEIDFTGFVPLLERIQEAMDHYYKSIKKFKK

SEQ ID NO: 960 - protein, 586 aa, unidentified
  source 1..586: note = Related to FLTX01000075.1; note = Xanthomonas bromi
MAKIFSTPALDSLKAASSLHDLAPLLGLKPAVLAMQLYKKDKRTGWYTSFEIKKKYGGVRSINAPEKHLKLIQSRLSKILQDCLLEIALIKNHKESPDRQGIAHGFKRYHSIMTNGRPHINRRFVFNTDLQDFFGAINFGRVRAFFEKNKNFSLDPKVSEILAHIICHKGSIPQGSPCSPVVSNLIAHSMDTLLAKAAKKNGVTYTRYADDLTFSTNKKEFPLAIAKKITSNEWVPGKEVSVIVEKSGFFFNEKKTRMQYKDSRQEVTGLSVNKKVNVTSDYRYTTRAMVSSLFKTGKFKFCFKAKNLAGEKEVVQEFEGRPAQLLGRLTHIDYVDQFNESLRKKNGLPPALPEGRLKLFRNFLYYYHFYMPEQPVILCEGKTDNIYIKCALKAHANAFPSMVKPGSPPELKVRLFKYSERRTGIVTDLSGGVGGICKLLKNFHANLSMWESAPQPTHPVIVVIDNDSGADNIYQAIAGITKKPKPKGYAKFIHVTQNIYVVPTPPVKGKKNTDIECLFSDATLKEELNGKKFNKSKEIEDSSEYGKTAFAINVVAKKAHEINFAGFTPLLQRIKEAMDHYYKSIK

SEQ ID NO: 961 - protein, 619 aa, unidentified
  source 1..619: note = Related to NZ_CP092971.1; note = Xanthomonas oryzae
MSRDMPSDILCSKYVVQVAPGSVRESFNQSRKSMVKTYSTPALDSLKAARSLHDLAQLLRLKPEILAMQLYVKDKRTGWYTSFDIKKKYGGVRTINAPEKHLKSIQSRLSKILQDCLLEIALISGHKEGPDRLGIAHGFKRYHSIMTNARPHTNRRFVFNADLQDFFGTINFGRVRAFFSKNKNFELDAKVSEILAHIICYRGSLPQGSPCSPVVSNLIAHSMDTLLAKAARTNGVTYTRYADDLTFSTNQKEFPSSIAERLVGNEWGVGRTVVRIVEESGFSFNQNKTRMQYKDSRQEVTGLSVNKKTNVTADYRYTTRAMVHSLFKTGKFKFYFKVKNASGAKVVINEAEGSPTQLLGRLSHIDHVDQFNESIRKINGLPAALPAGRLKLFRDFLYFYHFYMPEKPIILCEGKTDNIYIKCALKAKAASFPSLVTHSSPPELKVILFKYSDRRTGIITNLSGGVGGICKFLKNFNSNLSMWISAPIPAHPVIVVIDSDSGADKIYQAIAGITRNKKPKGSEKYIHVTKNIYVVPTPRKINEQTTDIESLFTQETLDTELNGKKFNKSKELDDASEYGKAAFATNVVAKRASEINFDGFIPLLNNINEAMTHYYRTIK

SEQ ID NO: 962 - protein, 588 aa, unidentified
  source 1..588: note = Related to DMZZ01000357.1; note = Comamonadaceae bacterium
MKLEELKAATSLRDVATLLQVKPAMLSYILYTKPKPELYTKFEIPKRTGGVREISAPYSHLKLIQQRLAAILLECTKELREKNASKSKNKNFEIRSVAHGFMPGHNIMTNGQSHITRRFVFNVDLSDFFGSINFGRVRGFFIKDNNFALDEKVATILAQIACYENKLPQGSPCSPVISNLLGHILDVALIDLARKNKCTYTRYADDLTFSTNRRVFPLAIAFAIQEDKNSWLPGKELIRIVQHNGFEFNKKKTRMQYKDSRQEVTGLSVNRKVNVPASYRYTVRAMASNLFRTGKFEHIVRYKNSSGEEVVSKVDGKTSQLLGMLSYIHQVDMYNEALAVKNNQPLADTPGRLELYRRAIYFDAFYAPERTVVVCEGKTDNTYIKNAIYRLFQGYPLLGELDAEGKPQLKIRLFKYADRRTASITKLSGGVGGLCHLIKYYNSDIVQKFRAPPAKFPVILLIDNDSGADSVYGAIAGILNIQKPKGKKPFIHVYENLYVVPTPFGLDGEKTSIEDFFDQATRATQLNGKSFERKNDADNQHHYGKAAFARDVISKNASTINFDGFRPILDRIEAVMKDYVGRIHQLAG

SEQ ID NO: 963 - protein, 584 aa, unidentified
  source 1..584: note = Related to NZ_BCWR01000008.1; note = Hydrogenophaga taeniospiralis
MKLEELKAATNLRDVARLLQVKPGMLSYVLYTKPKSELYTKFEIPKRTGGVREVSAPFSHLKLIQQRLAAILLECTKELREKHASKSKNKNFEFRGVSHGFMPGHSIMTNGQAHTTRRFVFNVDLSDFFGSINFGRVRGFFIKDNNFALDEKTATILAQIACFDNKLPQGSPCSPVISNLLGHILDVALVELARKNKCTYTRYADDLTFSTNKRIFPSEIALATEDDGNSWLPGNELIRVVRRNGFDFNERKTRMQYKDSRQEVTGLSVNRKVNVPASYRYTVRAMASSLFRTGKFEHIIKYKSASGDEIVSKCDGKINQLLGMLSFIHQVDVYNEALAVKNNHPIIETPGRLELYRRVIYFDAFYAPERPIIVCEGKTDNTYIKNAIHRLSQNYPLLGGLDSEGKPQLKIRLFKYADRRTASITKLGGGVGGLCHLIKYYKADIASKFSAPRPKHPVIMLVDNDSGADAIYGAIAGILNVQKPKGKRPFIRVYENLYVVPTPFGSNGEKTSIEDFFDKATLAVQLNGKSFERKNDADNEHHYGKAAFARDVIAKNAAAIDFNGFKPILDRIEAAIKDYATQTQ

SEQ ID NO: 964 - protein, 583 aa, unidentified
  source 1..583: note = Related to NZ_CP019236.1; note = Rhodoferax sp.
MTLANLKGATDLHGVAKLLDVKAGMLSYILYKQPKPDLYKKFEISKKTGGVREISAPCPHLKLIQQRLAAILLGCSLELKAKHATAVKNKNYVRREVSHGFTKGRSIVSNGEEHITRRFVFNADLSDFFGTINFGRVRGFFIKDENFSLFPAVATILAQIACSENKLPQGSPCSPIISNLIGHLLDMRLVEFALRQGCTYTRYADDLTFSTNKPEFPTAIAVQKEGDPHKWIPGGGLQKIVQKCGFSLNEKKTRLQYRDSRQEVTGLTVNKKVNVPATYRYAARAMANNLFKTGKFQHTIHFTDKDGAAQELRRDGHAGELRGMLSYVDQIDLYNSCREEANSLVPLGAPGRLQLYRRVIYFDSFYALSKPMIVCEGKTDNTYIKHAILQLAGHYPTLASASITGGKPELKVRLYKYADRRSAVVTDIGGGVGGLCHLIKNYHADVVNKFRAPRPMHPVILLIDNDLGADSIYGAISGLLKIKKPKGLRPFIHLFSNLYVVPTPLGPGNSQTMIEDFFDAATQAVTLNGKTFSRQDEDSSKHYGKAAFARDVVAKNADSIDFNGFRSILDRLRDVLLDYPTRP

SEQ ID NO: 965 - protein, 633 aa, Achromobacter sp.
  source 1..633: note = Related to CADIKS010000002.1; note = Achromobacter mucicolens
MAKEGNVRDICPRRTLLLHNHSVILLKECPQALSPEMALKKIEELKKVRTRIELAELLEVKPSRLAYELYKKKDSDRYQHFEIPKKYGGTREILAPNPTLKTIQRRLAIYLQDCLEEVIASTDSERHRGGGIKLGFSHGFMRDRTIITNARPHRAKRFVFNCDIVDFFGTINFGRVRGFFIKDKQFALAQEIATFLAQISCFQNVLPQGSPCSPVIANLIARKLDIKLGRLAYQTGMTYTRYADDLTFSTNKKIFSHSVGVQDASGFWRAGTELTKIVRASGFELNPNKTRLQQRDSHQEVTGLTVNRKVNTNSSYRYTARAMVNSVLKTGEFCFSYSIKNAPESLEAPEKKKGNLKQLLGILSHIDYVDRFNFELRKSNLAHLANKKNQKAVDDQLFPSLSRQETFKKFVYFYWFYACDEPVIICEGKTDNIYLKCAIKALKLRYPDLISNDKNNEKLKIRFFEYKESRAKSLSQLSGGVGGLCHFLENYHKYLNGAFFAPKPKHPVIVLIDNDNGGQSVYSKVAGITKKKKPTGKESFIRIEKNLYIIPTPLGPEGQQTAIEDFFDKAVLDEQLNGKSFSRDDDFDKSKFYGKAAFSRDVVLKNREKIDFQGFDSILSRINSVLRDYHLTP

SEQ ID NO: 966 - protein, 567 aa, unidentified
  source 1..567: note = Related to NZ_CXOO01000052.1; note = Limnohabitans sp.
MSKLQHLKSTSNLHSVANLLGLKPAHLAYNLYKKPDAEKYTKFEIPKRYGGKRIISAPNADLKHIQRLLAAVLMDCLNELNAKYNRQAAHGFITQRSILTNAHQHRGRGHVLNLDLQDFFGSINFGRVRGFFIADKDFSLHPAVATVLAQIACFENTLPQGSPASPVISNLIGNVLDTHLIKLARKHGCVYTRYADDLTFSTNLPNFPEELAYSKFGVWTTGTSLLKVIKQSGFDVNTSKVRMQLEDSQQNVTGLVVNQKANTAASYRSSIRAMAKNLFKTGNFTHDSFIKDSAGNVSKNSELGTVAQLQGMFGHIKHVDEFNLQIRRQEIPTGRASLYKRFFLFSQFFCSSKPVILCEGKTDNIYLLHAIRSRANHFPQLAETNATGSISLLIRIFKYVERKAGRTLGMSGGDGEISKFIGTYLTEVSKHFKAPGVSQHPVILVVDHDSGGKGPYETASKKVGKTLDILNPFEHVAANLYLVATPLPFGATSSCIEDCFQPTTLAKTLGGKTFNYKTKHLKPTEYGKSYFAEHVVQADAGTIDFSGFDPLLDRINSVIVHYAKLPK

SEQ ID NO: 967 - protein, 588 aa, unidentified
  source 1..588: note = Related to NZ_LOJI01000040.1; note = Polynucleobacter yangtzensis
MTLLAGLKSARTIQDVARLLNTKASALAFMLYKESPDTLYTEFSIPKKYGGFRAIAAPIPKLKLVQRKLADILQICLQEINEKENYSDKVAHGFKRGRSIVTNAQCHKRKRLVFNLDLEDYFGSINFGRVRGFFMADRNFQLHPSTATILAQIACYKNSLPQGSPCSPIISNLVGNILDVRLVRLAKESGLTYTRYADDLTFSTNAQSFPESIAVSSADSLHSWMVGKGLNELIERSGFRVNSSKVRVQYRHSRQEVTGLVVNKRVNIPSTYRRKVRAMVYSLVTEGYFEFKEIGEKDAESAQPTKKGSLNQLHGMLSYIYQLDSSNRKELSAANFKDGVPVSERDVPLTTTEKVFRRFLFFKNFYSTQKPVIICEGKTDNIYLHYALLSLATRFPNLVVKQAQKYSFAFSLHRYSRSSTERILGIQGGSGDLKMFMLNYLTSYNFFKVKVKKQPVILLIDNDDGANDIFSMAKNYLGYKPTGQEPFLHVDGNLYLMPTPLLNSRTKSTIEDFFDDKVKSVQVSGRSFDPKRKHNGSASTYGKNEFAREVVAKQANSIDFSKFSYVFKNIEDIIADFQSKVAAGKIKP

SEQ ID NO: 968 - protein, 577 aa, unidentified
  source 1..577: note = Related to NZ_AFWT01000016.1; note = Thiorhodococcus sp.
MSKLSRLRACKDLRDLAKLLGFRPSAVSYILYMESDSAKYREFEIPKTTGGTRQISAPHPKLKLLQTRLSNLLQDCLGELDKLNADAHRLDSLAHGFKRGRSIVTNAQRHRNRRWVFNLDLDGFFNDINFGRVRGYFIKDRNFLLQPKVATVIAQIACHKGSLPQGSPSSPVISNMVGRIIDLRLCRLAARAGCRYTRYADDLTFSTNKRSFPEAIAARDSQNDSSWSPGDELIKIIKESGFSINSKKTRMQYRESRQEVTGLVVNDRVNVPATYRHTVRAMVHRLCMTGTFDIQKATISSTKQSNQSDPGNLRQLHGMLGFIDAVDRFHQKNKPNDAHDKQKPRASELIYRRFLIYQNFYAAEKPVLICEGKTDNIYITCAIRSLAQQFPDLARIDKSGKISLEIRRFRYAKTSTGRILGLNDGGAPVLKNFIWEYKKEISKFRATISKHPIIILIDNDSASKQIFASLGKITTSKVCGNEPFIHAFANLYVVATPIPEGKDSSDIEDLFDQETLGATIDGKRFSRIVEDESRHYGKAVFAYKVVKPRADKIDFSGFRELLARFVRAIEDYQAKIH

SEQ ID NO: 969 - protein, 560 aa, unidentified
  source 1..560: note = Related to NZ_BCTR01000096.1; note = Sphingomonas azotifigens
MATSLSDVALLLGFHPKAFAWVIYKQTAKYAVFDIPKSRGGTRTIKAPEPRLKNIQARLAELLQDCIADINEARSQKEKLSHGFRRGHSIITNAYQHRGRRFVLNVDLADFFGTINFGRVRGFLITNRHFALHERAATVIAQIVCDDNSLPQGAPTSPVVSNLIAHILDVRLAKLARRFGLHYTRYADDLTFSTNSRDFPEEVAVPNDAGQWVAGPALDTAIQRAGFALNPQKTRVQMRQSRQDVTGLIVNEKVNIRSEYYREARAKCDHLFRTGAYRTKQLVRKDDGTAAVEEVPGTLDQMEGVLSFIDSVKRYKRPADRDHKLTGSEQTYRKFLVYRYFYAPSMPVILCEGKTDNIYLRCAIQAFADDYPGLAEKQGSAATLKVRLFNYSEHTKRLLGIAGGSGHFNNLIRDYRKNLKPFTAPHAERFPVILLVDNDSGADGIYKVVKATTKTACDGKESFYYVGDNLYVVPTPLGPSDAQTMIEDFLPAKWRAEKLGGKTLNLGKDCDITKEYGKALFAEHVIKRNRKDVDFTAMRVILDRIVTVIDDYAAMMGAGP

SEQ ID NO: 970 - protein, 572 aa, unidentified
  source 1..572: note = Related to NZ_WOTA01000025.1; note = Acetobacter oeni
MVGGNVKRIDQLRLTNCLADVAELLGFQPKLFAWVIYKQPYKYATFEIPKSRGGVRLIKAPEDRLKNVQSRLAKLLQDCISDINEKREQTEKLSHGFRRGYSIITNAYQHRSRRFVLNVDLTDFFGSINFGRVRGFLMTNKHFALQERTATVIAHIVCDDNSLPQGAPTSPVVSNLIAHILDVRLAKLARKYGLHYTRYADDLTFSTNSRSFSTEVATPDAAGHWVAGKALEKVITRAGFSLNTSKTRMQLQQSRQDVTGIIVNKKVNIRSEYYREARAKCHHLFCTGTYLTKKVVRKEDGTSAVESVIGTLDQLEGILSFIDSVKRFKMTFDREYKLTGPERLYRNFLYYRHFYAPPLPMILCEGKTDNIYLRCAIQKFASDYGQLAQEEGDAIKLRVRLFNYSDHTKRLMSLGGGTGQIKDLLSNYCKIMKPFLSMGERNPVIVLIDNDSGAKSIFSWISSTTGRRCDGKESFYYLGENLYLVPTPRTDEDGDTMIEDFLPLKWREEKLGGKTLNLGSNINRDKEYGKALFAEYVIKKNRKDVDFVQMKLVLDRIVAVINDYAAMMATST

SEQ ID NO: 971 - protein, 568 aa, unidentified
  source 1..568: note = Related to NZ_JAKREV010000015.1; note = Sphingomonas hankookensis
MKRIDDLKMATSLTDVALLLGFHPKAFAWVIYKQQPRYTVFEIPKSRGGTRTIKAPEPKLKNVQARLAELLQDCIADINEARSQKEKLSHGFRRGHSIITNAYQHRSRRFVLNVDLADFFGTINFGRVRGFLMTNKHFALHERVATVLAHIVCYENSLPQGAPTSPVVSNLIAHILDVRLAKLARRFGLHYTRYADDLTFSTNGRTFPEEVAAIDADGQWIAGPTLKGAIQRAGFELNPVKTRMQLRQSRQDVTGLIVNEKVNIRSEYYRDTRAKCHRLFKTGKYQIKQTIRKDDGSTIVEDADGALDQMEGVLSFIDSVKRHKQVVERDHKLSGVEQIYRAFLLYRHFYAPSMPTILCEGKTDNIYVRCAIQAFADDYAKLADKKGEAVSVKVKLFNYSDHTKRLLGIAGGSGHFNNLIKDYRKNLKPFTAPYAERFPVILLIDNDAGADGIYKVVRAITKGTCDGKDPFYFIGDNLYVVPTPLTDTGAATMIEDFLPSKWRDEKLGGKTLNLGKDIDITKEYGKSLFAEYVIKKNRKIVEFDAMRAILDRIVTVIDDYAAMMAAGS

SEQ ID NO: 972 - protein, 418 aa, unidentified
  source 1..418: note = Related to JACTGR010000001.1; note = Sphingomonas sp.
MKRIDELKLATSLSDVALLLGFQPKPFAWVIYKQPAKYSVFEIPKSRGGMRVIKAPEPKLKAVQARLAELLQDCIADINEARSQTEKLSHGFRRGHSIITNAYQHRSRRFVFNVDLADFFGTINFGRVRGFLMTNKHFALHERAATVLAHIVCDDNSLPQGAPTSPVVSNLIAHILDVRLAKLSRRFGLYYTRYADDLTFSTNSRTFAPEIAINDGAGGWAAGPALIKAIQRSGFALNPKKTRMQLRQSRQDVTGLVVNEKVNIRSEYYRDARAKCDRLFKTGKYQTKHLLRKEDGTFAIEELDGTLDQLEGTLSFIDSVKRHKQTIGRDHKRSGAERLYRSFLLYHHFYASQMPVILCEGKTDNIYVRCAVQAFVADYAKWPWRRKMGLNSRYGCSTIQTTQSACSVSLADQVTLMA

SEQ ID NO: 973 - protein, 562 aa, unidentified
  source 1..562: note = Related to NZ_LR733875.1; note = Sphingomonas sp.
MAYILGVTPKGLAYTIRIQPLANRYSSFTIPKKTGGSRNIDAPEVGLKLVQSRLADVLQDCISDIDKERGYPEKISHGFRRGHSIITNARNHSNRRFVLNVDIADFFQTINFGRVLGYFLKNRDFCLDKNAAVTLAQIACHNNGLPQGAPSSPVISNLITHILDIRLAKIAKNYGCYYTRYADDLTFSTNLRDFPEKLARLDSVSGKWIVGRSLEKAITQSGFALNASKTRVQLKQSRQDVTGIVVNDGVNVRREYYKNARAYCAELFKTGKFYINVKDIDENGQVSLKKIDGTRQQLKGILSFIDQVKSHRPKITLEKTTPDRKGVKGFNLLYKRFFYFDAFFANDKPMILCEGKTDNIYIQSAVAAMFNKFPTLSGEKNGKADFKFKLFNYTKTSLKIIGIGGGTGQLNAFISNYKSNVGDFKYKGEKHPVIIVIDNDSGSSSIYKTMKTILNIDVKGDKPFYFMGENLYIVPTPRGVNGEETMIESFLPQKWIDYKLNGKKFNMNNKGLDTKAEIGKALFAEYVVKKFKKDISFDNFSPLLDNITSAINDYYAMVAIKP

SEQ ID NO: 974 - protein, 447 aa, unidentified
  source 1..447: note = Related to SCRQ01000059.1; note = Sinobacteraceae bacterium
MLIAKECQPAAYFSLQHGVMNRLALLRSAKTINDLADLLGVKHSGLSFILYKKPTETKYQSFTVPKKAGGVRAIHAPTSELKLFQRRLADLLQECLNEIEATFRKTSEDRRPEKISHGFHPGRSIITNAIQHRRRRYVLNVDLKDFFGTCNFGRVRGLLIKNEHFLLHDRVATVIAHLACHEGALPQGAPSSPVISNLIGRVLDIRLVKLANSVGCSYSRYADDLTFSTNDRQFPPQLAAEIPPSSGRWEPGPALLGEIASSGFSLNPKKTRMQLHESRQMVTGLVVNTRVNVSSDYRHLIRAMVHRLLTKGEYEISTAAGPIKGTTEQLQGMLSFIDSIDEFNRKRFKERDVPFPRQRDETFRDFVFYRHVYQASRPTLICEGKTDNVYLTHAIRAMAKLFPDLASPGFYPVSADTSKKAEDGHKECLCRSEGSTALSSSVVLWSR

SEQ ID NO: 975 - protein, 599 aa, Pseudomonas sp.
  source 1..599: note = Related to AP019411.1; note = Pseudomonas syringae
MSELYQLQKATSLHDLAAILNYTPSALSYLVYKRPGKYTKFTIPKSNGSPRQICAPCDELKALQKQVKTLLDKCLATIESTGKARGAISHGFKAGHSIITNAETHKKRRYVFNVDLEGFFDSIHMGRIRGFLINNKDFQLNPKVATVLAQIMCHDDKLPQGSPTSPVASNLIGHLLDLRLVQLAKRNGCSYSRYADDLTFSTNKKNFPEEIASSDEGGNSWAAGPSLTKIIQKSGFELNHSKTRMQYRTNRQSVTGLVVNQVTNTPAEVRRTARAMAFHLFNKGYYLIKNEVVGEEKATAPMIRDYTQLASLDGLFSFIYMVDQFNRKKLVKNSTVKIESIKKTALEIIHGDFLFYKNFYASPTPTIMCEGKTDNIYLACAMKSLMERFPRLCKPNKDGKPALRVRFINYSELTHRALGLNGGSADLAAFIRSYAKNCGKYKAHPPLSPTIIVVDNDSGSDPIFKAIKDVTGNRYVIANGKGTILDKSQTTYYIAQNLAVVLTPLKKDGKPTMMEDFFPAKVLQTPWNNKTFEILTKSPNKNTYSKNTFAQKIVKADRANIEFKGFSPILKSISQIIRCYHVDKSLIDKSLRPKSINAQ

SEQ ID NO: 976 - protein, 598 aa, Pseudomonas sp.
  source 1..598: note = Related to NZ_CP060289.1; note = Pseudomonas protegens
MSELHQLRKATSLHDLAAILNYTPSALSYLVYKRPAKYTQFSIPKSNGSTRQICAPCDELKALQRRVKILLDECLATIENSSLARGAISHGFKQGHSIITNAETHKKRRYVFNVDLKGFFDSIHMGRVRGYLISNNDFKLNPNVATVMAQIMCHDNKLPQGSPTSPVVSNLIGHLLDLRLVQLAKRNGCSYSRYADDLTFSTNKKTFPKEIALSDENDNSWAAGPALTKVIQKSGFELNHDKTRMQYRTNRQSVTGLVVNQITNTPAEVRRTARAMAFHLFNKGHYLIKGEATGAEKAKALEVKDYTQLASLDGLFSFIYMVNNFNRKKIVENSSIKIESFKKTSLEMIHGDFLFYKNFYASPLPTIMCEGKTDNIYLTCAMKSLIDKFPQLCKLNKDGKPALKVRFINYSELTHRVLDLNGGSADLAAFIRTYAKNCGKYKAHPPLNPTIIVVDNDSGSDPIFKAIKDVTGNRYSIPNGKGAILDKTKTTYYIAQNLSVVLTPLRKDGQPTMMEDFFPANVLKAVWDNKTFEILSKSPSKNTYNKNTFAQRIVKADRPNIEFKRFAPILRSISEVIEGYHVEKSVIEQNLPPKPAKP

SEQ ID NO: 977 - protein, 596 aa, Pseudomonas sp.
  source 1..596: note = Related to NZ_FYDY01000001.1
MSKLHQLQKATSLHDLAAILNYTPSALSYLVYKRPGKYTQFSIPKSNGSPRLISAPCDELKALQKQVKVLLDECLATIEKVGAERGAISHGFKDGYSIVTNAEVHKKRRFVFNVDLQGFFDSIHGGRVRGFLISNKDFKLHPKVATVLAQIMCHDDKLPQGSPTSPVASNLIGHLLDLRLVQLSKKNGCSYSRYADDLTFSTNKKIFPAEIASSDNGSNPWVAGPALAKIIKKSGFKLNHDKTRMQYRTNRQSVTGLTVNQITNTPVEVRRTVRAMAHCLFNNGFYFVKDKASVSDKKNKPEIKDHTQLEKIDGYFSYIYMVDQFNRKKIVDNSSVKIESIKKAALEKIHGDFLFYKNFYASSQPTILCEGKTDNVYLTCAMKSLMDRFPRLCKPNKDGNPALRVRFINYSELTHRVLDLNGGSADLAAFIRFYAKNCAKYKAHPPLHPTIIVVDNDSGSDPIFKAIKESTGSRYSIANGKGTVLDKSQTIYYIAQNLYVVLTPLKGGQPTMMEDFFPSSTLQKVWEGKTFEVLSKPSKTTYNKNTFAQRIVKANRTDIEFKRFAPVLRSISEAIKDYPRIKKSVIEQNLALKSKA

SEQ ID NO: 978 - protein, 587 aa, Pseudomonas sp.
  source 1..587: note = Related to NZ_CP021132.1; note = Pseudomonas fragi
MSTLHKLQQASSLHDLAAILNYSPSSLAYLIYKKPVKYKQFEIPKSNGSPRVINAPCDELKALQRKIKLLLDKCLDAIEQAQGVRGSISHGFRRGHSIVSNADVHKRRTYVFNVDLEGFFDSIHIGRIRGFLITNNDFRLHPNVATVLAQIICHDDKLPQGSPTSPLASNLIGHLLDLRLIQLAKKTGCSYSRYADDLTFSSNKSEFPAEVSYKIDDGHTWIPGSSLLKVIYKCGFKLNHNKTRMQYARGRQSVTGLTVNQTPNTSAELRRAVRAMTHSLFLDGQYHTIKQPGDNDDSEKITKSYTQLAPLEGYFSYIYMVDNFNRKKIIENSSTKMENIPKTALENLHGDFLFYRYFYANSKPTIVCEGKTDNIYLTCAIKSLMGSFPRLCKSNKEGKANLKVRFINYSELTHRMLGLNGGSADLAALIRAYAKKCAPYKAHPPLHPTIIVVDNDAGSDPIFRAIKDTTGNRYAIPKGKGTVLDQSKTLYYIAQNLYVVLTPLKKDGGPTMMENFFTTKLLASRWEGKEFEVFNKNSPSGTYSKQIFAQRIVKSDQANIDFRKFKPILSSITEAIRHYPAIKVPKK

SEQ ID NO: 979 - protein, 584 aa, Pseudomonas sp.
  source 1..584: note = Related to JACYWS010000004.1; note = Pseudomonas syringae
MPTLKKLKSLTSLHDLAAMLNYTPTALSYLVYKRTGKYTSFQIPKSNGSPREILAPCDELKALQRKVKSLLDDCLDSIEKSKPLIGSLSHGFKSGHSIISNAEPHTKRLYVFNVDIKGFFDAIHMGRVRGFLITNRDFSLNPKIATVLAQIICHDDKLPQGSPTSPVASNLIGHLIDIRLVQLAKRSGCTYSRYADDITFSTNKSEFPAPIAYRMDDTHSWIPGDSLLKIIHRCGFELNHDKTRMQYARERQSVTGLTVNKTSSAPAEFRRTIRAMTHKLFMDGDYFIPDEPKHQSSSRVELNYTQLNRLEGMHSYLHMISRFHRQKIVDNTVRRPEDIPLTAMEKMHGDFLFYKYFYASELPTIVCEGKTDNVYLTCAIKSLHAKYPRLAKPDSKGVMRLRIRFLNYSNLTHRVMGLNGGSADLGHLIRRYAKQCARYKGHPPLKPTIIVVDNDSGSQPIFQAIRDTTGDRYLTPSGKGKTFDKSKTVYYIAQNLYVVLTPLIKGGDSMMENFFPPAVLNTIYNGKKFEVVHKGPKGSAYSKHQFAQYVVKPNQKKIVFSRFSSILKSINSAIKDYPLIKITP

SEQ ID NO: 980 - protein, 580 aa, Pseudomonas fluorescens
  source 1..580: note = Related to CABVHP010000013.1
MSTLHRLQKAATLHDLAIIFNYTPASLAYLIYKKTNKYTEFDIPKSNGSKRRIMAPCDELKTLQRKIKKALDECLESIEKKAPSPGPISHGFKKGHSIASNADPHKKRLYVFNIDIQDFFGTIHMGRIRGFLISNREFNFHPKIATIIAQIICHDNKLPQGSPTSPIASNLIGHLIDLRLVQLAKKTGCTYSRYADDLTFSTNKPKFPKEIAYRLEETQSWIPGTPLLKIMHKSGFSLNHEKTRMQYACSQQAVTGLVVNQKANTPAIFRRNVRAMTHKLFLDGDYFIHENHKTKEKKELTYKNLNQLEGMFSYIYMIDRFNREKIVNNSNKRHEDFPKTAIERLHGDFLFYRYFYASPQPTIICEGKTDNVYLTCAIKALHVNFPRLAKTDPEGKLKLRVRFLKYSNLTHHVMGLSGGTPDIGHFIRNYAKQCAKYKAHPPLHPTIIVVDNDKGSDTIFKAIKDVTGTTYSIPAGKGTTLDKSKTLYKIAQNLYVVLTPLSGGNDTMMEDFFHRSVLSMPYEGKNFEVFRKGPPGTTYNKNTFALHIVKANQKTINFSKFSPILKSINLAIRDYPKIKL

SEQ ID NO: 981 - protein, 576 aa, Acinetobacter sp.
  source 1..576: note = Related to MELH01000002.1
MPRLRALQKATTLHDLAVILNYSPTALAYLLYKKTGKYSRFQIPKKNGTPREILAPCDELKSLQRKLKKLLDECLESIEKKRSPLGSLSHGFKANHSIITNAEPHRKRLYVFNVDIKGFFDSIHMGRIRGFFISNKDFNLNTKTATILAQIICHDDKLPQGSPASPVASNLIGHLIDIRMVQLAKRLGCTYSRYADDITFSTNKSEFPPEIAYRLENSHDWIPGGALLKVIYKSGFGLNHEKTRMQYARAQQTVTGLVVNQSTNTPAEFRRKVRAMTHKLFMDGEYYVHEENGPRSPKKTELNHSKLNKLEGMYSYIYMTDCFNRKKIIENSNRRHEDFPLSSLEKLHGDFLFYKNFYASPAPTIICEGKTDNIYLTCAIKSLHEKFPRLAKPDASGKVKLKVRFINYSELTHRVMGLNGGSSDLGHLIRRYAKQCGSYKAHPPLNPTIIVVDNDSGSQPIFQAIKDVTGDRYSIPSGKGKIFDKSQTLYKVAQNLYVVLTPLLNGKDSMMEDFFPPAVLRATYNGKSFEAVSPGPKGTTYSKHQFSQHVVKPNQKIINFSRFSHILKSINLAIRD

SEQ ID NO: 982 - protein, 435 aa, Pseudomonas fluorescens
  source 1..435: note = Related to CABVHX010000009.1
MCHDNALPQGSPTSPFASNLIGHLIDIRMVALAAKNGCTYSRYADDITFSTSKKNFPTQIAYCIDESNTWIPGSAVLKIISKCGFSLNHDKTRMQYTSSQQSVTGLVVNKIAHTPADYRRTVRAMLHRLFLDGTYFTIKKPKHLNKTERITIPFGQLNKLEGMLSYIYMVDRYNREKIVNNSKTKHEEMLMTSIEKMHGDFLFYKYFYAGDTPTIVCEGKTDNVYLTCAMKSLFAKYPELVSVDKDGKRILKSRFINYSELTHRMLNMFGGSADIAQFIRFYARRCKKYKAHPPLHPTIVVVDNDTGSKEIFGAIKDTTGGRYIIGAGKAQALDKSRTLYYIAQNLYVVLTPLNAGKDTMMEDFFPTTVLTMPHKGRSFEILKGVKPGNTYSKHIFAQHIIKANQKSIDFSGFSPILDSMKAALLDYPKIKLIPA

SEQ ID NO: 983 - protein, 583 aa, Pseudomonas sp.
  source 1..583: note = Related to NZ_JACAOZ010000012.1; note = Pseudomonas edaphica
MSELRKLQKAATLHDLAVILNYEPKFLAYLIYKKTNKYSQFTIPKSSGAPRNISAPCDELKALQRKVKVLLDSCLETIALQVPNLATLSHGFKKDHSIITNADKHRKKLYVLNIDIQDFFGSIHVGRLRGFFITNRSFSLQPKIATILSQIMCHEDKLPQGSPTSPVASNLIGHLLDVRMVSLASKNGCVYSRYADDITFSTNKLKFPQSIAYKIDDTHDWIPGSDLLKIISKSGFGLNHNKTRMQYNRAQQTVTGLIVNSITHTPANFRRTVRAMAHKLFLDGDYYVQEKPKHLKKEKISIPRGQLKKLEGMFSYIYMVDNFNRAKIVSNSSKKQEEFSLRSIERIHGDFLFYKNFYGASAPTIICEGKTDNVYLTCAIKSLHAKFPELASLTKEGKTRLNLRFINYSNLTHRVLGLNGGSADIGLFIRNYARQCGKYKAHPPLNPTIVIVDNDSGSKPIFSAIKDVTGSTYAIPKGKGTVLDTSKTLYKIAQNLYVILTPKIGGKDSMMEHFFPAATLATQYKGKTFEVVRSGPPSTTYSKHVFAQNIIKANQKNIDFSGFEAILGSIKLALDDYPKIITP

SEQ ID NO: 984 - protein, 580 aa, Pseudomonas sp.
  source 1..580: note = Related to MUHV01000013.1
MLSLYALQKAKDLHDVASILGYEPKFLSYIVYKKNPKYTYFTIPKSTGAPRNIAAPCDELKTLQKKVKQLLENCLVSIQLQGTAQGSLAHGFKKGHSIITNAEPHKRRRFVFNIDISNFFGSIHVGRIRGFLISNNSFKLEPKVATILAQIMCHNDALPQGAPTSPIASNLIGHLIDIRLVNLAAKYGCIYSRYADDITFSTNKREFPEQIASNIEKDEWIPGTSLLKAIHKCGFSLNHNKTRMQYCENQQTVTGLVVNKTLNAPATYRRQVRAILHKLFLEGKYHLKDKPTEKNHSNISIYDYKKLENIEGMLSYLYMIDSFKRKKLSLNSKIRCEDMERTSLEELHGDFLFYKYFYANNKPTIICEGKTDNIYLGCAMKSLWKKFKRLAKEEDGDIKLKVNFINYTELTHRVLDLYGGTADISNLIRHYAKRCAKYKAHPPLKPTIIVVDNDSGSDKIFKAIKETTGKQYIITKGKETLLDKSRSIYYIAQNLYVVLTPLKNGNDTMMEDFFSKSTLKTKVDGRFFEVYKKSTTGTYNKNTFAQKVIKAQRKRKIFNAFTPILASITAAIVDYSKLKP

SEQ ID NO: 985 - protein, 580 aa, Pseudomonas sp.
  source 1..580: note = Related to NZ_SOCQ01000001.1; note = Pseudomonas helmanticensis
MSLHVLQKAKDLHDLARILNYEPKALSYVLYVKKPQYTSFTIPKSSGAPRHISAPCDELKTLQRKVKRLLDSCIASIELQGPAKGALAHGFKKGHSIITNAEPHKRRRFVFNIDITDFFGSIHVGRVRGFLITNKSFQLAPKVATILAQIMCHENSLPQGAPTSPIASNLIGHLIDIRLVSLAAKLGCIYSRYADDITFSTNKKDFPSSIAIEVDENEWVPGTTLLKIIYKCGFSLNHKKTRMQYSDNQQTVTGLVVNKSINAPAQYRRQVRAMLHKLFLDGNYHRKDEPRYKAHANSTIYDHKSLEPLEGMLSYLYMINNFKMDKLSKNGKIRKEDIKRTSLEDLHGDFLFYKNFYANKKITILCEGKTDNVYLSCAIKSLHKKFIRLAKTTGGKVELKTNFINYSKLTHRVLDLNGGTADIANLIRSYAKRCGKFKAHPPSQPTIIVVDNDSGSDPIFKAIKDTTGKRYEIANGRGTSFDKSRPVYYVAQNLYVVLTPLRNGQDTMMEDFFSKNILKTKLDGRSFEVYKKGLPGKTYSKHTFSQKVIKAQQKRKIFNGFVPILSSISAAVVDFSKLKP

SEQ ID NO: 986 - protein, 586 aa, Pseudomonas sp.
  source 1..586: note = Related to CP050147.1; note = Pseudomonas aeruginosa
MLSLNALQTAQTLHDLAHILNYEPKFLSYILYKKPVKYSHFTIPKSSGAPRDIAEPCEELKALQRKVKELLEVCLKTINNQKPQYGSLSHGFKKDHSIITNAYPHRKKRFVFNVDISDFFGSIHVGRVRGFFITNRDFRLSPKVATILAQIICHEDALPQGAPTSPITSDLIGHLIDIRLVEIAERYKCVYSRYADDITFSSNEKNFPSAIAFPVEGTTDWVPGRALLKAIHKCGFGLNHNKTRMLYRESQQTVTGLVVNQKVNPPATYRRQIRAALHKLFLDGQYFLQEKPRHSSSSKVDLGIDSLEKIEGMLSYVYMVDKFNRSLTVETSKSKKEEEIPKTSLEKLHGDFLFYKYFYAASKPTIICEGKTDNVYLTCAIKSLYKNYPELAKVSNDELKLNVKFINYSDLTHRVMGLNGGTGDIANLIRAYAKQCGKYKAHPPLHPTIVVLDNDSGSQQILNAVKDLTTPRYDVPNGKGTKLDTTQDFYKIAQNLYMVLTPLDKGKSTMMENFFPTKVLNTIYKGKTFEILKKSPPDQTYSKHIFAQHIVKAEQKKIDFVGFSPILDSITKAIKDYPTITLPKIK

SEQ ID NO: 987 - protein, 582 aa, Pseudomonas sp.
  source 1..582: note = Related to QJUQ01000005.1; note = Pseudomonas kirkiae
MSKLNILKNAKTLSDLAHLLNYKPKYLSYIIYKKQNLYHQFTIPKSSGAPRTILAPCDELKALQKKVSELLQDCLENMNQDLQIHSSLSHGFMRGHSIMTNADNHRKKRFVFNIDIQDFFGSIHLGRVRGFFINNKSFQLDPKVATVLAQIACYNNSLPQGSPCSPVVSNLIGHLIDIRLVSIAKKAGCQYSRYADDITFSTNKTSFPSTIAIQDETTGNWSVSEQLAKIIKKCGFSLNTTKTRMTYRKSQQTVTGLVVNQKVHTSASYRKQARAMAHKLFNDGSFSIPDKASLAAKENSPKMIAGTLNQLEGIFSHIYMVDQFNRNKLRGNNGIRGEDLELTAIEKTHRDFLFFKHFYSTSLPTIICEGKTDNVYIQCAIRSLATQYPELATIDAQGKRILKVRFINYSELTHRVLDLNGGTADIARLICGYVHLCGKYHNTAPKHPTIVLIDNDQGSQSIFSAIKSTTKDTHTAGTGKNKQIDRSKNFYYIAQNLYVVATPLINGKDSMMEDFFKNATLATLVDKKTFSVRTPTAPTGSTYGKHIFAQKVVKANRDKIDFSDFSPILDSLKSVIQHFKLP

SEQ ID NO: 988 - protein, 577 aa, Pseudomonas sp.
  source 1..577: note = Related to NZ_CP052862.1
MSKLAILRSAQGLHDLAELLAYEPKKLSYVIYKMPNRYTKFTIPKSSGGTRSIAAPREELKALQVKVSKLLQLCIHNMNADLNITTSLSHGFTKGHSIMTNADLHRKKRYVFNIDIENFFGSIHRGRVFGFLTKNKSFSLNPKVARALAQIACHDDALPQGAPSSPVFSNLIGHLIDVRLVELASKLGCSYSRYADDITFSTNKKTFPKEIALVSPSNEWVASPTLIKIVSKCGFALNENKTRMQYQESRQSVTGLTVNRKINSPAVYRHQARAMAHSLFNTGSFSVPDKDPKVKAKIPGTINQLGGMLSYIYMVNTFNRSKIVENSAIRDEDIKLSAMEKVHADFAFYKHFYGNQKITILCEGKTDNIYLQCAIKSLAKKYTILAKLNADGKAVLNVNFFKYTDLTHRLLGLYGGTGDIGELIKRYVSCCGKYKNHPFKHPTIIVVDNDEGSQKIFTALKVVTGNKYMIGSGKAQNLDKSLDFYYVAQNLYVVFTPLKMSGDDTMMEDFFTSDTLNTIVDGQRFSVVHKAPNQLVYSKHTFSQKVVKANQKTINFLGFTPVLDRIQKAAKHFYSLP

SEQ ID NO: 989 - protein, 588 aa, Pseudomonas fluorescens
  source 1..588: note = Related to JAGGOG010000003.1
MIKLKLLQSAATLRDLSIALGFQPKAVSFILYKYSKERLYTSFTIPKKSGALRDIHAPCAELKNLQSRVSEYLQDCIQEINESKKITQTLSHGFKRGYSIVTNASTHRKRRLVLNVDLEDFFGSINFGRVRGFFITNKNFSLNPNVATVLAQIICFDNKLPQGSPCSPVMSNLIGHLLDIKLAQMATSMKCTYSRYADDLTFSTNKQQFPLELVSPGDNHHDWVAGAKLEQIISKCGFKVNARKTRLQYQDSRQDVTGLVVNEKVNVPAPYRRQARAMAHRLFEHGSFQVERLSIKDKGQVTSERIEGSVDQLSGMFSYIAMVSQHNKDLVLKAGLKNAQTELSSIEKVHRDLIFYKSFYANPMPTIICEGKTDNVYLRCAIRSLAKQYPLLATFEDKNKLKLNVSLFKYSRLNSSLLGISGGTSNLKPFISDFSKNIARYKSRKSPFPVIILIDNDRGAKEIYSTIKTTTKTADTIDGSIPYYHIAQGLYVVPTPKLNGALESKIEDFFPLQTLKETLDGKKFNDKNEDLKADEYGKHFFAEHVIKKKQNSIDFTGFKPLLDIISSIISQSVALHMSAVVPPAPPKV

SEQ ID NO: 990 - protein, 588 aa, Pseudomonas sp.
  source 1..588: note = Related to NZ_LT607556.1
MIKLKLLQSAKSLRDLSIILGFQPKAVSFIVYKYSKDRLYTSFTIPKKSGSIRTIRAPCPELKNLQSCVSKYLQDCIDEINESKKITHTLSHGFKRGYSIVTNASVHKKRRLVLNVDLEDFFGAINFGRVRGFFITNKNFSLQPSVATVLAQIICYENSIPQGSPCSPVVSNLIGHLLDIKLAKIASEMKCTYSRYADDLTFSTNKQQFPLELVSPGNSPHDWVVGERLERVIQKCGFQVNSRKTRLQYRDSRQDVTGLVVNEKVNVPAQYRRRARAMAHRLFESGSFQVEKLSIKDDGRAVSETRAGSVEELSGMFSHIAMVSQYNNDVAIRAGIKDLRGELTSIEKVHRDLIFYKSFYANPMPMIICEGKTDNVYLRCAIRSLAKQYPSLVTVEAPDKVRLNISLFKYSKLNSQLLGINGGSPHLRTFITDFSKAAAKYKSRRSPFPVIVLIDNDKGAREIFSTIKATTRTTEKIDGSMPYYHIAQGLYVVPTPKLNGALESKIEDFFPVATLSETLDGKKFKAENEDLKADEYGKHYFAEYVIKKKQGSIDFSGFKPLLDVISTIVSQNIALQMSAVVHQVVVKK

SEQ ID NO: 991 - protein, 609 aa, Pseudomonas fluorescens
  source 1..609: note = Related to NZ_CABVHD010000002.1
MSEYIAPDRLCKRAVQMGRYEFRVRVSISLFMKIKLLQSASNLRDFAILIGFQPKAISFILYKHPKDRLYTQFEIPKKNGSFRTITSPCPELKNLQSIVSKYLQDCLAEIDERRPKKGTLAHGFKRGYSIASNAAVHRNRRYVLNLDLEDFFGAINFGRVRGFFINDRNFSLKPDVATILAQIICFENKLPQGSPCSPVVSNLIGHLLDIRLVALASKYGCSYSRYADDITFSTNKKTFPIELASSQLIPNVWSLGPELSSMIVRSGFTINVSKTRVQYSDSRQEVTGLVVNKKVNTVASYRRTARAMAERLFRTGSFQIEKLVLDSEGKSKSGTVSGTVEQLNGMLNFITMINRLSEEFRVSSDKHDLSSIEKVHRDLLFYKYFYANTMPTIVCEGPTDSIYLRCAIRKLAAHFPALAGFNKEGEIELKVCLFKYSDLNARLLKLTGGTAPLRTFASGFSSNAAKYKSRKSIFPVIVLIDNDKGAKPIYSFIKQLPGNGGVVDGSQKHYHVAQGLWIVPTPRSEGVPESKIEDFFEDKVLKMELGGKHFNPENMDLSDDEYGKQYFAEHVIKANHKSISFDGFAPILSTISSLITDSINQAKSALNRP

SEQ ID NO: 992 - protein, 578 aa, Pseudomonas sp.
  source 1..578: note = Related to NZ_UTCV01000055.1; note = Pseudomonas viridiflava
MKIKLLQSASSLRDLAILLGFKPKAISFLLYKVPKPYLYTQFQIPKKNGSTRTIMSPCAELKNLQSVISNYLQDCLEEIDEKRQKKGTLSHGFKRGYSIASNAAIHRNRRYLLNLDLEDFFGSINFGRVRGFFINDKNFSLHPDVATVLAQIICFENKLPQGSPCSPVVSNLIGHLLDIRLVGLASRYGCSYTRYADDISFSTNKKDFPAELAAPGSMPHEWHVGPVLTDVIMRTGFSINASKTRVQYSDSRQEVTGLVVNKKVNTAATYRRAARAMAERLFRTGSFQVEKMVLNSEGNSVSGVVRGSIDQLNGIFNFITMINRFSEVSRESIQKSELSSIEKVHRDLLFYKYFYANTMPTIICEGSTDNIYLRCAIRKLSANFPALAGVNEKGETELKVCLFKYSKLNARLLDLTGGTPPLRTFISEFANNAAKYKSRKSIFPVIVLIDNDKGAKIIYSLIKQLSGNASVIDGSQRHYHIAQGLWIVPTPKAVGVVESKIEDFFEDKVLEMELGGKHFNSENNDLSDNEYGKQYFAEHVVKANHKDISFDLFAPILSTISTLITDSINQANSARNRP

SEQ ID NO: 993 - protein, 579 aa, unidentified
  source 1..579: note = Related to JAHKPP010000027.1; note = Saccharophagus degradans
MKHLDLIKSCNNLQDVAFVLGYKPSRLAYILYKMPNSTKYREFEIDKKLGGKRKIFAPCPELKTLQQRLSKLLQNCIAVINKEKGIQKSISHGFKRDCSIFTNAEQHRNKRFVLNIDLEDFFGTINFGRVRGFFIKNKNFEIDENAATVLAQIACFNNSLPQGSPSSPVITNLISHTMDIRLAALAKQLKCTYSRYADDITFSTNEKNFPIELAEPTNAEGTEWKVGKKLERKIQKLGFSVNHKKTRLQFSQSRQDVTGLVVNKKVNIKSEYHRSARAMAHSLFKTGKFHIKENKQDANGNIVETKREGKITELGGYLNFIDMADKYRKRHVDDYKERRILSSREEIYRDFLFFRYFYQPSRPIILCEGKTDYIYLKCAIKSQFSKYPNLCQKNKQDEKILKVDFFKYTEVKSRLFSLSGGASTLSTFIGNYTKFCETYSVEISKNPVIIVVDNDMGVNKVFSSAKTKKYGKSKGSNIDGSLPFYHLGENLYLTAIPKKLGKDTAIEDYFKPTVLSTKYNGKTFNYKNKTKNVNPKTEYSKAVFAEHVIEKNRDKIDFSDFTPILDNICAAINDYSKKK

SEQ ID NO: 994 - protein, 604 aa, Chromobacterium sp.
  source 1..604: note = Related to NZ_LCWR01000203.1; note = Chromobacterium subtsugae
MQASPLKKFLTSSMQIPSLQDLKECRSRADIATLLGFKPAALTYILFKIDPPKKYRIFTIPKKSGGTREISSPCPEIKQLQKRLSYILSDAYTHLYDLNNTKKSVSHGFRKKHSIITNAVMHQKRKNILNIDLEDFFPTINFGRVRSFFIKNKDFNLHPDVATTLTQIVCHENSLPQGAPTSPIISNFIARPLDIRLLSLAKSHGCFYTRYADDITFSTNKSEFHSDIAKRNSIGNDWTIGGKLSSTIEKSGFILNDKKTRVMYSISRQEVTGLIVNKKINTRIEYRKLARSYVHSLINTGQYYLTSHEVENNKKIKVKRIGSIKQLDGILNFIYHTERFSNLKLNEKKNKKTNQNISYSNSEKTYRKFLKHTLFCENEFPFIICEGPTDDIYLKSALLMKGENFPLLYSSQSRPKIKLKFFKHSEKMRHLLGMSGGTGDIKNFIASYNKEIASEFKERPKNPIIVVIDNDQGSDEIFAWIKRNIEPFKSRKDSNVKGDENFYIVKPSLYIVPIPRINESDTAIENLLPSHLINNQIDGKEVNLSNKAVETNQINKMKLADHVRKNKKDIDFSGFNKLLESISMAYYHYKDETASVEKSYSHGM

SEQ ID NO: 995 - protein, 603 aa, Chromobacterium sp.
  source 1..603: note = Related to CP069442.1; note = Chromobacterium violaceum
MSNLNKLKNCETRADLADLLGFKASSLAYILYKMPPEKKYEEFLIPKKAGGNRSIAAPCPGLKKLQKRLCEILTECYQELYGGSGIKKSISHGFRPKHSVITNSLMHQKRRRVLNLDLKDFFPSINFGRVRGYFIKNKDFAISSDVATVIAQIACHDGVLPQGAPTSPVISNLVLRSLDLRLLTLAKKNSCFYTRYADDITFSTNKTSFPEEIAIKDQLTHKWDVGGELESTILRSGFQVNDNKTRVMYKVSRQEVTGLIVNKRVSTREEYRDQVRSMVYSLTKRGEFYFKQISIVDGQATTVKEPGDVWQLDGMLNYIYNVDMAYLTWAVGEKKVSEKKDKDVVYSAREQIYRKFLFYTLLCKSESPYVICEGVTDDIYIRCALSSLVGEFPTLRVASDEKKIKLKFFNHSKKMKYLLGMGGGTGDIKKFLIEYKAVIIKTFSERPSFPVIVIVDNDSGFRGSKGMYSWVRANAEAIDGPGFGIGPKAKEGFYFVKPSLYIVPIPRGEESEVAIEDLLPSKILTSKIGGKEVNLNNNGVSSSAEIGKTRLVEHVRKNRKDIDFGGFRPLLRLIEGALTHYDAATKSGVELVAGPNAVVDASM

SEQ ID NO: 996 - protein, 558 aa, unidentified
  source 1..558: note = Related to NZ_CP031124.1; note = Ephemeroptericola cinctiostellae
MTLLEQLRQARTLSDFAIILGYEPKKLSYLLYILPKEKPLYNQFSIKKRSGGERVISAPCEELKELQKRLLNLLDKCSQEINASKSKNHNSISHGFKKRHSIVTNAVKHKNKQYVFNIDLENFFGTINFQRVCGFFVKSREFQLHSKIAEIIALISCHQGSLPQGAATSPIISNLITHILDVRLVKFSTKIGVFYSRYADDLTFSTNKKNFPIEAALKSIELKHQWIIGKDLNEIINRSGFKVNSSKTRMQYKNSRQEVTGLIVNKKINTKREYKQKVRAMVHALVHRGEFNIFESDSGMYVKGSLNQLRGMLSFIESINPRDGCSKANEKMIGRDIYHKFLFYKYFYFGDKPILICEGKTDGVYIREAIKWFSGRDEFKGLKFDIFKYSKLNGRVLGLNGGYSDLTKFIAQYLTFFNVNTAPSSNMPVIVVIDNDDAAKKILKDERNENRDFYHKVKNLYVVTTPLVGTEVESEIEDLFKIEALRIELNGKTFHKEKDLNDGKHYGKHVFSEKIVKSKEYNIDFSGFEELLKRIQNAIKHFETQTNENRKSSIEPIN

SEQ ID NO: 997 - protein, 564 aa, unidentified
  source 1..564: note = Related to JAEMNU010000126.1; note = Rugamonas sp.
MSKLKDLKNAKSLTDLAKLLGFKPKALAYILYVMPKELRYAEFEIPKRTGGLRKISAPCSKLKKLQKNLSDLLLICCDELHSQRESQHNRKIYSAISHGFVRKKSIITNAANHRSRRYVFNLDLNDFFGTITFPRIRGFFIENKNFNLDPTVATLIAQIACNNDALPQGSPSSPVISNLLAHILDIRIVALVSKVGCTYSRYADDLTFSTNKNNFPEELAKFDDVEKLWSEGEVLRNIVNSSGYKINSSKTRMQEKRSRQEVTGLIVNSKVNSRVEYRKSVRAMAYSLFETGKFHRNISRLNDEGKIIVIKELGKMSELNGMLNFVDMLSDYNRGKDRTSSVGNEHLRKEPRKMVQLNTNERIYRDFLFYKYFYSSDTPTIICEGKTDYVYLQCAIRKLHQKFPMLAGVNASGKIEFKIKFFRFSALTSKLFGLSGGATQLKQFIIDYDDACSRFKAAGLNKPVIVVLDNDAEAKPIYSLIKNYLNINVDGSELFYEYKRNLYIVATPLLPGLKETMIENCFSTDVTEKILSGKKFSWANDYKKDETYGKKYLAEYVVKKSAIQ

SEQ ID NO: 998 - protein, 580 aa, unidentified
  source 1..580: note = Related to NZ_CP009962.1; note = Collimonas arenae
MTQLKNLKAAISLNDVATILGFTPKALAYILYKIPSAEKYAHFDIPKRSGGIRKISAPVARLKKLQTRLALTLQQCIIEINTSLKVKNVLSHAFTPKFSIITNAVNHRNKRFVFNLDLENFFGTINFGRVRGFFIENRNFQLHPDVATVLAQIACHENMLPQGSPSSPVISNLIGHILDIRLAELAHKTGCTYSRYADDLTFSTNKANFPSRVAQLINQTTHEWNTGKELERLILKAGFTINSSKTRMQYESNRQEVTGLIVNKKINTRTEYRHLVRAMAHNLYKTGQFYKTETVRDATGALVHTKVDGTVSQLNGMLSFVDSVGVYNLEKNEPKEFSVTKHKDAKPEAKLSAIETVYRRVLFFKNFYSPEYPVILCEGKTDSVYIKAALRKLVDDFPNLAVKKNGKVESKIRFFNYTKTADRIMNLNGGTGQINKFIVDYAPNCKKISAKGQLMPVIVLIDNDEGAKGIYSTVSKVTKKEVKNTDDFFFVAENLYIVATPLLEGKQSTIEDFFEPYVRDTKLHGKSFSGKNTFDPHTQYGKHYFAEYVVKKDESKISFEGFRPILARLDAALSDYKKKT

SEQ ID NO: 999 - protein, 601 aa, Pseudomonas sp.
  source 1..601: note = Related to RHQT01000006.1
MLGANAHISLPEWSTRLVTVIRVRVPINPFPSLIVMSKLASLKSATSLRELAVVLGYKPKNLSYILYIKPKKELYEEFEIPKKSGGVRKISKPCEELRALQRKLADFLQDCIDEINSEKKVKVSISHAFKRRHSIATNAFAHKNRRYVFNLDLEDFFGSLNFGRVRGFFMINKDFEFHEPVATVIAQIACFNGSLPQGSPCSPVISNLIGHVLDIRLAQLAKKTGCTYTRYADDLTFSTNKKVFPGDVAGFDVGASEWGAGRKLKKIIKDSGFVVNSKKTRMQFSTSAQSVTGLVVNKKVNVSYAYRRNVRAMADSLFKTGKFHLPGPEKKLGSVDQLSGMFSYIHMIIEFERAVRLNGSKDSQQERELLGIEKVYRQFIFFRKFYANPRPVVIYEGKTDAIYLHCAIRYFARIGKFPELAVKKGDEYHFNVEFFRFTKTTSRILGLSGGAEQLKNLIREYAQVCSLFKAPGNTKPVMMVIDNDKGAKNIYSLIKEFQKSEAPIDGSANNYNVVRNLFVIPTPKGKNKESKIEDFFDDQALASKLGDKTFDLNSDFDTANFYGKNAFAENVVNKNKDSINFVGFEPILARMVEVINYYKPS

SEQ ID NO: 1000 - protein, 555 aa, Pseudomonas sp.
  source 1..555: note = Related to CP066045.1; note = Pseudomonas stutzeri
MLGFKPKALSYILYIKNKADLYNQFLIPKKTGGARTILSPCDELKAIQRKLSDYLQDCINEINSQRKITFSIAHAYKKKHSIATNARVHRGRRYVFNADLENFFDSINFGRVRGFFISNNNFKLHPDAATVLAQIACHNNSLPQGSPCSPVISNLIGHILDIRLARLASKEGCTYTRYADDLTFSTNKKIFPKSIAMLSDSEEHIWSTGKQLEKEIKKTGFAINNKKTRMQYKDSQQTVTGLVVNSKVNTRYSYRRTARAMADALFKTGKFTIKKPVQANGKSILLETPGTVEQLCGIFSYIHMIAEYNRSISMSNNKKLELSGIEKTYKELLFYRRFYANPRPLIIYEGKTDAVYLRCAIRSLIKLGEFPELGGINDKSEVEINADLFTYTKTASRILGLPGGAAPLKTLISEYLHNFSRYQAPGNTSPVIMLIDNDSGSKDIYSLIKQLRKEKNPIDGSEEHYYIAKNLFVVPTPKVLGKESKIEDFFTRNTLEMKIGTKSFDCSNDHDTETSYGKNAFAEQIVKANQNTIDFTGFRPILQRIVNVINYYRAI

SEQ ID NO: 1001 - protein, 576 aa, unidentified
  source 1..576: note = Related to JAIZSB010000002.1; note = Burkholderia cepacia
MSRLAKLRRAAGIDDLAELLGFKPKAISYILYIKDPEKKYVQFEIPKRSGGTRLISAPCGDLMSLQRRLAELLQECIAEINEERKVRTVLSHGFRRKHCIKTNAWMHRGKRFVLNVDLSDFFGSINFGRVRGFFMANNNFKLNAKVATLIAQIACHENALPQGSPCSPVISNLIGHLLDLRLAELAKQSGCTYSRYVDDITFSTNKPQFPRNVAVQRDEDDHEWDAGADLVRIVGRAGFRLNDRKTRLQYHGSRQEVTGLVVNATLNTRVEYRHVARAMVHKLMTTGAFKRKRFVQNEDGTWALAEVDGKIEELNGMLSFIDSVDLYKRRRQLKEVERDKSLVTLKDLSATERYYGDFLFYKNFIFNERPVILGEGKTDNVYIQCALRSLLADYPSLIAKGANGFDQKISLFNRTSTIERLTQLSGGAEQFKTFVKEYLAARRKFPIKGKAPPIVIVADSDDGIGQVNAYLKNLTGSPVDMTADFTHIKENLYIVYTPLDAGGKGAPMENMFEKSVLQTQLGGKTFNPSNTKINHAKEYGKAYFAQHVVKKDADKIDFSGFKVLLDRIVKAIEHGS

SEQ ID NO: 1002 - protein, 579 aa, unidentified
  source 1..579: note = Related to QTSF01000012.1; note = Burkholderia cenocepacia
MSRLAKLREATGLEELAKLLGFKPKSISYVLYIKDPEKKYAKFEIPKRSGGMRQISAPCSELMGLQRRLAELLQECIAEINEERGVKTVLSHGFRRKHCIKTNAWVHRNKRYVLNVDLQDFFGSINFGRVRGFFISNKNFQLKEKVATLIAQIACHDNALPQGSPCSPVISNLIGHLLDIRLAELAKQSGCTYSRYADDITFSTNKPQFPKNVAVQRDEDDHCWVAGADLAKIISRAGFKVNDKKTRLQYHGSRQEVTGLVVNTKLNARSEYRHVARAMVHRLMKTGSFTRKGYVLDKEGKGSIQEVEGTVESLSGVLSFIDSVDLYNRMSKIKKADREKPLVTLQDKTATERCYGDFLFYKNFLANEKPVVLGEGKTDNVYIQCALRSMFAQYPYLIKKNADKFDFQFSFFNRTSTTDRVTSLSGGSEQFKTFVKEYLAYRRKFPIKEKAPPIVIVADSDNGVKQLNGYIRSVTGSAVDMNADFTYIKENLYVVYTPIAADGKGAPIENLFEKNVLEKELNGKKFNPSNSGINPAKEYGKAYFAQHVVKADADSIDFSGFKVLLDRIAKAIAHGSAKV

SEQ ID NO: 1003 - protein, 577 aa, unidentified
  source 1..577: note = Related to CABWIJ010000002.1; note = Burkholderia lata
MSRLAKLRGAAGIDELADLLGFKPKAISYILYIKDPAKKYTKFDVPKRGGGNRTISAPYDDLMNLQRRLAELLQECISEINGERKVKAVLSHGFRPKQCIKTNAWQHRKKRFVFNIDLQDFFGSINYGRVRGFFITNKNFKLTEKVATLIAQIACHDNVLPQGSPCSPVISNLIGHLLDIRLAELAKKNGCTYSRYADDITFSTNKPEFPRNVAVQRDEDDHDWVAGADLVKIINKSGFKINDKKTRLQYHGSRQEVTGLVVNRKLSARSEYRHVARAMVHRLMKTGAFVRTAFVQDKDGKVSLAKPAGTIPHLNGILSFIDSVDLYNRRSLLKVAERDKALVSLKDLSATERCYRDFLFYKNFLGNAKPMVVCEGKTDNIYIQCALRSLLAGYPSLIKKGVSGYEMELSLFNRTQTTDRLMSLSGGSEQFKTFVREYLNARRKYPINGKVPPIIIVADSDDGVKNFNSYIGGITGAPVDMKADFTYVKENLYVVYTPLGATGKGAPIEDMFDKSVLQKQLNGKTFNPSNSGINHATEYGKAFFAQHVVKKGAEGIDFSGFKVLLDRIVKAVEHSSK

SEQ ID NO: 1004 - protein, 591 aa, unidentified
  source 1..591: note = Related to NZ_JMLA01000001.1; note = Methylobacter tundripaludum
MSHLKTLKEATTLHDVAHILGFQPKSLAYILYKKPSAEKYKHFTIPKRTGGKRSISAPYPDLMNLQKRLSDLLQNCISEINQARKIESTLSHGFRRKYSIITNAAIHRNKRYVFNIDLANYFGAINFGRVRGFFITNRNFELKPAVATVLAQIACHENTLPQGSPCSPVISNLIGHLLDIRLAALSSQVGCSYSRYADDLTFSTNKRNFPAKVAKLAEGNHQWQVGKELVRIIDRTGFTINNTKTRMQYMDSRQDVTGLVVNSKINTRAEYRRIARAMVHRLLNTGSFQRKQISYDDQGNLVETEVNGTLDQLNGMLSFIDSVSVFNKRKDKNPTEKEKDLMPSKDPDNNEKVYRRFLFFKNFYASANPLIICEGKTDNIYLKAAIQRLADAYPCLAEKKEKGGISLKVCFFRRNATSGRILGLAGGTGELINLIKMYATESKHITAPGKKQPVILLIDNDEGAKGIYGYVKNLTKSKGDSKAAFIFVTENLYIVPTPLTHDGKNTMIEDFFEESLKNTKLNGKTFNPSDKGFNSKTEYGKNYFAKHVVKENQATIDFNGFKPILTRIEAVLNYHSKKPSSESMAESMGSD

SEQ ID NO: 1005 - protein, 581 aa, unidentified
  source 1..581: note = Related to NZ_FNKX01000001.1; note = Paraburkholderia tuberum
MSKLKILQAATSLHELADLLGFKPKAVSYILFKKDLAAKYTEFEIPKRAGGKRLIQAPYPELMNLQRRLSELLQDCIAEINAARDIDSVLSHGFRRKYSIITNAVVHRSKRFVLNIDLANFFGTINFGRIRGFFISNRNFALQPKVATLIAQIACHDHVLPQGSPCSPVISNLIGHLLDVRLSALAFQTGCTYSRYADDITFSTNKPLFPAKLAKAVEGDEHRWEVGKTLFRAITKAGFEVNAEKTRLQYTDSRQEVTGLVVNSKINTRSEYRRTARAMVHRLVSTGSFYRKRVERDGDGEVVISEKLGTLEQLNGILSFIDSVGVYNKKKGMKDDEREKPLTMPSSPDCQEKDYRKFLFYKHFFAIKQPMIVCEGKTDNIYLSCAIRRLAKSHLLLASPDGKGGSRLQVSFYKRTATTDRTIGLTGGTDQLISLIKEYRAESRRIKIAGKVQPLILLIDNDNGAKGIFAYLKNLLKVQIDPNAPYFEAHEGLYVVPTPLTSDAKGTMIEDFFDESVLKTMLNGKTFNPSNEGVNHKTEYGKAYFASHVIKKHENTIDFSGFKPILDRLEEVIAHHQKKHQ

SEQ ID NO: 1006 - protein, 577 aa, unidentified
  source 1..577: note = Related to JACVPK010000006.1; note = Polynucleobacter wuianus
MSILEKLQAAQNLHDVALLLGYQPKSLSYILYVKPKTQKYTTFNIPKSSGGTREIKAPYPDLKTLQKRLSKLLQECIAEINLQKEITTSVSHGFRKKHSILTNAAVHKNMRYVLNLDLKDFFHSINFGRVRGFFIANQNFLLNPNVATIIAQIACHENCLPQGSPCSPVISNLVGHILDMRLVQLARKFGCIYSRYADDITFSTNKKVFPVDLATAALDGEQLWSVSKPLHDIIKRSGFDVNSAKTRMQYKFSRQEVTGLIVNSRVNVRFGYRRIARAMLHKLITRGEFHKPNSKKVSSVTNTTAPSLDYLNGVLSFINSVNLFVHKKHSFRVKSDSKKALEKSFLNLSISRGYRNFLLYKYFFAAKNPVIICEGKTDNVYIRSATRQLSTQYPILGKSSPDGTINLKISFFKRTKTTDMFLGLTGGASQFNKFIEDLRQPIFKDFLLKIKQPIIIVIDNDHEALKVFSYLYKNFNINCDKTVGFIEVFRGLYVIPIPLLSGANQSVIEELFDIKDLTRSLDGKKFNYKSDSYNTKLEYGKSAFATRIVQAKEDQIIFDGFKPLLTQIEEAIKSFRC

SEQ ID NO: 1007 - protein, 573 aa, unidentified
  source 1..573: note = Related to PHCU01000169.1; note = Betaproteobacteria bacterium HGW-Betaproteobacteria-12
MSFLTELKSAKSLHDVAYLLGYKPKSLSYVIYKMPVKYETFTVPKKTGGVRTISAPHPELKLLQRRLSDGLQSCWDEINSEKKISKPISHGFRRRSSILTNASVHRGRRFVFNVDIKDFFDSINFGRVYGFFLKNTDFALPESVAKILAAISCHEGKLPQGSPCSPVISNLIGQVLDIRLAQLARSHGCSYSRYADDLTFSTNKRVFPSAVAALGINHAWVVGDALSKIIERSGFQLNPKKTRMQYCDSRQEVTGLIVNRRANTRPEYRRLTRAMTHKLVTTGKFQIAGMKADASGTFAPTLVDGSISHLQGMFGFIDWVDLSHKKATETHDGPPSSISKVYKRFLMHRDFWASSLPVILCEGKTDSVYLRGAIRRLATAHPSLVSMTTVGKAEYKVRFFNYSYTSQRILDLSGGAPAVKSFITGYLKSVKKTPAPSNRQPLIVLLDNDSGGKVFYSLIKEYNGKKTPVDGMDDFYHLEANVYVVFTPIAKPGDNSSIEDFFEPALLATKIDGKSFNPSNEDLDENTEYGKAIFAAKVVRPNIPKINFDKFGLILARLERVMDAHVKKHVSKV

SEQ ID NO: 1008 - protein, 574 aa, unidentified
  source 1..574: note = Related to NCCT01000010.1; note = Hydrogenophilales bacterium 12-61-10
MSFLTILKNAKSLHDVADLLRYKPKSLSYVIYKMPVKYETFTVPKKTGGVRTISAPRPELKLLQRRLSDGLQSCWDEINTEKKTTNNKTTKPISHGFRKGASILTNASVHRGRRFVFNVDIKDFFDSINFGRVYGFFVKNKDFALPESVAKVLAAIACHDGKLPQGSPCSPVISNLIGQILDIRLAQLAHRYGCSYSRYADDLTFSTNERIFPSAIALSNIDHSWVAGVGLSKIIEKAGFQLNPKKTRMQYLDSRQEVTGLIVNRRINTRPEYRRLARAMTHQLVTTGKFQITAMKADALGTLVPSKIDGNIRHLQGMFGFIDWIDWRHKKARGTLAGMPSSIDKVYKRFLMHRDFWASSLPVILCEGKTDSVYLRGAIRRLATAHPNLVLMSAAGKAEYKVRFFNYSYTSQRILDLSGGASVVKKFITEYIKSVKKTPAPANQKPLIVLLDNDSGGKVFYSLIKEYKKTPVNGMDDFYHLAANVYVVFTPIAKPSDNSSIEDFFEPALLEMKINGKSFNADNEGLDKNTEYGKADFATQVVRPNIAKINFDKFDPILARLEGAMEAHIKKHVS

SEQ ID NO: 1009 - protein, 571 aa, unidentified
  source 1..571: note = Related to JAGFNH010000001.1; note = Candidatus Accumulibacter sp.
MFFLTNLKSAKSLHDVACLLGYKPKSLSYVIYKMPLNYTTFTVPKKSGGVRSISAPRPELKLLQRRLSDGLQSCWDEINDQKKITKPISHGFRRDASIVTNASVHRGRRFVFNVDIKDFFDSINFGRVYGFFVKNKDFALTESAAKVLAAIACHDGKLPQGSPCSPVISNLIGQILDVRLAQLAHRHGCSYSRYADDLTFSTNERIFPSMIALSNADHSWVAGAVLSKIIEKSGFQLNPKKTRMQYRNSRQEVTGLVVNRRINTRPEYRRLTRAMTHQLVTTGKFQLTKTKADVLGKLVPTKIDGSITHLQGMFGFIDWIDLCHRKNQEVPNVQQSAIGKVYKRFLMHRDFWANSLPIILCEGKTDSVYLRGAIRRLATAHPNLVSTNAAGKSEFKVRFFNYSYTSQRILDLSGGAPVVRRFITEYIKSVKKTQAPVNPKPLILLLDNDSGGQVFYSLIKQYNGKKTTVNGMDDFYHLAENVYVVFTPIDKPGDNSSIEDFFEPSLLAKKIDGKTFNADDTTFDKNKEYGKADFAAKIVRPNIAKINFEKFDPILARIEGVIEAHSKKHFP

SEQ ID NO: 1010 - protein, 594 aa, unidentified
  source 1..594: note = Related to JAIQFH010000036.1; note = Acidobacteriia bacterium
MSQLQALRAASTLEHVADLLDYKPKTLSYILYKIPAANKYTTFSIPKKDGNPRDINAPCSELKELQSHLSDFLIGCANEINEIRKFKDQLSHAFKPEHTIVTNAVRHKKKRYVFNIDLKDFFGTINFGRVRGYFLKDANFMLHAKVATILAQIACHDHKLPQGSPCSPVISNLVGHILDIHLCGLAFKNGCTYSRYADDITFSTNKPIFPENIAKLLPGQAHAWQVGNGLEKIVSRSGFTINHQKTRMQYRGSRQVVTGLTVNKKVNIKNDYRRTVRQFTQRVFNTGKFQYLAVVTDAAGAKTPTKIDGSLEQLHGMFGHIDFVDNENKEAEEKRDSGSSKAKNAAKDALYSKRKLYRRFLIFKDLYSAPRPVIICEGKTDNVYLLHAIKSLAANYPILASITTAGKVQIHVRLLKALDSSIGTILHLGHGASDLDRLAKQYAEEILRFKADGMEQAVVLLMDNDDGADEMYKLAKDLTGKNVSRAEPYFHLVGNMYVVVTPLIGTNKQSEIEDSFADTLKNVVLDGKTLSTKNKFDTAKYFSKHVFAQHVRENASKIDFSGFSGILDRVAAAIQANQIRIAASAAPQAVPATV

SEQ ID NO: 1011 - protein, 588 aa, unidentified
  source 1..588: note = Acidobacteriia bacterium; note = Related to JAIQFA010000126.1
MSQLQALRAALSLHQVATLLQFQPKALSYILYKKPLPTRYTSFNMAKRDGGVRTINAPSPELRLLQHNLSDLLQNCVEEINEGKKWKDQLAHGFKRDCSIITNAVKHRKRRYVFNIDLNDFFGTINFGRVRGFFIKDANFMLHPKVATILAQIACHENVLPQGSPCSPVISNLIGHVLDIHLCKLAASNGCTYSRYADDITFSTSKPDFPESIARRVTGQAHTWEVGGGLQNIVAHTGFSINPKKTRMQYRGSRQVVTGLVVNKKVNIRTEYRRRARSLAHELFKTGTFQHVKTIPDANGVVTPTAVEGTLAQLHGIFGHIDAVDHHNFKIQSKADPREAKIVLRSKEKLYRRFLMFKDFYAASLPVLVCEGKTDNIYLLHAIRSLAAYYPKLATVAANKKITLNIRILKTVKTSTGRVLQLEGGASYLKAFIEQYVSEIHKFKAPGMQAAVVLIVDNDSGADEIYNTIRKLAKIKAPRSDAYVPVAGNLYVVPTPLKAGATKSAIEDCFADEIKNLKLGGKTFNANSDEDTVAYFGKHILSVYIRENASKVDFTGFAGLLDRITAAIEAHQAKQAAVGIASAPAAQP

SEQ ID NO: 1012 - protein, 595 aa, Pseudomonas sp.
  source 1..595: note = Related to NRAO01000002.1; note = Pseudomonas aeruginosa
MRNLELLKSIKTRSELAVLLGYKPKALTYLLFKMPPEQRYKSFPVPKRSGGQRTINAPCPELKALQKRLAGLLVNCSSELALAKKLPRISYGFNKGGSTLDNASVHRRRRYVLNVDLEDFFGSIHLGRVRGFFINNEDFKLLPDVATVIAQIACLDGKLPQGSPASPVISNIIGHILDVHLARLARRYGCSYSRYADDLTFSTNKPIFPQQIASLVDPLEHIWVAGGELEREITRCGFRVNHSKTRLEYNDSRQVVTGVVVNKKLNVPSEFKRGARAMADRLFKTGSFENVQVVELDGVKQFARTSGTINQLAGVFSYIYMVSHWNSKKLAIKPGTPLTSIERVHRDFLFYKDFYANQFPTILCEGKTDNTYLKCALKGLASSFPALIGRKPDGSPDYKIRFFRGSRLAARLLSLSGGTAQLKDFIAAYSSWCAKFKSQGGAKPVIIVIDNDAGATHIYNWYASVKRIPKPDGMLPYYYVGQNLYIVPTPKAAPADMSKIEDLFKADALGVILGGKRFNPNNDTENTTEYGKQYFADHVVKARQKTIDFSGFEPLLDTISKIILSHTTAVAAAAETSFAAAIEASTAVAPVAPPT

SEQ ID NO: 1013 - protein, 476 aa, Pseudomonas sp.
  source 1..476: note = Related to CP068986.1
MITNAINHRNKNLVLNIDLADFFGSIHFGRVRGFFLKNENFKLSPSVATVIAQIACHENALPQGSPCSPILSNMIAHILDIRLARLAAAEKSSYSRYADDITFSTNKKEFSESLVRCIDHVNHTWVAGTALENTINRAWFSINSKKTRLQYRDSRQIVTGLTVNSKVNVRAEYHRTAKAMTHKLFRTGSFEVLKANEHGIQEKTAGSLHQLNGILSFIYMINDYNRKLRAQNPLNPAFTPTPDRLKSIEKSHKRFIFYRDFYASPVPTIICEGKTDNIYLRAAIYSLSAKYPELVETNKDGSKKLKIKLFKYTEQIKHLMSLSGGTGEMTKFMTSYTKECAFFKAPIGLKPVIMLIDNDQGAIEIYKQIHKMKKLAKKPDGSDELHFIGRNLYVVPTPLNKGQNTMVEDLFEPKLLKTELNGKKFNPDDAKMTSNEYSKNHFAKFVVKAQQESIDFSGFEPILNTILKIVKQHGRL

SEQ ID NO: 1014 - protein, 590 aa, Pseudomonas sp.
  source 1..590: note = Related to NZ_CP065202.1; note = Pseudomonas fragi
MSELAKLKKIISLQDLSSMLGFKSSALSYLLYKKPKTELYRTFEIRKKTGGIRIISAPCPELKLLQSNLARLLQKCVNEIQEARININQNKIQKHRSLSHGFKPGFSILTNAKSHRKKRVVLNIDLEDFFGSIHFGRVRGFFLSNRDFNLSPKIATIIAQIVCHNNSLPQGSPCSPIVSNLIAHILDIRLSKLAFENKCSYSRYADDITFSTNQEKLPDSIARCTCEESHIWIAGKNLLRIIKDSWFSINSKKTRIQYRDSRQEVTGLVVNSKLNIKAEYHRTAKSMAHSLFQTGSFTILKRNESNELERCYGTINQITGIFSFIYWINKYNRELPIGVPPDDVPPPKIEDLKSIERTHRKLLYYKYFFANEIPTIVCEGKTDNAYLKAAIQSLAQNYPALVEVDKDNNKILKVKFFKYSKQVKYLLALTGGTGDLEKLISNHPKECSSFKARAGTKPVILVIDNDSGANGIYNRLHKFLKLSKKPDGSQEFYYYGNNLYIVPTPLAADGGQTMIENLFDPTLLQTVVNNKTFNPDEKASSSLYYGKSKFVENVVMPNRSTIDFGGFTKLLDTISKVVDNHALLVSQSKP

SEQ ID NO: 1015 - protein, 605 aa, Pseudomonas sp.
  source 1..605: note = Related to JAHUWE010000017.1
MSELIKLKKTNSLSDLALYLGYKPKSLSYILYKKPKEELYRSFEVPKKTGGSRTISAPCKELKLLQSKLLEKLQACINEIQSLKNLRKTLTQPFKTEKNTSLSHGFKPGFSIITNARQHRHKRHVLNIDLENFFGSIHFGRVRGFFIKNQDFNLHPKIATILAQIACHDNVLPQGSPCSPLISNLVAHVLDIRLAELAKKNDCTYSRYADDITFSTNEKKFPSSLAVCVCEEDHIWIAGKTLVDLVKKCWFSINHAKTRLQYKDSRQEVTGLIVNSKVNVRAEYHRTAKAMAHRLFHSGKYETLGFDKDGLSKKVLGSVNQLSGVFSFIYMINKYNRNLRTINPLEKFPNPQPKLKSIEETHRKLLFYKDFYANEVPTIMCEGKTDNVYLRTAIRSLSEKFPALIEKDKDGEKRLKLKIFNYTDQVKYLMHLTGGTGDMVKFTSNYPKECSFYKSKGGLKPVILVVDNDQGASDLYTRIQKFGKMPVKPDGSKPFYFYSNNLYIVPTPLTPDGKQTMIENLFDPELLKTELDGKTFNPDEKTATASNYSKNHFAEYVVKANQKTIDFSGFEPLLATISKIIQDHERLSALATLPLATASHKVAKA

SEQ ID NO: 1016 - protein, 561 aa, unidentified
  source 1..561: note = Related to CP028127.1; note = Xanthomonas vasicola
MSELNKLKACTTIGELALLLGFQAKTLGYIAWGLPSATKYSTFAIPKRSGGKRTIHAPSPQLKLAQGKLSILLQACEKEIEEELGVKHTVAHGFKLGRSILTNADVHRRQRYVLNFDLSDFFGTINFGRVRGFLINNRNFQLHPDVATLIAQITCHKDMLPQGSPTSPVISNLIGNILDVRLSKVARANGCAYTRYADDITISTSQTEFPKAIANQVDSTSGWTLAKDVEQAVAACGFRINHAKTRLLHHRSRQDVTGIVVNRHVNVNTDYRRAVRAMVNNLCSTGTYHRKKSIVAAEDTTTVSVEGSRPQLEGMLGFLLQVERYRRSDELPPPTLSSTELLLHRFLFFTTFASNDRPTILFEGKTDNIYISAAIRRLRESYPLLMAPGSKELLVKLLPHTKTRERIFNLTGGDNPLTSFIVSYRENYRRIKGPKGANPVIVIFDNDSGSNAVIAAIKKHYKLDMPDGDQYIRVYDNLYVLLTSKKGSGNHCIENYFSAATLAKTLSGKKLSLSNKKLKDDEYGKAWFAEKIIKPYYKDINFSNFSGLLDPICEIIQGHYP

SEQ ID NO: 1017 - protein, 561 aa, unidentified
  source 1..561: note = Related to NZ_CP064002.1; note = Xanthomonas translucens
MGELAKLKACTNTGELARLLDFQTKTLSYIAWGTPSAAKYSAFDIPKRSGGKRAIHAPSPQLKLVQGKLSKLLQACEKEIEEELGVKHPVAHGFKQGRSILTNADVHRRQRYVLNFDLTDFFGTINFGRVRGFLIGNRNFQLHRDVATIIAQIACHDDKLPQGAPTSPVISNLIGNILDIRLSKIARAQGCAYSRYADDITMSTSQPQFPHAIARQLLATPNWVVTKEIEEAVKACGFKINHAKTRLLHHRSRQDVTGIVVNRHVNVNGDYRRAIRAMVNRLCSTGTYHLEKTVLAAGQTMLASIEGSRPQLEGMLGFLLQVERYRRSDDLVPPILSATERLLHRFLFFTTFAANDRTAILFEGKTDNIYISSAIRKQRATYPALIAPGSNELLVKLLPHTKTRERIFNLTGGDSPLTNFIVGYRDNYRKIKGPKGSHPVIVIFDNDKGSNAVIGAIKKHYKLDMPDGDQYIHVYANLYVLLTSKKGSGDHCIEHYFSEATRAKKLSGKKFNLSNKKLKDDEYGKAWFAEKIVKPYYKDIDFSGFAGLLDPICGIIKSHHP

SEQ ID NO: 1018 - protein, 561 aa, unidentified
  source 1..561: note = Related to NZ_NSGT01000016.1; note = Xanthomonas sp.
MSELAKLRACTTIAEAAQLLGFQTKTLSFIAWGLSPAMKYSVFNIPKRSGGKRTIHAPSPQLKLAQEKLSRLLQACEKEIEDALGVKHTVSHGFKSGRSILTNAEVHKRRRYVLNFDLADFFGTINFGRVRGFLITNRNFQLHPDVATLIAQIACHEDKLPQGAPTSPVISNLIGNIMDIRLSKIARAHGCSYSRYADDITMSTSHPQFPGAIAHQIGTPFKWQISKELETAVGASGFKINHAKTRLLHARSRQDVTGIVVNKHVNVNTDYRRAVRAMVNNLCSTGTYYRENPVLGVDNTNMTLVEGSRPQLEGMLNFLLQVERYRRSDHLTPLELSATERLLHRFLFFTTFADNDKPTILFEGKTDNIYISSAIRRLRASYPLLMAPGSRDLLVKLLPHTRTRERIFSLTGGDSPLTNFIISYRENYRRIKAPKGTNPVIVIFDNDRGSNGIISAIKKHYKLDMQDGDQYIRVYDNLYILLTSKKGSEKHCIEHYFSEATRAKKLSGKKLSLSNKKLNDDEYGKAWFAEKIVKPYYKEIDFSGFAALLDPICEIIQSHSP

SEQ ID NO: 1019 - protein, 567 aa, unidentified
  source 1..567: note = Related to JAJA02000003.1; note = Lysobacter capsici
MSDLIALRACTTIAGVAKLLGFQAKTLAYIAWGAPSATKYSVFDIPKRSGGKRTIHAPAPQLKLAQGKLSNLLQACEKEIEDSLGVKHSVSHGFKRERSILTNAEVHRHQRYVLNLDLLDFFGTINFGRVRGFLINNRNFKLHPDVATLIAQLACHEDRLPQGSPASPVLSNLIGNILDIRLSKMARAHGCAYSRYADDITLSTSKPEFPTAIAHQVDAFKWQASEDLESAVGASGFKINHAKTRLLHHRSRQDVTGIVVNQHINLNSDYRRNVRAMVNKLCSTGSYQRDKTILAADNTTKVSVEGSYAQLQGMLGFMMQVERHRRSGGPLPSTLSATERLLHRFLFYTTFAGNDKPVILCEGKTDNIYISAAVKRLSASYPKLIEPESKNLLVKILPHTATQERIFNLTGGDNPLVNFIIAYRDNYRLIKAPKGANPVIVIFDNDNGSNAVIAAIKKHFKIEMPDDTQYIRAYANLYVLLTTKKGTGNHCIEHFFPSKTLKKTLSGKKLNLSNKKLKDDEYGKAWFAEKIVKPYYHDIDFTGFSGLLDPLSEIITHHANHKIDEKG

SEQ ID NO: 1020 - protein, 569 aa, unidentified
  source 1..569: note = Related to FOAX01000001.1; note = Pseudoxanthomonas sp.
MSNLSRLHACTSVVDLANLLGFQAKALGFLAWGLPPTARYSTFDIPKRSGGKRTINAPIPQLKLAQQKLAAILQSCEAEIELLLGVKRSVAHGFKPNHSILTNAAVHRRQRYILNFDLEDFFGTIHFGRVRGFLITNRYFKLHPDVATLIAQLCCHQNQLPQGAPTSPVLSNLIGKILDVRLSKLARIHGCAYTRYADDITMSTSAPEFPAALATECANSLTWQLSARVTSAIADSRFKLNPSKTRLQHRRSRQDVTGIVVNQTLNANSDFRRSTRAMVDKLCRTGCYQLVKPTLLAGDTVSEPREGTNAQLHGKIGFLLQVERFRRAGDPESPQLSATEKLLKRFLFYTTLANAERPVILFEGKTDEIYLRCAIKRLASAFPRLAAAATGEVLVNLFSHTPTRQRIFGLTGGDPPLTNFVNEYREHYRPIKGPKGTHPVIVLYDNDNGANSIFAAMDKIYKVKMADGLQFIRIYDNLYIVLSSAKCAPGTGHCIEHLFDKSVLTTTLSGKTLSLSNKPLKPTEYGKAWFAEKVIKTNYKSIDFSGFHPLLEAISTIVTTHKASSSPLP

SEQ ID NO: 1021 - protein, 562 aa, unidentified
  source 1..562: note = Related to JAIWPR010000054.1; note = Luteimonas sp.
MSKLLALHLCNSASDVARLIGFQPKAIGYLAWGTKARYTTFEIPKRSGGKRTINAPILHLKIAQRKLADLLQECESEIEEAIGVKQRVSHGFRRDHCILTNASVHRGKRYVLNLDLEDFFGTINFGRVRGYFITNKHFQLKADVATLLAQLACHDSKLPQGAPTSPVISNLIGNILDIRLLKLARAHGCSYTRYADDITISTSAPTFPVEIALEGPTNTWTLSKTLNDSVKSSGFAVNAKKTRLLHRRSRQDVTGIVVNKCLNVNSDYQRRVRVMVHHLRSTGKFYRKLSSLTAAGDTEVQSRDGTRAQLQGMLGFVMHVERFRRGDEPLPEKLTGIEKLYRRFLFYTQFANHEMPVLLFEGKTDTIYLGAAIRALAPAYPTLIAASALQVHMLRNTPRIERLFGLRGGGDQLFNFVGEYHEEYRHIQGPKGTRPVIVVVDNDAIGRNMVKKVEGMTKTTIPVGSQWFRVQDNLYVVLTSPFDPKGAMHCIEACFDPKFMATALGGKTLSKGSKGKKLDPAKEVSKAWFAEKIVKPNTKSISFAGFSSLLDCISDVITKHVP

SEQ ID NO: 1022 - protein, 563 aa, unidentified
  source 1..563: note = Related to CP018725.1; note = Xanthomonas vesicatoria
MSKLFALQQCSGASDVAHLIGFQPKALGYVAWGTKARYSAFDIAKRSGGKRTIHAPIPQLKLAQQNLAELLQECELEIEAALGVKKRLSHGFRRDHSILTNADIHCGKRYVLNFDLEDFFGTINFGRVRGYFTNNKHFRLKPDVATLIAQLACHESKLPQGAPTSPVITNLIGNILDMRLVKIARANGCAYSRYADDITFSTSAPEFPTAVASEIAPHAWTLSKTVEDSVKASRFSINASKTRMLYRRSRQDVTGIIVNKFVNVNSDYQKRLRVMVHHLRSSGIFHRKNSVLGASGNTSVQKEVGTRNQLQGMIGFALQVEAFRRYGAPPPPELTSTERLYKRFLFYTQFAAHDKPVLLFEGKTDVVYLKSAIKSLSASYPTLYTGSDILVHLLRHTPRMERLFGLSGGGHPLIAFIKNYHEEYRHITGPRGAKPVIIVVDNDQIGRNTINLIEKITKTVVAPGTQAVKVFDNLHVILTSPHDKDSELHCIEDCFDPAFIKAELDAKTIYNGKKIKKNNEFDPSIHISKSAFAETIVKAKAAAIDFAGFKPLLDHIAAVIAKY

SEQ ID NO: 1023 - protein, 645 aa, unidentified
  source 1..645: note = Related to CP011130.1; note = Lysobacter capsici
MIQIGLANAHRKLALAALTSIASQAALCLLLGVAGRFGCRRIAASEAIARWICPVTLSATRRSLGVRESSCNPSFPASHGDGMSKLLALQICNSASDLAHLIGFQPKALGYVAWGTKARYSTFNIPKRSGGKRTINAPIPQLKLAQQKLSSLLQECEREIEETLNVRHRLSHGFRKQHSILTNAAVHRGQRCVLNFDLQDFFDTINFGRVRGYFMTNKHFRLRPDVATLIAQIACHDSKLPQGAPTSPVISNLVGNILDMRLVKIARANGCAYSRYADDITLSTSAPEFPEAIAIEGPTHSWTLSKAVNDAVKASGFRVNAAKTRLQYRRSRQDVTGIVVNKCVNVNADYRRRVRVMVHHLRSSGKFYRKSSGLSAAGDTEVQQHEGTIAHLQGMIGFVLQVERFRRGEDPAPAELSGIEKLYRRFLFYTQFANHEKPVLMFEGKTDVIYLASAIKSLAAVYPTLIVKPPELLIHLLRYTPRIERLFGLSGGGHQLITFIKNYHDEYRYIQGPRGSKPVIAVVDNDKIGRDTINLVEKITKTPMPTGAQSVRVYDNLYVVLTSPHDKAGKHHCIEDCFDPEFVKSELAGKKISKGTKGVKLDPVTEVSKAWFAEKITKPSFKPIDFSGFQPLLNEIAAIIAKHAP

SEQ ID NO: 1024 - protein, 589 aa, unidentified
  source 1..589: note = Related to JACVAG010000008.1; note = Pseudoxanthomonas sp.
MSKLAALKACSSIGDLALLLGFKAQTLGYIARGLRDPAKYTSFDIPKRSGGKRTIHAPVPKLKLVQRKLCNLLEECQKEIESTLGVEKRLAHGFKKHHSIFTNADVHRRQKYVLNFDLEDFFGTINFGRVRGFFIANRHFKLNSDVAMLIAQLVCCNAKLPQGSPSSPIISNLIGNILDIRLAKLARANGCSYSRYADDITISTSLPDFPSAIASLVTGSHVWTLSSDVMNTISACGFKLNPKKTRLQYHHSRQDVTGIVVNRHVNVSSDYRRKLRAMVDRLRSTGSFTYSATELDTAASTKVSVKTGTRNQLQGMLSFALQAERYRQASTSTPAPECLTGNEKLLRRFLFYTTFASHERPLVISEGKTDGIYLASAIRSLAATFPELVAPKTGVPAVRFLRLTRSMERLFGLSGGDGPLKEFVHQYAEEYRHIKGPKGSMPVIAIFDNDTGAKGVLGLLKGFYKMPMPAGAQSVHVHGNLYVVLTSPHITGAPSHCIEDCFDAATLAITLSGKTLSLANKTLGPNEYGKAWFAEKVIKPNAKTIDFAGFNGLLGVISQIVKGHTPPPVAPPAPSSVALPLVTPKPSIP

SEQ ID NO: 1025 - protein, 580 aa, unidentified
  source 1..580: note = Related to JAHCAU010000005.1; note = Lysobacter sp.
MSALTNIKACNTFNDFARLLGFKANSLAYLLWGMHADTKYTTFDIPKRSGGKRTICAPNPKLKLAQSRLSELLQQCEKEVEVIHAVKKSLSHGFKKEHSILTNAEGHCGRRYVLNIDLEDFFGTIHFGRVRGFFIKNRQFALNPTIAMTIAQIACHENKLPQGSPCSPVISNLVANILDIRLAKLSKIHGCSYTRYADDITFSTSMPDFPESIAFKQIDSNHWVLGKPLVDAIKACKFRINLSKTRLQYRRSRQDVTGIVVNKQLNVRSEYRKALRAMVYKLRETGSFSRNYSQLGANGDTQVIAKDGSRAQLFGMLSYVIQVERWRNRRIDSPPERLSANEWLMREFLFYTMFANADRPCIVCEGKTDSIYIREAIKNLGASFPYLAKSNAGNNEVIVSLVRNTDLLARLFGLSGGETRLKDFVKNYRDEYRKIKGPKGSHPVIILFDNDSGAKDVLNLLANLFKVIPVVGRQYFHVHDNLYVMLTSPVGAGPHYIEKCFDAATLAMTLGGKTFNPANQTLGPNEYGKGFFAEKVIAPNAQSIDFSGFSTMLAEFSSIIVSHAAPSPSLPVPPGMAPSP

SEQ ID NO: 1026 - protein, 713 aa, unidentified
  source 1..713: note = Related to NZ_CP018756.1; note = Stenotrophomonas maltophilia
MSALKRLQAATTLSDVAKILGFKPRALAYLIRVMPAGSRYTEFEIPKRMGGFRRICAPNKKLALVQTRLADLLSDCAEEIAAQRSVKKYVAHGFRRGHSILTNADVHRGRKYVLNVDLLNFFDAIHFGRIRGFFHTSQDFQLELEVATVIAQIACHEAKLPQGSPCSPVISNLIANILDMRLAPLAQHYGCSYTRYADDLSFSTNRREFPEELAAQVKGQEPIWEVGPALLAAIKTAGFSINPKKTRVQYDCSRQDVTGIIVNKFLNTPIEYRRTLRSMVHHLTGTGKFYLKDVDPATGKKREGSRAKLQGMLGFAYQVEKWRSRRSPVVSGAHTAMEKLLQRFLYYTEFASPSIPAIVFEGKTDSLYLREAIRRTPSAMPMLATGVGGGYRLRVKLHRESVIMRKFFNLSSGGDPLKNFIRDFSKLFPRIVGPKGEMPVIVLMDNDSGFSSTKSMLKNCYGISVMPGDQKIHVFENLYILLTSPYAVGASHCIEDCFPSSVLATKLGSKSFSKSNDFDTSTHYGKEWFAEKVVKPGSKGIDFTGFNGIIDGVKAILLEHAVSFKAKALLPMAAPSVGGASIAAPSAARRLIPKVSKAPKTLAASTPSVASKSSTAVLDPTGPEAPKVPKAPNIPKAPKAPKAPKAPKAPKAPKAPKAPKAPKAPKAPTGPEAPKVPKAPKIPKAPKAPKAPKAPKAPKAPKAPKAPKAPSPK

SEQ ID NO: 1027 - protein, 572 aa, unidentified
  source 1..572: note = Related to SEBG01000120.1; note = Cytophagaceae bacterium
TTTIGFKPKALSFITRVTPPAARYIEFDIPKRSGGTRRICSPNKQLSLLQSRLAELLNECEVEIAQQRSIKRHVAHGFRKGYSILTNADVHRGRRYVLNIDLTDFFGTIHFGRVKGFFENSLDFQLKAEPALVLAQIACHEGKLPQGSPCSPVISNLIANILDMRLVALSKRHGCSYTRYADDLSFSTSKLIFSDALATPSEANKSIWQAGPDLIAAVHSAGFKINPLKTRVQLSRSRQDVTGVVVNRQLNTPVEYRRTLRSMVHRLCSTGEYLLQETDPATGKQKVGTPAQLQGMLGFAYQVERWRSRNDEPASGAQTAMERLLKRFLYYKEFASPMLTAIVFEGKTDSVYLREAIRRSGTAFPMLSKGAGTTFELKVKLHRESKIMKKLFGLTSGGDPLKNFIKCYRWEFSRIDGPKGQNPVIVLMDNDDGFTGTKAMLFNVYKISISSGQQFIHVWENLYILLSSPFGGAKHCIEDCFTASVLAVKLGIKEFSKTNDFDPNIYYGKEWLAEKVVKPNSATIDFSGFGNLLSALQDVILHHSATMLSARAANTGVPSLPMPLPIPGGPAP

SEQ ID NO: 1028 - protein, 585 aa, unidentified
  source 1..585: note = Related to NZ_WVHR01000032.1; note = Paraburkholderia madseniana
MKKPTHIAQLRSLAALHGLATLLGYEAKGLAYVVYGIKDKDKYVDFPIPKRSGGTRIISAPVKSLKLLQSRLSTLLAACAEEIEVERGGKNKFFHGFRKNHSILTNATVHRGKRYVFNVDLSDFFGSVHFGRLTGFFTKNRHFELEPVVARILAQIACHNTVLPQGSPCSPVISNLIAHILDVRMAQLAARNDCYYSRYADDLTFSTNRNEFPSAIATRVGDSNEWVAGKSLLKIVKDSRFELNHSKTRMQFHRFRQDVTGVVVNKKLNVPSEYVRDVRAMVNSFVKTEKFTLRKKYRNDTGAWVLETVQGTKEQLRGMLSFIDNVRVFPQKKLAMEKKDKREQRIPRVEFKDMDGASRMYRRYLQYTQFFNPELPFVICEGKTDNVYIKCALRQLAGTYPQLVSKTASANKLLLNFFNYTKVADRILHLGGGTGDFQTFIGNYGSEFKGFKSEKKRNPVILLIDNDEGTAKIFSSIKTAIKSKSPVDGSEPFYHIADNFYVVAIPRKGGKSTTIEDFFDPALLKTKLGTKIFSGKDGFDPATEYGKHYFAEYIVKKGQKTIDFSGFHPILERLVAVLMAHAVKP

SEQ ID NO: 1029 - protein, 585 aa, unidentified
  source 1..585: note = Related to NZ_QLTK01000030.1; note = Paraburkholderia bryophila
MKNPTHIAQLRAQTSLHGLARLLGYEPKGLAYVVYGIGDAYKYVDFPIPKRSGGTRIISAPVKSLKLLQARVSTLLGACAEEIEVERGGKNRFSHGFRKNHSILTNATVHRGKRYVFNVDLHNFFGTVHFGRVSGFFAKNRHFKLDPVVARILAQIACHNKVLPQGSPCSPAISNLIAHILDVRMAQLAARHDCYYSRYADDLTFSTNRKEFPESIATRVSDSNEWIAGKSLLKIIKDSRFELNHSKTRMQFHRFRQDVTGVVVNKKLNVPSEYVRDVRAMVNSFVKTGQFTLRKSYRNDAGAWVVEEVAGNKVQLRGMLSFIDSVRVFPQKKLAMEKKDKREQRIPRVELKDMDGASRTYRRYLQYTQFFNPELPFVICEGKTDNVYIKCALRQLADTYPQLVSKTASENKLLLNFFNYTKVADRILHLGGGTGDFQTFIGNYGSEFKGFKSKEKRNPVILLIDNDEGTAKIFSSVKTATKRKSPVDGSEPFYHIADNFYVVAIPRLSGKSTTIEDFFDPTLLKTKLGTKVFSGKDGFDSATEYGKHYFAEYIVKKGQKTIDFSGFHPILERLVAVLTAHAAKP

SEQ ID NO: 1030 - protein, 594 aa, unidentified
  source 1..594: note = Related to JAAGPR010000055.1; note = Paraburkholderia sp.
MSADILPLTMKTPTHIARLRSISSLHSLARLLGYEPKGLAYVVYGIDDKYKYTDFQIPKRRGGVRTISAPIEKLKLLQRRVATLLDACVEEIDAERGVRNTLSHGFRKKHSILTNAAPHRNRRYVFNVDLHNFFGTVDFGRVVGYLKKNKHFQLNPTVARMLAQIACHQKVLPQGSPCSPAIANLIAHILDIRLGRLAARNDCHYSRYADDLTFSTNRPVFPSEIARRVGDTNEWVAGKILLKIIKESRFEINPEKTRMQFARFRQDVTGVIVNRTLNVRREYVKNARAMVDSYVTKGVFYSEKQYRDEKGAWTNELVDGTVGQLRGILSYIDSVRLFEQQKHASAKKTKRDYRVPRVEIKDMDSAARTFRRFLLHTQFFNPEKPLIICEGKTDKVYIQCALRQLVDAHPQLATRTKSGVDIHVSFFNFTKVADRILRLGGGTGDFQDLIAKYGTEFKGFYAKGQRQPVILLVDNDDGTKKIFSTVKTATGSKTAIDGSASFYHIADNFYVVAVPQLGKKDTTIENFFDPVVLTERLGTKVFSGKDQFDPATQYGKHHFAEYVVKKKQNTINFAGFEPILARLDAVLKEHAAKP

SEQ ID NO: 1031 - protein, 585 aa, unidentified
  source 1..585: note = Related to NZ_BBJI01000006.1; note = Paraburkholderia kururiensis
MNKITHIARLRPLSSLHGLAHLLGYTPKGLASIVYGTPDSSKYNDFRIRKRSGGTRLISEPNDRLKLLQRRLANLLSECIDDIDSERRVTNSFAHGFRKKHSILTNASRHRRKRYVFNVDLHDFFGTVDFGRISGYLKKNKHFLLDERVARMLAQIACHNKVLPQGSPCSPVMANLIAHILDVRLARLAALHDCYYSRYADDLTFSTNRADFPSSIAKRVEDSNLWVAGKALEKIVSESRFQLNPSKTRMQLNRFRQDVTGIVVNSGINVRSEYQKTVRAMVHSLVTKGVFHIQKLHRDDKGAWVREKKEGTRAQLRGMLTFIDNVRLFEKTKRLPPDRAQDQRGQKGDPAEMDSATRTFRRFLMFTQFFHPEKPLILCEGKTDKVYIQCALRRLSTAYPLLSSKSATKTNIHVSFFNYTKIASRVLSLGGGTGDLNGLVATYGSEFAGFKSTTKRHPVILLVDNDEGTKGIFSAVKTRTKSTSPITGNEPYYHVADNLYVVSLPLVNSNMVTIENFFPKHVRDTKLNGKVFSGKNRFDAKNQYGKHVFAEQVIKKIQNAGDFSGFHDILMRIQAVLVVHSAKKP

SEQ ID NO: 1032 - protein, 583 aa, unidentified
  source 1..583: note = Related to NZ_JZUR01000039.1; note = Burkholderia vietnamiensis
MTTTHIQKLQATAGLYSLSDLLGYSAKGFAYILHGISDDHKYIQFDIAKRSGGKRIISAPIPELKILQRRLAELLEACVVDIDNSRKLKNTFSHGFRPKHSIMTNASFHRKRRWVFNVDLQDFFGTINFGRICGFFAKNKYFQLDPTVARIIAQIACHEKKLPQGSPCSPVIANLIAHILDVKLARLASSYGCFYTRYADDLTFSTNSEIFPELIASRIDGSNEWTAGKKLLRIIKDCAFEINPAKTRMQFREFRQDVTGLVVNSKINVRTDYVKSARAMVNSLVESGEFYIKRRFRDENGAFRDETEKGEPDVLRGMLTFIDSVRQFDALKNVRDIDKADHRPTRPLAKDLSSADRTFRRFLLYTQFHNPQKPLIICEGKTDKVYIQCALKQRKDKFPDLSKKEDETDGKLSFFNYSKVADRILHLGGGTGDTDAFIARYGKEFKGFFENKKQHPVIVLADNDSGAKSTFGVVKKAGNIPSVDGSAPYYYICRNLYIIFIPKIDGKDTTIEDLFDKSVREAELNGKKFSGSDKFDAKTEYGKHLFAEYVIKPKQKEIDFSKFDSILKSIVDVLADFEKRQPT

SEQ ID NO: 1033 - protein, 584 aa, unidentified
  source 1..584: note = Related to NZ_LT977071.1; note = Cupriavidus taiwanensis
MTTRLASLKAANSLHTLAQVLGYRAKGLAYVVHGIPDSIKYTDFQIKKRSGGLRTISAPIPELKKLQKHLAHLLEDCAAEINSTRGIKKSLSHGFRRKHSIMTNAAAHRGRRYVFNIDLQDFFGTINFGRVWRFFEKHREFQLNSAVARTIAQIACHNKVLPQGSPCSPAISNLIGHVLDIRMAQFAAKVGCHYSRYADDLTFSTNKKEFPALIATRMGDTTQWSPGTKLIREIRRCGFELNFAKTRMQFKDFRQDVTGVIVNSKVNVRTEYVKNVRAMVHALVTRGEFQIRKVFRDDSGAWTEAVAKGSEAQLRGMLSFIDSVRHFEECRDTPKNNGVPDYKLPRSSLDDMDGPARIYRRFLVFTQFFRPVQPLIFCEGKTDNVYIRCALRQLFAKYPALAAKKKSGEIEFKIDFFSHSKVADRILHLGGGTGDMCDFIAKYGSEFKGFKHDGKRNPVIILIDNDSGANRIYSAIRSAIKSKDTIDGSKPYYFVRDNLYIVPVPMLGGNPTAIEDFFEKKVLDTVLNGKKFSRADKFDAATQYGKHLFAEHVVKKGQKSIDFSNFAAILDRINDVLTIHAAKP

SEQ ID NO: 1034 - protein, 581 aa, unidentified
  source 1..581: note = Proteobacteria bacterium; note = Related to JAFEDJ010000026.1
MTRLKKLKAASSLHAFADVLGYKAKGLAYIIHGIDDSKKYKDFEIKKRSGGLRKISAPIPELKRLQKSVAHLLEDCVSEINSHRKTKGTLCHGFRPKHSIMTNAAIHRKKRYIFNIDLKDFFGTIHFGRVWRFFEKNRDFALDSSLARTIAQIACHNRELPQGSPCSPSISNLIGHILDIRMAKLAAQAGCQYSRYADDLTFSTNRKNFPPEIAQRVGDTNLWVPGKQLANEIKRCRFEINPAKTRMQFKDFRQDVTGIVVNSKLNIRAEYAKNVRAMVHSLVTRGEFTVRKTFRDEAGAWIEEVEAGTEARLRGMLSFIDSVRFFELHRQTIKKSVASDSRLSRRPVREMDRHERVYRQFLLFSTIFRPLQPLVICEGKTDNVYLRCALQKLSGKYPKLVNVSGAKITLQLNFFNYSNTTDRILHLGGGTGDLAEFIGNYGAAFKGFKYSEKRRPVIVVVDNDSGAQPIFAAIKKATFSKSAIDGSLPYYHIRDNLYVVPVPKQKGKETAIEDFFEKAVLDTKLGGKEFSRQDKFDPATQYGKHLFSEHVVKKNKGSINFDGFEPVLDRIVQVLDAHSVK

SEQ ID NO: 1035 - protein, 601 aa, unidentified
  source 1..601: note = Related to CP062062.1; note = Janthinobacterium sp.
MYRSLCQGVSVVPFQTIYLFENMSRLASLKSATSLHDLGHILGYTAKGLAYILHGVPDTAKYSEFTIKKRSGGSRVISAPIPELKRLQQHLASLLNDCMVESDANRGVVNTLSHGFRPKHSIMTNAAMHRKHRYVFNLDLKDFFDTINFGRVWKFFEKNREFGLNTAMARTIAQIACHKGTLPQGSPSSPVISNLIAHILDIAMVQLAAKAKCHYSRYADDLTFSTNESEFPGLIATRIGTTTEWAIAPKVVREIVRCGFQVNPLKTRMQYKTRRQDVTGIVVNTKVNIRSEYSRDVRAKVSSLITKDTFSINKTFRNDTGAWTTETKDGTDAQLRGMLSFIDSVRLFERRRNEQIPPETHIPRIELKEMDGNLRVYRAFLLFTQFYRPVRPLIICEGKTDNVYVRCALHSLAAAHPMLAKTTGKISECLIDFFSYSKTSDRVLHLAGGTGDLGNFIANYANEFSRFKKIDSRNPVIILIDNDSGSSKIFSVIKKVTESTVNVDGSLKFYPIKDNLYVVPIPKIGGKETTIEHFFTKKILGTKLNGKVFSGTDKFDPATQYGKHLFAEYVIKKNKDDINFSKFSIILKNIEAALKFHYGMP

SEQ ID NO: 1036 - protein, 606 aa, unidentified
  source 1..606: note = Related to NZ_JAJJOZ010000002.1; note = Paracandidimonas sp.
MAAFKITPPKTTLELFQTATSRAALASLLNIEPKDLTYLLYVLKDEDKYSVFSVPKRGGGERQISSPISQIKSLQERLADSLERCINDIELLTGRSNSASHGFRPEKSILTNASVHRNKRFVFNLDLEDFFPTITGRRIRGFLINDKNFKFHKDVATTIAHIACLDGKLPQGSPCSPVISNLIAGILDFHLARLAKACGCRYTRYADDITFSTNKKDFPKEIAFCDVEHTHIWKVGKQLRGLIAKSGFVINEKKTRMQYYTSRQQVTGLVVNKKINVTTEYRKLVRAYVFSLINHGKFTLKTTTKDASGQVTITTATGTRAQLHGMLGFIHSVDNVYRAEVKLHPYNYLGHQQSTKESVGNQAIYRRFLLYTRFYDNDTPLIVCEGKTDGVYISNAVHQSKAHFPKLLKKNDDGNDVLSFQLFKYARKHKKKDHVYLPNFSTASILGVGSGGGGNLGNLIRTYHKELEKFKTPVGASPVVFIVDNDDGGRAVYKVIKNILHITVSGHERFVHLFANLYIVPVPFKGSKDTSIEDLFSEVDISKGLNSRSFDFSKKIDARAAVGKADFAYEFVAKQAERMDWGGFYPLLQNICDALADYAKYRKENV

SEQ ID NO: 1037 - protein, 601 aa, unidentified
  source 1..601: note = Related to NZ_JACJUU010000033.1; note = Pusillimonas minor
MAAFKLPAPKSALERFQYASSRAALASLLSIEPKDLTYLLYVLKNSEKYSLFSIPRKGGGLREINAPIPKIKSLQRRLAEGLELCVADIARLTGRSNSASHGFCPGKSILSNASVHRNKRYVFNLDLKDFFPTITGGRIRGFLINDKNFKLHKDVATTIAHIACLEGKLPQGSPCSPVISNLIAGILDFHLARLAKTNGCRYTRYADDITFSTNKKDFPKSIAFCEKDAHRWEIGKQLQGLIIKSGFVVNEKKTRMQYKTSRQQVTGLVVNTKVNVTREYRKLVRAYVFSLVNHGRYTIKTVVKDDKGRLVEETEEGRRSQLHGMLGFIHSVDNVYQSDVRDHPYNYPGQQRSNKNPTGNLAIYRKFLLYTLFYDNKMPLIVCEGKTDGVYISNAVHQSKAIFPQLLTKNDDGKDVLSFQLFKYTRQHKKKKSVYMPNFSTASILGASSGGGGNLGNLIRAYHKELNSFKAPIGDHPVIFIVDNDDGGRTVYKIIKETLKIAMSGHESFVRLFANLYIVPVPFNGNAQRSIEDLFTETDISKGLNGKRFDFSNNANSSASVGKAEFAYEFVAKQAETLDWTGFHSLLNNICAVLVDYETSA

SEQ ID NO: 1038 - protein, 596 aa, unidentified
  source 1..596: note = Related to JAHJHQ010000474.1; note = Gammaproteobacteria bacterium
MELLQAAKSRPGLAKLLQIEHSQLTYILYKKSDAEKYKTFEIPKRGGGLRTISAPIAELKLLQRRLGDVLYMCAVNVENSTGRINYSAHGFKPDRSILTNAAVHRNKRFVFNVDLKDFFPTISAKRIRGYLINDKYYRVVPEVATTIAHIASRDGILAQGAPSSPVISNLIAGILDFHLTRLAKSCGCRYTRYADDITFSTNKKEFPKEIARLVAGAEHNWEPGGALVRLIKKSGFEINGDKTRMQYKNSRQQVTGLVVNKKLNVTQEYRKLARAYVFSLITHGKYTVTKFTKNTLGNIEKEVIEGTFAQLHGMLGFIHSVDNVFRADRKNNPYNYVGYGGEGKNGDQKLQIFRRFLYYTNFYCNSAPLIVCEGKTDNAYISNAVHQSKALFPQLLKKGDEDNDVLSFFLMKYDRKHKKRRHIYLPNFSTVSILGVGSGGVDNLKNLLIGYRAEIDRFRAKPGPHPVIFIVDNDHAGKKVFGTAVELSSPKVSSITGDEKFINIFANIYIVPIPKVKKPETSIEDLFSAKDIPAAINGKPLKFSNDNDKSFAGKADFAFEHVVKNADAIDWGGFYPLLNNICDAIEHRKAKLEGAI

SEQ ID NO: 1039 - protein, 612 aa, unidentified
  source 1..612: note = Related to NZ_MCAS01000001.1; note = Paraburkholderia fungorum
MLVPEITTLERFQAAHSREALANLLDIKHQHLTYLLYVKKDAGKYATFSIPKRSGGTREIRAPIKELKSLQRRLANRLQNCISDVSRITGRENQSSHGFCPNKSILTNASAHRNKRYVLNLDLQDFFPTITGQRIRGFLINDRNFKFHRDVATTIAHIACVDGVLPQGSPCSPVISNLIAGILDSHLSRLAQKNGCHYTRYADDITFSTNKKEFPSQIGFLDKSTSDKWVLGKELRRLVALCGFVINDGKTRMQCKNSRQQVTGLVVNEKVNVTSEYRHLVRAYVFSLVNRGSYKIRSTLKGGDGNEIVSEKDGTPEQLHGMLGFIHSVDSVFRTELKNNPHNHLPPYQLSGKTTPDPLPLRNLTIYRKFLLYTRFYRTTTPLVVCEGKTDIVYISSAVHQSKAVFPQLIKKNDAGKDILAFQFFKYDRKHKKKEHVYMPNFSTAAILGVASGGGPNLSNLIRTYHKESKKFQSPCGDKPVVFVVDNDSGATEVLKAIKDCSGKACDRDDPFIHVFGNLYVVLVPRNGLDKMDTEGLFSPLDLAKGHNGKTFDFSKDADSSTSVGKAPFAFEFVAPKAKELDWTGFHPLLANIIAAFDHYKGTMAAIVPSPP

SEQ ID NO: 1040 - protein, 601 aa, unidentified
  source 1..601: note = Related to FSRU01000001.1; note = Paraburkholderia phenazinium
MSSEKTILQLFQAATSRSDVAALLDIKVKDLTYLLYVMKAEDKYKTFDIPKRSGGMRKINAPIKKVKSLQRKLADRLEQCLTLIEGTTGLTNPSSHGFRRGKSILTNAATHRNRRFVFNVDLQDFFPSITGRRIRGLLIKDRKFGFHKDVATTIAHIACHNGELPQGGPCSPVISNMIASVLDFHLSRLARDNGCAYTRYADDITFSTNKKTFPSAIAVCDEASGHNWKLGNQLAGLIKKSGFSVNEKKTRMQYRTSRQQVTGLVVNKRVNVTNEYKRLVRAYLFSLINHNKFTIKKVEPSELGDKVSLIDGTREQLHGMLGFVHSVDSVFRTNVKQHPQNYPGMQTDIKKDTKKPTGTLELYRRFLFFTRFFSNTLPLIVCEGKTDIVYLSNAVHQSKLAFPKLITKNSGGADVLNFRFLKYARKHKRKKNVYLPNFSTVQILGAGSGGGPNLGNLILNYQSEFPKFRAPKGKYPVIFVVDNDSGGKDVFNKVKNIVKITGHESFVRLFGNLYIVPLPLNGAAEKSIEDLFSPADIAKGMDGKPFDFTKDSSDATSIGKAGFAYDFVAKQAEDLEWSGFHPLLQNICAALDDYAALAATP

SEQ ID NO: 1041 - protein, 597 aa, unidentified
  source 1..597: note = Related to NZ_LOVK01000019.1; note = Burkholderia ubonensis
MSSEKSILQLFQAASSRSDVAALLDIKLKDLTYLLYVMKDHDKYKTFDIAKRSGGKRQISAPIKNVKSLQRKLADRLEQCLTLIESAAGRKNPSSHGFRRGKSILTNAATHRNRRYVFNVDLEDFFPSITGQRIRGLLIKDKKFGFHKDVATTIAHIACHNGKLPQGSPCSPVISNMVAAILDFHLSRLARDNGCVYTRYADDITFSTNQKEFPIAIAVRKESNGHVWEASNQLQGLIKKSGFSINVGKTRMQYKTSRQQVTGLVVNKKVNVTTEYRRLVRAYVFSLINRNGFTVKKSRRTELGDEIVSVDGTREQLHGMLSFVHSVDSVFRTNVKQHPQNYPGMQADAKKPTGTLDLYRRFLFFTRFFSNTLPLIVCEGKTDNVYLSNAVHQSKVEFPRLITKGNNGPDVLAFHFLKYARKHKRKKHIYLPNFSTVQILGAGSGGGPNLGGLILNYHAEYTKFRAPKGKFPVIFIVDNDSGGKAVFNKVKHIAKVSGHEPFVRLFGNLYIVPVPLVGAAEKSIEELFAPADLAKGMDGRSFDFSKDSSDATSIGKAGFAYDFVAKQAKDLDWSGFHPLLQNICAALNDYDALSATL

SEQ ID NO: 1042 - protein, 601 aa, unidentified
  source 1..601: note = Related to NZ_CABPSB010000021.1; note = Pandoraea anhela
MFPKSMLERFKVAKSRETLAMLLDIKHKDLTYLLYVKKDVEKYSVFSMAKKNGGSRDICAPIPELKSLQRKLATALERCIADVETITKKNNKASHGFRPGKSILTNAAVHRNRRYVFNVDLQDFFSSITGKRIRGFLIKDRNFAFDASVATAIAHIACREGKLPQGSPCSPVISNMIAGVLDVHLAKLAQMHGCTYTRYADDLTFSTNKEDFPVEIAFRNDSTGHTWRVGAELNRLILQSGFSINETKTRMQYRDSRQQVTGLVVNKKVNVSTEYRYLVRAYVASLVKNGTFTVKRQAVGVDGKPQTLEEEGVTAKLHGMLGFIHSVDSVFRTDVKKHPYNYPGQQANEKKPTGNLAIYRRFLIYTRFYANTVPLIVCEGKTDGVYISNAVHQTKNIFPSLVRKDGEGKDVLSFQLLKYARKHKKRKTVHLPNYSTITILGGGSGGGANLGNLIRAYHSELSKFKAPRGKQPVIFIVDNDSGGKTVFKVVKDTLKMTIIGTESFVHLFANLYVVPVPLGEDKERSIEGLFAPIDLAKGLNGKPFDFSSDSSSGTSVGKADFAYEFVAKHANELDWAGFHPLLENIVGAMDDYAERVRAADL

SEQ ID NO: 1043 - protein, 581 aa, unidentified
  source 1..581: note = Related to NZ_CABPSK010000001.1; note = Pandoraea pneumonica
MLLDIKHQDLTYLLYVKKDPERYNVFSIPKSSGGSRDICAPTSELKSLQRKLAAALEQCLVDIAALTKRTNKASHGFRPGKSILTNAAAHRNRRYVFNLDLKDFFPSISGQRIRGFLINDRYFAFDAKVATTIAHIACRDGVLPQGSPCSPVISNMIAGILDAHLSKLAQMHGCTYTRYADDLTFSTNKEVFPAAIAYRDDSKEHSWHVGAELQRLILRSGFSINEKKTRMQYRDSRQQVTGLVVNKKVNVSTEYRYLVRAYVASLVKNGKYTVKRQVPDVHGKLQTFEEEGTPAKLHGMLGFIHSVDSVFRTDIKRHPYNYPGQQANEKKPTGNLAIYRRFLIYTRFYANTVPLIVCEGKTDGVYISNAVHQSKNLFPSLVKKNVEKEDVLSFQLLKYARKHKKKKMVHLPNYSTITILGGGSGGGANLGNLIRAYHGELAKFKSPGGKQPVIFIVDNDSGGKTVFKVVKDTLKLTITGDESFVHLFANLYIVPVPLGNAKERSIEDLFSQVDIAKGLNGKPFDFSSESSSTTSVGKADFAYEFVAKQAKELDWAGFHPLLANIVSAMDDYAARLAAAAA

SEQ ID NO: 1044 - protein, 581 aa, unidentified
  source 1..581: note = Related to NZ_LT984806.1; note = Cupriavidus sp.
MLLDIKHQDLTYLLYVKKDAEKYNVFSIPKKSGGSRDIHAPIPELKSLQRKLATALEECIADIEKLTNRKNNASHGFRPGKSILTNASAHRNKRYVFNIDLKDFFPSITGKRIRGFLINDRNFGFDASVATTIAHIACRDGRLPQGSPCSPVISNMIAGILDAHLSKLAKAHGCIYTRYADDITFSTNKEEFPTAIAYCDDANEHCWRVGSELYRLVLRCGFSVNEKKTRMQYRDSRQQVTGLIVNKKINVSTEYRYLVRAYVAALVKNGKYTIKRQVADATGKLETVTEDGTPAQLHGMLGFIHSVDSVFRTDVKKHPYNYPGQQVSDKKPTGNLAIYRRFLIYTRFYANTLPLIVCEGKTDGVYISNAVHQSKTIFPSLVKKDGEGKDVLSFQLLKYARKHKKKKMVHLPNYSTITILGGGSGGGANLGNLIRAYHGELTRFKAPRGEQPVIFIVDNDSGGRTVFRVVKEVAKINITGEERFIHLFSNLYIVPIPLGSAKERSIESLFSDADIAKGLNGKPFDFSADSSSATSAGKADFAYEFVAKHAKDIDWTGFHPLLENIVGAMNDYSARVAAAAL

SEQ ID NO: 1045 - protein, 639 aa, unidentified
  source 1..639: note = Related to WSNR01000001.1; note = Ralstonia solanacearum
MAFGNNVRTYAASGIIRRTPCVARGQFAMECLRGPHSMLLPKNKLQWFQAAKSRAELAILLDIKHKDLTYLLYVKKDPEKYKIFSIPKKSGGSRDIHAPIPELKSLQRKLATALEECIADVEELTNEKNKASHGFCPGKSILTNASVHRNKRYVFNIDLEDFFPSITGQRVRGFFIKDKNFAFDPSVATAIAHIACRDGKLPQGSPCSPVISNLIAGILDVHLSKLAKVHGCIYTRYADDITFSTNKENFPATIAYRDEANEHCWKVGEELRRLILKCRFSINEKKTRMQYRSSRQQVTGLVVNKRVNVTSEYRYLVRAYVAALVKNGKYTIKRQIVDATGKQETISTDGTPAQLHGMLGFIHSVDSVFRTDVRKHPYNYPGQQANDKKPTGNLAIYRRFLIYTRFYANALPLIVCEGKTDGVYISNAVHQTKSIFPSLVKKDKDGKDVLSFQLLKYARKHKKKDAVYLPNYSTITILGGGSGGGANLGNLIRAYHGELGKFKAPRGKQPVIFIVDNDSGGKKVFSVIKEVLKKNLTGEEPFVRLFSNLYIVPIPLGGNKERSIEQLFSDVDIAKGLNGKSFDFSADSSSTTSVGKVDFAYEFVAKQAKNIDWKGFHPLLQNIVAAIDDYAAHVVAEGL

SEQ ID NO: 1046 - protein, 612 aa, unidentified
  source 1..612: note = Related to CP028290.1; note = Acidovorax cattleyae
MDTAYLYVTIGSRKSVCGATFTDGHHFPTVVLSSLSRLKAATSRAHLASILGIKLQDLTYLLYKKPIYKKYTSFEIPKRSGGKRKISAPIDSLKSLQRKVAEVLQECISEIETSTKKINRAAHGFRLDKSILTNAAMHRNKRYVFNIDLEDFFPSITFPRIRGFLTSDKNFNLAPVVATTIAQIACLESKLPQGSPCSPVISNLIAGILDVHLSRLAKVNGCTYTRYADDITFSTNKKDFPIAIAIESQGNANVWVLGRQLAGLIKKSGFSVNVSKTRMQYRTSRQQVTGLVVNKKISAPNEYRHQVRAYVNSLVRRGFYMVDNGEKVEEGGIQKLHGMLGFIHAVESVYRTDLQRQPYNYPGVVIDERRPTGNLSIYRRFLLYTRFYANHQPLLICEGKTDNVYIGNAIHQRKSEFPLLIKKNDDGKDVISFQFFKYARKHRRKSDIYLPNYSTAMILGNGSGGGPNLAGLMSAYRSELKKFTSPGGKCPVIFIVDSDSGGKPVFKVIEGITKKKPSGTELFIHVFENVYVIPISKDGKSNVSIEHLFSENDKSILMDGKPFDFSGESSDSILGKASFAYDFVAKYPEKIDWSGFSRLLKSISDILELHKA

SEQ ID NO: 1047 - protein, 592 aa, unidentified
  source 1..592: note = Related to NZ_JACBGE010000023.1; note = Hydrogenophaga sp.
MSSWGSTYKMRKIEALKSVKSINGLADLLGFKASALGYILFKLPDAQKYNSFTIPKRSGGRRSISAPVPRLMLLQKKISTLLNDCLAEIEGKLSSPAHGFKLGRSIFTNAAHHRGRRYVLNLDLKDFFPSIHFGRIAGYFEKSRDFGLDPKIARILANVLCHKSSLPQGSPSSPVVSNLLARMLDIHLAKLAKRNRLTYTRYADDLTFSTNLNVFPEAVAKRVSEHVWQLGPELISTIGSCGFSINDLKTRMLYRSSRQEVTGLVVNDKVSVPVEYRRWARAAVARLVKTGAYFKPTPKGFIGPQPATPDAGSLDHLEGCLSHIYNAHRFQRSQAALGRALHHAPDELNSDEHVYRRFLFYTKFYVPEKPVIVCEGETDSIYIAAAISAMGGYYPDLIDAKLKPGEQNRFNVRFFKHSSIAGRLLELNGGTDALKNFCRIYVDQTKKFKGGLLSQPTIVIVDNDKAGRDVVNYAKGIAKNQGLPAIKGLNYVFTRPNLYVVSIQSPANAPDCVIEDLFPAHLLNTKLGGKVLTLSNQKVGDNEYGKMYFAKHVVPHADPKDFSGFSQLLDTLVEVIADFSSRVQVQPATKKA

SEQ ID NO: 1048 - protein, 573 aa, unidentified
  source 1..573: note = Related to MRCN01000005.1; note = Variovorax boronicumulans
MKLGKLQAATSTIDLANLLGYQPSAFHYLIYKLSEAAKYSVFQIPKRNGGTREIRAPEPKLKLLQQHLAEYLSECLKEIESSSDYASPAHGFKPGRSIFTNAEIHRQRRFVLNIDLKDFFTTIHFGRVKGYFEKSREFRLNSTIALAIAKIACYDRCLPQGAPTSPVISNLIGRVLDGHMCKLAKKHKVTYSRYADDLTFSTNLKEFPSALAIQNEEHKWHHGKELGEVVKHAGFEINEKKTRVQYRASRQEVTGLIVNDRVSIRAEYRAWARVAVHRLVHKDGFFEPIAKTFVGPLPNEKAPGSLRKLEGILSFIYSAQVFRREMIIEKGGQNKEKKAELHSDERLYQKFLYYTKFYRNEKPLIVCEGKTDNVYIRAAIVAMGEKFPTLKQEKGEKDSLLVRFYPHPKYGNRLLEMGGGTAGLRNFSHTYVDKSRKFSQIAPRNPVIIVLDADDAGKSVYSFAQKNHAKKDDFQGIVFLHPNLYFICIPEPKNSTHKAIEGLFPSVLTDQKLGDKSFNWKNTPLKEKEYGKAYFAKNIVPLATPEMFVEFTPLLEGIAAAIEHFRKLPEAKS

SEQ ID NO: 1049 - protein, 601 aa, Achromobacter sp.
  source 1..601: note = Related to JADCNH010000007.1
MGPLDYQAVLYMSQLIALRNADTRREMAALLGYESSKLTYALHGLKEESRYTQFAIPKKNGGHRTISAPDDATKALQRKLAALLANCVREIRSVESPRLPGQRRGVLSHGFEPGLSIITNARVHRKRRWVFNIDLADFFDSIHFGRVRGYFENNRNFQLKPIAALVIAQIACFKSKLPQGSPSSPVIANLVASILDIHLSRLATQVGCSYTRYADDLTFSTNQEEFPSAIAHQVDRDSNRWEASKELVDVISRSGFKLNSRKTRMQYRHSRQEVTGLVVNRVVNVPSEYRREVRARVHRLITKGEFYISGIGEAGQSTQVAGTPAQLRGMLAFIDRVDLFNLNLARESKGEPPITPASDLVDLTRNEETYRKFLYFTEFYATPLPLVICEGSTDYVYLVHAIRALVDDFPELAYRTGDEEIKFKIRFYRYPRNSTRRLTRIRGGTADLKKFVATYGAEVQRFKAGGQQHPVIVDNDAAGREVYGPAKKLGVVFNKSRPLTRVSANLYLTATPLLGADESCIESLFKTEDTARLVDGKSFDPDDKADRSLTYSKAVFAHQIVAKHAAHINFDRFRPLLASLSDAVTMHRESRTEEVAPAAIT

SEQ ID NO: 1050 - protein, 604 aa, unidentified
  source 1..604: note = Related to NC_020813.1; note = Pseudobdellovibrio exovorus
MMVNYLKELQQAKSLQDLAKLLGTNESNLNILLYKISRKSLYRTFEIPKKGGGFRIISSPDESLKVVQKRLASILSSILEPNYQLKHKKKLQNPKKERATRAYSNKSVSHAFKQNLSIATNAEQHLKKKYVLNLDLEDFFGSINFGRVRGFFIKDKQFKLDPVVATHIANIICHMDKLPQGSPCSPVMSNLIGRLLDRHLLRLANRRGCFYTRYADDLTFSFNGPKFPTEIAILEQDQWVIGDALTEVIEKSGFKIKKSKVRMHYRTSRQMVTGLVVNCHVNVPAEYYRDTRSMCLNIFTTGSCYLKTNRNKNLSMQQLEGRLNYIYQIKKFKNIYADQGGYRHSRHNGKYKSDSNLDRSTQYADNSHQVSLDGIKNIYGRFLFYKNFFAPQMPLIYCEGKTDPVYLKCALLALETKYSGMVSSGKLNVRFFAGNNLDGEMMKLVDGTGGMKYLISSYNRMKKECKFNGVPLHPVIIVVDNDSAGLEVKKAAKKKRSMTNGVFHIFHNLYILEIPKNPTDAVETVIEDYFTDKTLNMKFKGKTFKSGDLDEKDAVNHFGKAVLSMLVKKRCKKIDFSKFSEIFDKVDEIIKDYQTILSTKTSQE

SEQ ID NO: 1051 - protein, 561 aa, unidentified
  source 1..561: note = Related to NZ_JADPQF010000006.1; note = Aliikangiella sp.
MSYLERLKSCSNLKEFAEYLGYKPSNLSYLLYVLNDDLKYRTFEISKKSKEARVIKAPEKSLKGLQRRLASRLENCQKEIESNLGIVNPVSHGFRKGHSIATNANIHKRKRYVFNLDIKDFFGTLDFGRVRGFFIKNYNYELAPEVATIIAQISCFDNSLPQGSPCSPIISNLIGNILDVKLLKLAKKNGCHYSRYADDLTFSTNQKVFPADIAIQDPIKGDWDCGAEIYKIMKLVRFQINDSKTRMLYRNSRQLVTGLVVNRKVNIAADYWRDTRAMLWNLFNTGSFFIKDNSEEVAEGTLSQLNGRLDFIYQIDAYNTNKSKGENVKTAKKEAYKKFLFFKSFYVNEMPTIVCEGKTDPIYLKCALESLADSHRELIDKDGKLNIGLFNYSKVAADVLELSGGNAPISKFLDQYQKMFSLFRVNSSQNPTIIILDNDGAGLRTLNHAKRGATSEVKMDGFDEPIQCLPENIYVFRIPRIIDKDLEIEDYFKEEAFQIKLNEKSFKRKGVIDKKKEFGKFLFAEKIVKNNKKNIDFSQFSLIFNVIQQIISHSKASAPTD

SEQ ID NO: 1052 - protein, 577 aa, unidentified
  source 1..577: note = Related to NZ_QJSU01000001.1; note = Psychrobacter fozii
MNDFSKLKALQKTTTLSELAHLLRVQPKTLSYNIYIIDKNKTTTKKYSEFSIPKKSGGTRIILAPNQNLKFIQSQLSKILYSCIDEINKEKGVTGSLSFGYRKKSSIFDNAKVHKKKKFVFNIDLKNYFDSINFGRVRGFFIKNRNFCLDENVATVIAQIACHNNILPQGSPVSPVISNLIGHILDIRLSKIASSCGCSYSRYCDDITFSTNEKVFPKKLAYSNTDKTWHPSKLLISIVSQSGFEINMQKVRMSLFYSQQRVTGLTVNKKVNTTRAYRDLVRALVHSLCTKGDFEFRGDFYKDKISETNKLNSLQGMLNYISRIEYQELRGNRENKRFYPNINKLTKSEITLRDYVLFRYFFNPEKVTIFGEGKTDKSHLKHYLNFRSNIDTSKNPMPESFSDWKNMNFHDFESRIFDVISKSGGTGDIKKLVTEYKKYCNKFCIPEVQNPVIILVDDDDGSADLLMKLEKVKKDKLIKVVRKDFYHIDNNLYLIFLPRINSTDTDIESFYSKEVIDIPRNGLYFEKSNLSNNKRNYSKKVFATEIIPRNQELVDWSKFDQIFEKVQLAIEHFQSKK

SEQ ID NO: 1053 - protein, 583 aa, unidentified
  source 1..583: note = Related to NZ_BMXO01000001.1; note = Halomonas johnsoniae
MSALKKLKSACDINDLAKLLNFKSSNIAYIIYRLKEEEKYSSFEIKKSSGGLRTIDAPEPKLKNLQSNLAYLLQECLTEIEKTSQIKSTASQAFQPKKSIITNASLHRKKRFLFNLDIENYFGSINFGRVRGFFIKNKNFELDPKIATLIAQIACYRNRLPQGSPASPIISNLISHILDMRLIELSAKNKCFYTRYADDITFSTNLTEFPPEIAYESEDKIWSPSQKLTKLILKNGFNINYQKVRMQLHFSRQEVTGLTTNRIINTPIEYRKNARAMVRSLIMKGSFHMPKEEQEASVEQLHGILSFIDHVKLVTKHGHSNDPHSLPAAKEEKKSSFEKDFADFLFYKYCYAPTKPLIICEGKTDNIYLKCAIKSLDSKYPKLIHPNNKQDFKIDFFKYSRSQGGDSQKGRLLELRGGEGNLKNFISAYDKKCTKIRAPGKLHPVIVLIDNDKGGKQILSLIKNLKRETSTVTGNEDYYFINNNLYVIPIPDIMGNKNTTIEDFFYKKTLNRKINGRVFNRKNDHSGKNFYGKYEFAQKIVQKDLKNINFKKFIKILDRFELVISDYKRYLKSKALQNSRANH

SEQ ID NO: 1054 - protein, 573 aa, unidentified
  source 1..573: note = Related to NZ_JACTAG010000001.1; note = Sulfitobacter aestuariivivens
MTTMVSRLQACIGRSDLSSLLGFKPKAFAYVLFHVADAEKYTDFEIPKKNGGVRVISAPIPQLKLLQSRLSECLQTCLAEIEKADGVKESCAISHGFRKGRSIYSNAEVHKGRRWVFNIDLEDFFPSINFGRVRGYFIKNKNFALSPDVATVIAQIACHKNALPQGSPCSPVISNLLAHMLDMRISRIAKKARCSYTRYADDLTFSCSKKLFPDGIAQLSQADQGVWIPSDKLRHTIFSSGFKINKSKTRMQVYWSRQDATGLVVNAKVNVPREYVKTARAQCHQLITKGSVFNKEELWGQDVKVPYDPAKLQGKLSHIFNIKGQDLNFERQKGSLKTWPNFYRDYRSFLDYQSFGSSPKPVFLFEGKTDNIYIRCALNSLAADYPELISDGAPKQLMVRLFNYSRPTNAVQQLAGGTGDLQLLINNYELRLRGFSAATLAFPVILVVDNDKGSTDLFKAAGSKSDTKAKVDGSQPFYHITKNLYLVPTPTPKGMVESYIETFLPNSVLKKKLGKKTFHLPEKGFDVTKHFGKVLLAEQIVQRQQKAISFVGFKPLLDNMRAAMQDYAAKMAP

SEQ ID NO: 1055 - protein, 591 aa, unidentified
  source 1..591: note = Related to NZ_FOPM01000016.1; note = Methylobacterium gossipiicola
MTLTVILRIESACKLTMSIERMNQLKNSQGKFGFANALGISLKQLTRAVYGIPVQNRYSTFLIPKSTGGHRVIHVPHREIKFVQKALANLLQICLSEIETKKGVVRPVSHGFHPGRSIFSNAWAHRNKNYVMNFDLENFFHSIHFGRICSFFEKNNDFLLHPKVANLIANLSCHRIDGGGTFLPQGSPCSPIISNFIAMPLDQKLRKLARDNGCRYSRYADDITFSTNKDLFPDDIAIFDVSSKKWIAGSGILKVISKSGFKLNIQKTNMSIAGTRQIVTGLVVNKQVSVSRPVYKWARAAADHMFKDGVAFKRDPSTASIHTTDRQVTLGHIIGQVNHICYARRKSNIPLLNSRKMVGPELLYRRLTYYERFFAHKETLIICEGETDNTYLKIAIDKLGHKFKNVARRADGNPQVKLLNVTPHITIYTALNGGSDQQKSFLQNYDNDMSIVGERWADKCVIIFGDNDSGANSIMQILRGKSIIPGDIKTADFTYYTRNLYVILTPIPNKNSISMIEDFLDPNASRVKLENKVFHLGGKGFDEKKHYGKKALSEHVRQNASKYDFSKFEIILKRIDLAIDDYSSRLAALKL

SEQ ID NO: 1056 - protein, 575 aa, unidentified
  source 1..575: note = Related to JAKSXV010000098.1; note = Methylobacterium sp.
MSNGQLDRLKNAQGKLGLAMALGVPLRQLTRAVYGIPIPNRYTVFEIRKSSGGSRIIHVPHREIKFVQKSLAQLLQSCLSEIETRNGVKHPVSHGFHPKRSIFSNAWPHRNKNYVMNLDLEDFFHSIHFGRVYGYFEKNNDFLLNPKVANLIANISCHRNDVGGTFLPQGSPCSPVISNLIARPLDSKLRIFAKENKCRYTRYADDITFSTNLDNFPESIALLDSVKKYWVVGSGTTKIITKSGFRLNLGKTRMSVAGTRQMVTGLVVNRQVSVNKTTYKWARAASDRLFKEGVAFKRDPSTASIHTTDRQVTIAQLIGQVNHICHARRKSNIPLLHSRDMVGPELLYRRLTYYDRFFSNKNTLIICEGETDNIYLKIALKKFGANFKNLYNHVDDKATVQLLNITTHVTSYTALNGGSDQQKSFLQNFDNDMRIVKDRWADKPVILLGDNDSGANAIMQILRGKSIIAGDIKTAQFTHYIKNLYVIFTPVTSKTDNSMIEDFLDPKASKAILGGKSFHLGGKGFDEKKHYGKKALAEHVKENADKYDFSSFNSILKRLDLAVGDYAERLARSMA

SEQ ID NO: 1057 - protein, 586 aa, unidentified
  source 1..586: note = Related to QYRN01000007.1; note = Aureimonas flava
MSSLPSESTLERLKACKGKLGLAMLLGVQLKHLTHALYGIPMPVRYAVFTIPKSSGGVRIIHAPNDRLKFVQSALAAVLQECLIEIETKSGVQRPVSHAFHPKRSIFSNAWVHRRKRFVVNFDLQDFFPSLHFGRVCKFFEKSSDFQLHPKVANLIANLATHPDGAGGTFLPQGSPCSPVISNLLTRPLDLRLRKLAQRCDCRYSRYADDLTFSSNTTAFPEAIAKLDNECWIAGDEFEKIVVQSGFFLNHAKTRMALKGTRQVVTGLVVNKQVSVNRDTYKWLRAACDSMFKKGIASRHDPRTVKVYTMARKLELKQLIGHAEHVFHARRKSGIELPAMSLMKGPELLLKRLIYYERFFAHDRPIVICEGDTDYVYLRIALAKFGHQFANLAPSKEGLPAIRFLRFTPVIGRFTGLQGGSDQLKTFLQNWDVNMAMVGDRYPSQPVILFMDNDSGANATMQILRGKKVISQDIKMMEFTHATKNLYVIFTPVPDVKSQSCIEDFVDPTAKSVKLDGKTFHPGGNATYQGKKWSDTLHYGKRVLAEKVVAENVAKYDFSLFKPILDRLDKAIADYPKQVAKIVASK

SEQ ID NO: 1058 - protein, 548 aa, unidentified
  source 1..548: note = Related to JAFUJV010000004.1; note = Treponema sp.
MKYLKRLQDARTTEDFAKLLGFKAGNVSYLVYHYSGQKYYSFQIPKKNGGTRTINAPNDELKNLQRRLSDYLYKCLEEIHLQNNIHDTVSYGYQKNKCIYDNALIHRNRRYVFNVDLKDFFNSINFGRVRGFFINNKNFKLDPHIATLIAQTACNDNILPQGSPLSPIITILIGGILDHRILRLTHKIRCSYSRYVDDLTFSTNLKTFPPEIAFFDETGKWVIGKELNNILKTSGFESNEKKVSMQYKDSRQTSVGLIVNKKVDVPREYYKTVRAMCNSLITRGYFVKKDAAEDEPPTLNQLEGMLNYIFSVKSKNTNVRVKDHYPGFQNIYIDFYIYRFFFANEKPILFTEGKTDIIYIRSALKHLKAEYPKLITSEGLLNFQLMWINDYLQSVFHISSGCSGSLKLLVQYESFLKRYKKTESMNQVFFLFDHDSGIKEIVNKYKKYDSAKDYFSKNDFSSLSVEVYKNVRFIFTHEEHDKYIEQYFDEALLSEKINGKSFTPENNVHDPEHYFGKQVFATKIIKKKQDSIDYSNFRPLFNELSKYL

SEQ ID NO: 1059 - protein, 562 aa, Salmonella sp.
  source 1..562: note = Related to AANPCH010000002.1; note = Salmonella bongori
MSFLTKLKQAKNVSDVAHILGCSPAALTYTIYKNNAKYTTFKIKKKSGGERCITSPDRKLKELQKRLAKGLQEYFDEINKGRDTETSAHGFVKGKSILTNAYKHKNKNLVLNIDLENFFDTINFGRVRGYFIYNKGFALTEKVASVIAQIACNENKLPQGSPCSPIISNLIGQILDVKLSSMAKKNKCFYTRYVDDITFSTNQKAFPESIANINDTQVIIGKKLRNEIEKAGFKVNDSKTRMQLRNSRQDVTGLVVNQKVSVRSEMRHLARAMTDSFFKNNTAFISIDGKEENISIERLNGILSFIYNIRTGVYGANGCKNTSLHDSFERMYACFLFYKNFAANKSTVIICEGETDNIYLKYAFRSLVGCYPELQVIKKGVKKRLDLSIYRQTKTLENLLNITDGTGNNIKFIKTYRQSMRRYASPPKVFPVIVLLDNDSGSSSIDGIINRDFIDTREVCDGFTYVCENLYIVKTPLIDKKKESKIEDFFDSHTLSKTLGSKTFTSENKFDKEQHYGKKKFAEIIVKQNYKEIDFSNFKKIIDLFNDVILHYQEKRNQRFNF

SEQ ID NO: 1060 - protein, 557 aa, Salmonella sp.
  source 1..557: note = Related to CP074306.1; note = Salmonella enterica
MSFLAKLKQAQSTSDIAKILGCSPAALTYTLYKNRTKYTEFKIKKKNGGERIISVPEKKLKELQRRLSKGLQECINEINAKRKFETSSHGFVKGKSIFTNAYKHKNKNLVLNIDLANFFDSINFGRVRGYFIHNREFALSDKVSSILAQIVCYDNKLPQGSPCSPVISNLIAQILDVKLSALAKKHNCYYTRYVDDITFSTNQNKFSASIISFQEREVIVSGQLKKEIERAGFKINSGKTRLQFKNSRQDVTGLVVNKKVNVKHELKHIARAMTNSFFKLNSAYISIDNRVEEVSLDRLNGMLSFIYHIRSKMNDNNDTKNKGTLDSFDKMYSKFLFYKTFAANKSTVVICEGETDNIYLQYAFQNLVGSYPELQLIKKGVKKKINIFLYKQTKTLSHLLNVTDGTGNNIKLIKTYKQNMSGFVCPPQNYPVILLMDNDSGSNGIEGLINRDFSDTRKIHDGYTYVCENLYVVKTPLIDGKKETKIEDFFDCKTLSKKLGDKTFSASNNFDKSLYFGKRKFAELIVKQNHKEIDFSNFKMIIDLFYLVICDYQKRLS

SEQ ID NO: 1061 - protein, 448 aa, unidentified
  source 1..448: note = Related to NZ_LT615367.1; note = Dickeya aquatica
MSFLAKLKESQNISDIANLLGCSPKSLAYTIYKSQNNYITFKIRKKNGGHRDIKAPAKKLKELQRRLAKGLQECIEEINGKKNKRISSHGYTKGKSIFTNAYEHKNKNLVLNLDLENFFDSINFGRVRGYFIHNKNFMLPEKTATIIAQIACHENSLPQGSPCSPVISNMIAQILDVKLSALAKKNKCFYTRYVDDLTISTNRNIFPNDIMELHDHKPIIGKSLINEIKRSGFTINDNKTRVQCKDSRQDVTGLIVNKKVNVKSEFKHLARAMANNFFKNNQAFISLNGEKTPISLEKLNGMLSFIYQIRNRMDMQNANGQPRKTHDSFEKTYSDFLFYKNFAANNRTVVICEGETDNIYLNYAFKNLVSYYPELQNYGKGIKKRIDIHLFKQTKLLYRLLNITDGAGNNIKLLNTYQKRMSRFSSPRESFQLYCYLITTADQLGSKE

SEQ ID NO: 1062 - protein, 568 aa, unidentified
  source 1..568: note = Related to JAGGMP010000001.1; note = Erwinia rhapontici
MSALETLKKLKNLKDVAVFLDCKPKFLSYLLFFEKDKYSEFELRKKSGGVRIIHAPNKKLKAIQKKLSDVLYECQDEIYPKQKFKVLSHGFVRKEKIKNKILIHGALSNAKAHKNKNNVFNIDLENYFGSFNFGRVRGFFIKNKDFLLTDKCATVIAQIACYNNSLPQGSPCSPIISNLISRSLDVKLANLAKRNSATYSRYVDDITISTNKKIFPKNIALNDSHKISLGDEFSKIISSSGFTVNSKKTRLQYSDSRQEVTGLVVNKFVNIPHEYRSNLRPKAHSLFLTNSYFYVDNEGNKCEGSIDKLNGLFSYIHFIRKNTINHGKYIRDKNGELALDGSDYLYSQFLYYKYFANNDKPIVICEGKTDVIYLKAVLKTLAADYPDLIEVNNDKTSLKIQILPASKTVQDLLGLLTGTADLRKFILSYEARLEDFKSPSLLNPVIVLVDNDDGPRKINNAIKDKYKISPEAGKPSIIFSNMVYVRTPELEKKKETSIEDFFSDGIRKIKIDGRTFSPDIDDDTTAHFGKKTFAEEVILKKRKTLDFTSFKPVLNLLVESIRIYKKGA

SEQ ID NO: 1063 - protein, 311 aa, unidentified
  source 1..311: note = Related to NZ_NRNL01000028.1; note = Cronobacter malonaticus
MTTLETLKKLKDLKDVAGFLDCKPKFLSYLLFFEKEKYTIFKVPKKNGGVREIYAPNQKLKAIQKKLSDILYECYSEIYPKNKYKVISHGFVKKENNSKKEVIYGALSNAVEHKNKRNVLNVDLENYFGSFNFGRVRGFFIKNKDFALSEKCATVIAQIACYNNLLPQGSPCSPIIANLITRPLDIKLACLAKKNSATYSRYVDDITISTNKKTLPKCFCLNNKHEIFPGKALVEIINKSGFSINDNKTRLQYSDSRQEVTGLVVNKFVNVPYEYRHNLRPKAHSLFNENSYFYEDNEGNRLSGSIEKLNG

SEQ ID NO: 1064 - protein, 578 aa, unidentified
  source 1..578: note = Related to SZZV01000010.1; note = Pantoea sp.
MMSSLESLKKLKNLKDVATFLGCKPKALSYLLFFDENKYRTFEIKKKSGGSRKILAPNDKLKAIQKILSNVLYDCYAEIYPTKKYSVISHGYVRKEKNQINKENNHTKDQNLSYGTITNSIPHKNKHNVLNIDLADYFSSFNLGRVRGFFIKNESFKLSTECATVLAQIACYENELPQGSPCSPIIANLISRSLDVKLAGLAKENSATYTRYVDDITISTNKKVFPTKIAGVIDNKVTLGKSLQRIVIKSGFTINPPKSRLQFSDSRQEVTGLIVNKFVNVPSNYRHTLRPMVHSLFKNNTYTYMNDEGDNVKGSIDRLNGMLSYIHYIRSNTINKGKYVRDDKGGIRLDGSDQLYADFLFYKYFANNTRPVLICEGKTDVIYLKSTLKALADNYPSLIEKDGSKTHLKIQILPASKTIQNLLGLLSGADDLKKFMETYEARFSKYAKPSALHPVIVLVDNDEGPRNINSKIKNKYKVIPSPGTPVKVWGNLLYVQTPEIVGMKNTAIEDFFSSEIRKIKVEGRTFSPQTETETIAHYGKRVFAEDVISKKRKILNFDSFKPILDLLVSSIDLHNLKK

SEQ ID NO: 1065 - protein, 585 aa, unidentified
  source 1..585: note = Related to NSDJ01000002.1; note = Rahnella variigena
MATGGSPYECDKSVYRPLPSIFNMDIMSKLADIRSLKSLSDVADFLGCEPKNLAYSLYFAKNKYKSFEIYKKSGGVRIINAPNEKLKSLQKILAGYLSECLDEIYNTHGGNKISHGFVKGKTIITNASQHRNKNLVFNIDLSDFFNTINFGRVRGFFIKNKYFSMDEKAATVFSQIACHEGRLPQGSPCSPVISNLILNILDIRLASLAFKNSCNYTRYADDLTFSTNRKEFPIDIVKDELGDWVVGNKLHKEITKCGFIINKSKTRLQYKDSRQDVTGLVVNKFVNVPSDYRRLTKSMAHELFRTNEFYIKLPDGESIEGTQNQLNGMLSYIYSTRKITIHKNFDSTIPRDGKGIPILDASDRLYSDFLFYKNFVANDKPIVICEGKTDVVYLKHAIKSRYEKYPNLVEIKKKEKALKIQILGASFLVNHLLDLLTGTTAIKRFVESYATRLSKYKCPPLNNPVIILTDNDDGIKGLIHAINGKYKESEDRDGIYFITSNLYLIRTPLLNDKNSSKIEDFFTKELLARKLDGKTFHPDNDTDNTMHYSKQVFVEKIIKKEYKSIDFSGFDSIINLLEKTIIDHK

SEQ ID NO: 1066 - protein, 557 aa, unidentified
  source 1..557: note = Related to CP060807.1; note = Klebsiella variicola
MSKLTEISQLQSLRDVAIFLGCEPKNLAYSLYFEKNKYKSFEIHKKSGGVRIINAPNEKLKSLQKILACQLNECLEEIYRMHGGNKISHGFTKGKTIITNASKHRNKRLVFNIDLTDFFSTINFGRVRGFFIKNNHFNLNEKAATILAQIACHEGKLPQGSPCSPVISNLILNILDVRLAKLASTNSCTYTRYADDLTFSTNKNDFPSDIARQSAENTWIPGSRVRKEILRSGFSVNDKKTRLQYYDSRQDVTGLVVNKVVNVPSEYRRLVKSMVHQLFNTNEFYLKLSDGESLEGSQEQLGGMLNYIYSTRKTTIHHGKVKRDAEGNLLLDASDRMYADFLFYKYFVANNKPIIICEGKTDVAYMKYAIKSRSNHFPSLVEETEGKKQLKIQILAASNTVNHLLDLLNGTSSIKKFIELYDSKLKKYKNPILKNPVIILTDNDSGSSNLIPTIRGKYKNSEEKDGFYFITKNLYLIKTPLINGNDSSKIEDFFTKELLSRKLDGKTFHPDNDTDNTMHYSKNVFVEKIIRKEYKSIDFSGFDSILNFITNVISTHK

SEQ ID NO: 1067 - protein, 558 aa, unidentified
  source 1..558: note = Related to NZ_CAKLIS010000018.1; note = Pectobacterium versatile
MSELIEISKLQNLSDVAHYLGCKPQSLAYTLYHEKNKYTTFEIKKKNGGVRLINSPCDKLKVLQRILANKLSECLDEIYKENGGNKISHGFVKNKTIITNASEHRNKNLVFNIDLTDFFNTINFGRVRGFFIKNNNFMLNEKVATIFAQIACHDGKLPQGSPCSPVISNLILNILDIRLAKLAFSSNCYYTRYADDLTFSTNKKVFSKNIVKYRDDGAPESGPLLTKEISRSGFIINDKKTRLQFCDSRQDVTGLIVNKVVNIPSDYRRLIKAMTHELFCKNSYYIKNANKKDQKGNLEQLNGMLSYIYSVRKNTIHKNITTRDSKGNPRLDANEKIYSDFLFYRYFVANDKPILICEGKTDVAYIKYAIRSRSSRYNSLVEEEYGEKKLKIQVLNSSGQVNHLLDLLNGTSSIKKFIENYSARLKKYEKPLFTNPVIILTDNDDGSSKLVPAIKGKYRGSKEINGFHFITNNLFLIKTPLFPDKPDSKIEDFFTKELLSRKLNGKTFHPDNDTDNTIHYSKNIFVEEIIRKEYKSIDFSGFDEILDLIVSVIDEYKK

SEQ ID NO: 1068 - protein, 638 aa, unidentified
  source 1..638: note = Related to NZ_JAFBFW010000001.1; note = Pantoea coffeiphila
MSWRFLGSCQVCVRVPINLFKWGRRVNRLLLLKSAKTKPDLARILGVKPSALTHCLYIVKPENQYVQFEIPKRNGGKRFISAPSGMLKTLQSSLSDLLLDCLDEIIFLKFPDSEITRPKAKNSLFLKVKCSGSETKQPSLSHGFERKRSIITNAMMHLGKKHVFNIDLENFFSSFNFGRVRGFFIKNGNFLLEPEIATVIAKIACYNNELPQGSPCSPVISNLITHALDIKLAAVAAKHSCTYTRYADDITFSTRKESLPSSIAKSDNHTFVAGKVIRNEIVRSGFSINESKTRNQYKDSRQEVTGLVVNKKPNTKKEYWRLVRAQCNHLFNTGEFKETINGAEVSGNIHRLEGKLTFIDQVDHYNRLRQGEKLNPKYHLKKDAIRKSNPSIRRYLHTSRETTFSKFLFYRWFYGNTKPTILTEGQTDNIYLKSAIWKLAANFPKLATGKSATEPYKALTRFFKYNERTRYLLELFGGGDYLRDFVDNYKELFNAYKAPKPSHPVIIFVDNDSGPNNLINKVKRVKGIEIFPAGVGLADIRQSEFVHIFCNLYLVLTPQGAGSSETDIEYFFSDADRLREHKGKRFNTVADRDEVNDLSKEAFATHIVKTQKGIIDFSRFTHLLERIEKVIDHYNSIK

SEQ ID NO: 1069 - protein, 611 aa, unidentified
  source 1..611: note = Related to AP025009.1; note = Raoultella ornithinolytica
MKKLDLLKAAKTKPDLAKLLGVKPSALTYCLYKTKPETQYVQFEIPKKNGGNRIISAPSGMLKNIQASLSELLLDCLDEIIIDKFPNSEIARQKAKNSIILKLKCSGSEIKQPSLSHGFERKRSIITNAMMHLGKKHVFNIDLENFFGSFNFGRVRGFFIKNKNFLLEPEIATVIAKIACYNNELPQGSPCSPVISNLITHALDIKLAAVASKYSCTYSRYADDITFSTRKDSLPSSIAKSDNHTFVAGKVIKSEIKRSGFSINETKTRNQYKDSRQEVTGLVVNKKPNTKKEYWRLVRAQCNHLFRTGQFKEIVDGVEVVGNINRLEGKLNFIDQVDHYNRLRQSEKLNPKYHLKKDALKNGYAKSRRYLHTSREKTFSKFLFYRMFYGNKKPTILTEGKTDNVYLKAAIHKLAALFPKLAIEKTALAPYKLLTQFVEYNERTKYLLELFGGTDYLKDFVIHYRHYFHDYKAPKPSNPVIIFVDNDSGPKNLINYVNGVEGIQIFPAGVADIRQSDFVHIFCNLYLVLTPQVEGCPETDIEYFFSNVDRLKQHKGKCFNTVADRDPSNDLSKEAFATHIVNAHKNDIDFSRFTSLLERLEKVIDHYNLIK

SEQ ID NO: 1070 - protein, 611 aa, unidentified
  source 1..611: note = Related to LMLK01000003.1; note = Erwinia sp.
MKTLQSLKEAKTKPQLAKILGIKPSTLTHCLYVLNTNNQYIKFEIPKKNGGIRVIHAPTPILKMIQKSLSKLLLNCLDEIIFTKFPNSELARQKAKNSGILKVKISNAEIKQPSLSHGFERNRSIITNAMMHLDKKFVFNIDLHDFFGSFNFGRVRGYFIKNRNFELHPDIATVIAKIACYQNKLPQGSPCSPVISNLITHALDIKLAKLAKLSSSTYTRYADDITFSTRLSELPKSIAEKENHKYEPSKKITKEINRSGFSINTSKTRNQYADSRQDVTGLIVNKKPNTKKEYCRLARSQCNHLFKRGEFKELINGNEEKGNINSLEGKLNFIDQIDHYNRLRQTKKLNPKYQLKKDTIKNGNAKLRRYLHSSREKTFSQFIFYRHFYGNELPTILTEGKTDNVYLKSAINKLSAQFPELSRSKTSQAEYKLLLKFFNYNERTRFLLELFGGTDYLRDFIVNYKKNFSYYQAPKPKKPVIILVDNDSGPRDLINYAKNIEGVMIYPAGTTEIRDADFVHIFHNLYLVLTPKKPGHNETDIELFFKDVDRLRIYNGKHFNTAAQRDKNRDLSKEAFAEHVIHAQKDVIDFSEFPAILERLVKAMNHYDTIK

SEQ ID NO: 1071 - protein, 549 aa, unidentified
  source 1..549: note = Related to CP071802.1; note = Yersinia ruckeri
MIQSSLSGLLLDCLDEIIHNKFPESELARQKAKNSKILKIKCSSAEIKQPSLSHGFERKRSIITNAMMHLGKKYVFNIDLEDFFGSFNFGRVRGFFIKNRNFLLDPEIATVIAKIACCNNELPQGSPCSPVITNLITHSLDIKLAAIAKKNSFTYTRYADDITFSTRKSDFSSSIAKKQNNKYVISKRVRNEIILSGFIINESKTRNQYKDSRQEVTGLVVNKKPNTKKEYWRLVRAQCNHLFKNGEFVEIIDSKETKGNINRLEGKLNFIDQIDHYNRLRQGEKLNPKYHLKKDAIKKGQAKSRRCLHNSREKTFSKFLFYRLFYGNNLPTILTEGKTDNVYLKAAIHKLASLFPKLAVVKSASSPYKILTNFIDYNERTKYLLELYGGADYLKDFIIHYKNNFNYYKAPKPSNPVIIFVDNDSGPKDLINYVSKINDIKISPTGLMDIRSSEFVHIFHNLYLVLTPQIKGYAETDIEHFFTDTDRLRPHKGKVFNTASKRDPDNDLSKESFATHIVHAKKHDIDFSGFTSLLERLEKVINHYDTVKE

SEQ ID NO: 1072 - protein, 547 aa, Escherichia coli
  source 1..547: note = Related to NZ_CP080146.1
MQSSLSRLLLDCLDEIVCIKFPDSELARQKAKNSKILKLKCSNSEIKQPSLSHGFERKRSIITNAMMHLGKKYVFNIDLDNFFGSFNFGRVRGFFIKNRNFALDPEIATVIAKIACYNNELPQGSPCSPVITNLITHSLDIKLAAIASRNSSTFTRYADDITFSTRKGEFPSAIAKNQNGKYIVSKKIRGEITRSGFIINDGKTRNQYKDSRQDVTGLVVNKKPNTKKEYWRLVRAQCDHLFKHGEFLEVIDGKEIKGNVNTLAGKLNFIDQVDHYNRLRQGEKLNPKYHLKKDANKNGHAKKRRYLHSSREKTFSEFLFYRLFYGNELPTILTEGKTDNIYLKAAIHKLASSFPNLAVAESPGLSYKPRTKFVNYNERTKYLLELYGGADYLKDFVIHYKQHFNRYKAPKPSNPVIILVDNDSGPKDLINYVSKVDNIGIFPTGVPDIRASEFVHIFCNLYLVLTPQVKGYTGTDIEHFFKDADRLRPHKGKFFNTVSKRDHDNDLSKESFATHIVHAHKHEIDFSGFTSLLERLVKVINHFDTVK

SEQ ID NO: 1073 - protein, 618 aa, unidentified
  source 1..618: note = Related to NZ_CP065024.1; note = Rahnella inusitata
MNRLQSLKEAKTKPDLAKLLDVKPSALTYCLYILKPENQYTQFKIPKKNGGERTINAPNGLLKSIQSSLSKLLLDCLDEIIFNKFPDSELAAEKANNSKVLKIKCSAAEIKQPSLSHGFERKRSIITNAMMHLGKKNVFNIDLENFFGSFNFGRVRGFFIKNRNFELDQEIATVIAKIACYNNELPQGSPSSPVITNLITHSLDIKLAALAVKNSCTYTRYADDITFSTRKIDFPSFIANDKCGKFAPSKKLRSEIVRSGFLINDKKTRNQYKDSRQDVTGLIVNKKPNTKKEYWRLVRAQCDHLFKYGTFVEKIDDIEIKGNINRLEGKLNFIDQLDHYNRLRQAEKLNPKYQLKKDPTKNTQAKTRRYLHGGRESTFSRFLFYRLFYGNTLPTILTEGKTDNVYLKAAIHKLAALFPKLASEKSAGSPYKSLTRFLDYNERTKYLLELFGGADYLKDFVIHYKSYYKYYTAPEPSHPVIIFVDNDTGPKDLINYINKIDNASIFPKGLKDIRSSDFVHVFHNLYLVLTPQTKGYSETDIEHFFKDKDRLRQYKGKSFNTVSLRDPNNDLSKEAFSKHIIHANKHDIDFSGFTSLLERLVKVIEHFNSLKIKNSSAP

SEQ ID NO: 1074 - protein, 613 aa, Vibrio parahaemolyticus
  source 1..613: note = Related to LQCW01000011.1
MERLQLLKNAKTKPDLAALLNIKPSVLTFCLYKVKPQNQYTQFIIPKKNGGERIINAPTGVLKSIQSALSNLLLDCLDEITRNKFPKSELVIEKAKHSKVLKVKCSNSQSKQPTLSHGFERKRSIITNAMMHLGKRHVFNIDLEDFFASFNFGRVRGFFIKNKNFELEPDIATVIAQIACHNNELPQGSPCSPVITNLITHSLDIKLSALASKNSCTYTRYADDITFSTRKKEFPIDIARKKGEQFISGKKLRSEIIRSGFKINKGKTRNQYKDSRQDVTGLIVNKKPNTKKEYWRKVRAQCDYLFKYGEFIDTVNGKEVKGNIHSLEGKLNFIDQVDHYNRLRQTLPLNSKYQLKKDAIKNGQAKLRRYLHSGREETFSKFLFYRLFYANESPTILTEGKTDNIYLKAAIHKLAGSYPRLASEKNDNSPYKLLTRFVEYNERTKYLLELYGGADYLKDFVVHYKHHFKYYEAPNPQNPVVIFVDNDSGPNNLINYVNKINGKCIYPEHINDIRASEFVHVFHNLYLVLTPQVAGFKETDIEHFFVESDRLRPYKGMIFNTISKRNPEKDLSKDAFATHIIHAKKNEIDFNGFKSLLDRIVKVIEHYDSINKK

SEQ ID NO: 1075 - protein, 611 aa, Vibrio sp.
  source 1..611: note = Related to KB662759.1; note = Vibrio cholerae
MTRLQALKKAKTKPELAHLLNIKPSVLTYCLYKIKPQNQYTQFKIPKKNGGERTINAPTGTLKSIQSALSELLLDCSDEITRNKYPESELAREKAKHSKILKVKCSNSIIKQPTLSHGFERKRSIITNAMMHLGKKHVFNIDLEDFFGSFNFGRVRGFFIKNKQFELEPEIATVIAQIACYNNELPQGSPCSPVITNLITHSLDIKLAALASKNSCTYTRYADDITFSTRKKEFPSFIAQQKDDQFFASKKLRSEIVRSGFKINPSKTRNQYKDSRQDVTGLIVNKKPNTKKEYWRTVRAQCDYLFKYGEFIEVIDGEGVKGNINSLEGKLNFIDQVDHYNRLRQTLPLNPKYQFKKDTIKNGQAKLRRYLHSSREDTFSKFLFYRFFYASELPTILTEGKTDNVYLKAAIHRLASSYPELALEKKGDSPYKLLTRFVEYNERTKYLLELYGGADYLKDFVIHYKQNFRFYKAPKPENPVIIFVDNDSGPNNLINYVSGIQGKYIYPESVKDIRASEFVHIFHNLYLVLTPQVAGFKETDIEHFFTDNDRLREYKGMCFNTILNRKPEKDLSKDAFATHIVHAKKNEIDFDGFKILLDRMVKVIEHYVSIK

SEQ ID NO: 1076 - protein, 611 aa, Vibrio parahaemolyticus
  source 1..611: note = Related to JACBSO010000017.1
MERLQTLKQAKTKPDLANILGIKPSTLTYCLYKLKPQNQYAQFNVPKKNGGVRVINAPTGTLKSIQAALSILLLDCWDEILKSKFPASEISREKAKHGKTLKVKCSNSETKQPSLSHGFERKRSIITNAMMHLGQKHVFNIDLEDFFGSFNFGRVRGFFIKNRDFELDPEVATVIAQIACFNNELPQGSPCSPVITNLITHSLDIKLAALASRNSCTYTRYADDITFSTRKSSLPKCIAQNRDGEFLVGKKLRSEITRSGFNINDKKTRNQYKDSRQDVTGLIVNKKPNTKKEYWRTVRAQCNHLFNNGFFIESINGKDVKGNINRLEGKLNFIDHVDHYNRLRQTLPLNPKYQYKKDAIKNGQAKLRRYLHTGREDTFSKFLFYRLFYANDLPTILTEGKTDNVYLKAAIHKLAGGFPKLATEKNGNSPYKLLTRFVEYNDRTKYLLELYGGADYLKDFVINYNHHYKYYKAPTPNNPVIIFVDNDTGPSGLISYINKIQDSVIYPDGVKNIRDSDFVHIFHNLYLVLTPKENGYDGTDIEHFFVEKDRLRKHKGKCFNTVADRDSENDLSKDAFANHIVHARKHEIDFSRFNTLLERIVKVIEHYDSIK

SEQ ID NO: 1077 - protein, 610 aa, Aeromonas sp.
  source 1..610: note = Related to JAKZFL010000005.1
MSKLQDLKKATTKPDLAHVLGVKPSVLTYCLYVLKTENQYTQFKIPKKTGGERVINAPTGKLKTIQSLLSNLLLDCLDEINHKAFPKSQLAKETVKNAEVLKIKCSTALVKQPALSHGFERKRSIITNAMMHLGKKQVFNIDLEDFFGSFNFGRVRGFFIKNRNFELHPEIATVIAKIACHNDELPQGSPCSPVITNLITHALDIKLARMASKNSCIYTRYADDMTFSSRESTLSKNIAYEDDNIFVVSKKLRAEITRSGFTINDKKTRNQYKDSRQEVTGLVVNKKPNTKNEYWRTARSQCDRLFKTGGFTELVNGEVVPGNINRLEGRLNFIDQVDHYNRLRQKLPLNPIYQTKKEVLKKTNQAKLRRYLHSGREDTFSKFLFYRLFYANELPTILTEGKTDNIYLKAAIQMLAKNFPRLATEKTAVSPYKLLLRFVEYTERTKFLLELHGGADYLRDFVINYKKHFEYYKAPRPENPVIIFVDNDTGPNDLINYVNKIEGITIYPSSQNEVRKSDFVHVFCNLYLVLTPRDSNGNTDIEHFFTNKDRLRQYKGRCFNVESKRDVKNDLSKDAFANHVVHANKASIDFDGFSGMLGQIAKVIEHYDSI

SEQ ID NO: 1078 - protein, 610 aa, Aeromonas salmonicida
  source 1..610: note = Related to QLLM01000001.1
MSRLQELKKATTKPDLAKLLGIKPTMLTYCLYILKTENQYAQFNIPKKNGGERTINAPTGILKSIQSLLSKLLLDCLDEINHKKFPKSELAREVARNSKVLKIKCSNALIKQPSLSHGFERKRSIITNAMMHIGRKNVFNMDLENFFGSFNFGRVRGFFIKNKHFELNDEIATVIAKIACHNNELPQGSPCSPVITNLIFHSLDINLAKLASKNSCVYTRYADDITFSSREKELPKDIAHEDNGEFVLSKKLRYEITRSGFIVNDKKTRNQHKDSRQEVTGLIVNKKPNTKKEYWRTVRAQCNSLFKTGVFTEIENGKAIPGSINRLEGKLNFIDQIDHYNRLRQAPPLNPKYQPKKEAIKNGQAKLRRYLHSGREDTFSKFLFYRLFYANELPTILTEGKTDNVYLKSAIHMLAKNYPQLSSEKTDKSPYKLLLRFVEYTERTKYLLELYGGTDYLKDFIIGYKQHLKFYKAPRPEKPVIIFVDNDTGPKDLINYVNKIDGKEISPSTEVDIRSSEFVHIFYNLYLVLTPKDNNINTDIEYFFTEKDRLRQYKGKCFNIVSKRDLDNDLSKEAFATHVIHANKKDIDFSGFTGMLDRIVKVLKHYDSIK

SEQ ID NO: 1079 - protein, 615 aa, Vibrio sp.
  source 1..615: note = Related to POSH01000027.1; note = Vibrio diazotrophicus
MVKLKALKEAKTKPDLARLLGIKPSLLTHCLYVIKTENQYIQFKIPKKNGGERIINAPTDKLKFIQSALSNLLLDCLDEINYDKFPKSDFSNITSKRAKVLKIKIPNSNIRQQSLSHGFERKRSIITNAMMHLGKKYVLNIDLEDFFGSFNFGRVRGFFIKNRNFELSPEIATVIAKIACHNNELPQGSPCSPVITNLIVHSLDIKLAKLAEKNSCIYTRYADDITFSCRKRDLPKAIAYELNGEFILSKKLRSEITRSGFNINHKKTRNQYKDSRQDVTGLIVNKKPNTKKEYWRTVRAQCDNLFKTGAFTELVDGKDVEGNINRLEGKLNFIDQVDHYNRLRQTPPLNPKYQTKEDLIKNNQAKLRRYLHNGREKTFSKFLFYRLFYANELPTILTEGKTDNVYLKAAIHMLSKDFPKLSSVQTTTSKYKLLLRFFEYKVRTRYLLELYGGADYLKSFVINYRYQYNYYKAPKPENPVIIVVDNDTGPNGLINYVNGITEKKIFPSASKDIRTSEFVHIFNNLYLVLTPKGLGGCNTDIEYFFTDKDRLRTYKIKDSLKCFNTVDKRDPNNDLSKEVFATHIVHANKKDIDFSGFKVILERIVKAIDHYDSIK

SEQ ID NO: 1080 - protein, 611 aa, unidentified
  source 1..611: note = Related to BPEY01000057.1; note = Shewanella sairae
MQKLQLLKKTKTKPDLAHLLGIKPSALTYCLYIVKTENQYSQFKVPKKNGGERIINAPTAALKSIQSSLSNLLLDCLDEINAEKFPSSEIVKEKAKNSKVLKVKCSNAKTKQPSLSHGFERKRSIITNAMMHLGKKHVLNIDLEDFFGSFNFGRVRGFFIKNKHFELSPEIATVIAKIACHKNELPQGSPCSPVITNLIVHSLDIKLARLASNNSCIYTRYADDITFSTRNRELPVALASERDGEFILSKKLRSEIRRSGFLINDKKTRNQYKDSRQDVTGLIVNKKPNTKKEYWRTVRAQCNSLFKTGGFTELVNGEVVKGNANVLEGKLNFIDQVDHYNRLRQSPPLNPKYNTKKEAIKNNQAKLRRYLHSGREDTFSKYLFYSLFYGNELPTILTEGKTDNVYLKSAVHMLAKSFPKLASEKTATSRYELLLRFVEYTERTRYLLELYGGTDYLKDFIINYRQHFKFYKAPKPKKPVIILVDNDVGPKNLINYVNHIEGKSIFPSSAKDIRASDFVHIFHNVYLVLTPLGKENSETDIEYFFSDADRLRKYNGKCFNTVSKRDPDSDLSKDSFATHVVHANKKDLDFSRFKGIFDRMVKVIEHYDSIK

SEQ ID NO: 1081 - protein, 610 aa, unidentified
  source 1..610: note = Related to WMDE01000004.1; note = Photobacterium carnosum
MEQLKSLKKVTTKPEFAQLLGIKPSVFTYCLYVIRPENQYSQFKIPKKNDGYRTINAPTGTLKTIQSALSNLLLDCLDEINKDKFPSSEMFKAEAINSKFLKIKCSNSVIKQPSLSHGFERKRSIITNAMMHVGRKNVFNIDLENFFGSFNFGRVRGFFIKNKNFKLCPDIATIIAQIACNNNELPQGSPCSPVITNLIVHSLDLRLAKLASNDSCIYTRYADDITFSTRENKFPINIAKEDDNKFHSSKKLNSEIKSAGFVINDKKTRNQYKDSRQDVTGLIVNKKPNTKKEYWRTVRAQCDSLFKTGEFKELVGDSYIIGNINRLEGKLNFIDQVDHYNKLRQSVPLNPKYYLKKEANKSQAKKRRYLYTGREITFSNFLFYRLFYASELPTILTEGKTDNVYLKAAIHMLADKHSSLASAKSGNSSYKLLLKFVEYSERTKYLLELYGGTDYLMDFIKNYNLNYNLYKAPKPNNPVIIVVDNDDGPKGLINYINKIKDAKLFPQTAKDIRSSEFIHIFNNLYLVLTPRTEDNCPTDIEYFFTDKDRLREYKNKCFNTHSNRDTENDLSKDSFANHIIHANKNDIDFSRFNGLLNRIGKVIEHYNLGK

SEQ ID NO: 1082 - protein, 612 aa, unidentified
  source 1..612: note = Related to NZ_SODO01000007.1; note = Oceanimonas baumannii
MTQLQALKDAKTKPDLARLLNIKPSIFTHCIYIVDTKNQYTQFTIPKKNGGERTINSPSDKLKKIQKSLSNLLLDCLDEINKLQFPDSEISRPRASNSKYLKVKCSNSKIKQPSLSHGFERKRSIITNSMMHVGKKHVFNIDLEDFFGSFNFGRVRGFFIKNKNFLLEPEIATAIAKIACYNNELPQGSPCSPVITNLITHSLDIKLSKLAFYNSCIYSRYADDITFSTNESKMPRHIARSVDGELIVGKKLYSEIRRSGFSINKNKTRDQYKDSRQDVTGLVVNKKPNTKKEYWRTVRAQCNMLFKTGSFNEVLNGEIIKGNINRLEGRLNFIDQVDHYNRLRQHPALEAKYQSKKEALHLRNMAKLRRHLHNGRENTFSKFIFYRLFYANETPTVLTEGKTDNVYMKAAIHMLASSYPQLAQENNGSTPYKLLMKFVEYSERTRYLLELFGGADYLKTFVMHYRQHYKYYKAPKADNPVIILVDNDEGPKDLINYVNGIKSKHVYPTSSKDIRSADFVHIFHNLYLVMTPRGNNNQHTDIEYFFKDFDRLRKYQGKCFNTISKRNPNTDLSKDSFANHIIHAHKKSIDFSGFDAILNRILLAIDHYKSRK

SEQ ID NO: 1083 - protein, 616 aa, unidentified
  source 1..616: note = Related to NZ_FNXF01000003.1; note = Rheinheimera pacifica
MQKIEALRKITTKPELAALLGIKASVLTYALYIVKPQNQYIQFKIKKKNGGERLISAPTDKLKSIQSALSDLLLDCLDEIYKSKFPDSEIAKQKLKHSKVLKIKIGSAKNKQPSLSHGFERNRSIITNAIMHIGKKNVLNIDLEDFFGSFNFGRIRGFFIKNENFKLDSNIATVIAHIACCNKELPQGSPCSPVITNLIAHSLDIRLAALAKKHSCTYTRYADDITFSTREDTFPESVMRQEGGGYIAGKKLRSEIRRAGFSIKESKTRIQYADSRQDVTGLIVNQKPNVKREYWRTVRAQCNSLFKTGKFVEVAGEEQTVGNINVLEGRLNFIDQLDHYNRLRQKPALDPNYHLKRDALVQQKKAKQRSHLLNSREKVFSKFLFYRYFYAFDKPLILTEGKTDNTYLKSAIWKLAAHYPKLAKAKSNTSAYELLLRFFNYTERTNFLLELAGGGDYFKDFASGYAENYKKYKAPRPEHPVIIIVDNDSGPKDLVNLIATKKIGSIYPTNPAHSNVDVRNSDFVHLFHNLYIILTPLSAGSSSSDIELLFKDVDRLRLYKGKSFNTATKRDNSKDLSKEAFATHIVSAQKNIVNFDGFKELLDRVVSVINHYDSVK

SEQ ID NO: 1084 - protein, 615 aa, unidentified
  source 1..615: note = Related to NZ_JYNJ01000140.1; note = Thalassomonas viridans
MRKLNSLAQITTKAELAALLGIKTSFLTHCLYVIKPANQYTQFKIAKKNGGERTINAPTNRLKSIQSALSHLLLDCLDELNRKKYPASELAKSSAQHSHILKVKCSNTKTKQPSLSHGFERKRSIITNAMMHTNKKNVLNIDLKEFFNSFNFGRVRGFFIKNDNFKLDPHIATVIAQIACYNNELPQGSPCSPVITNLITHSLDIRLALLAQKHSCTYTRYADDITFSTRESIFPPQIMREENGQFIAGKKLRSEIRRSGFSINNKKTRIQLKDSRQDVTGLVVNQKPNTKKEYWRIARAQCNNLFNTGAFTKTVNGETIKGNVRELEGQLNFIDQLDHYNRLRQKSPLNPKYHLKKDEIIKQKKAKQRSYLFSGREKTFSQFLFYQFFYASDKPTILTEGKTDNVYLKTAINILAANFPDLAKTKTVTTPYELLLRFVEYSERTKFLLELHGGTDYLKHFIMGYESKLKRYKAPKPKHPVIIVIDNDTGPQGLLHYVANISSAIISPNSLILKQDYRKADFIHIFHNLYIVLTPRGAGNTHTDIEYFFKDIDRLRTYKGKCFNTVANRDEERDLSKDAFAKQIIKAQKKVVDFSNLKPLLERFVMVIKHYSTIN

SEQ ID NO: 1085 - protein, 635 aa, unidentified
  source 1..635: note = Related to JAHVIP010000004.1; note = Marinobacter daepoensis
MTKLELLQAAKTKSDLASILNIPPRALTYRLYKIRPESQYHTFSIPKKTGGSRTIRAPEKELKNIQSALSNLLLDCLDEINKKRFPNSELASPKARHARTLKVKCNSARQKQPSISHGFERNRSIITNAMMHIGQKNVLNLDLANFFESFNFGRVRGYFLKNENFKLTPEVSTTIAQIACTDNSLPQGSPCSPVITNLITQSLDIRLAALANRHSCIYTRYADDITFSTRKKSFPSQIIRNSQGIQTLGKKLASEIRRSGFSVNPKKTRVLYHSSRQEVTGLVVNQKPSVKKDYWRLVRAQCHQLFTHGSYLEEVDDNFVTGSITELEGKLNFIDQIDHYNRLREKPPLDPRYHYKKDALAKSSSSKSREYLFNNREKTFSQFLFFKYFYANSTPTILTEGHTDNIYLKTALLQLSSNYPSLTKGSPPKLSCHLFNYTERTKFLLELAGGTDYLKSFVEKYNTRYEKYNAPTPTQPVIIVVDNDSGPSSLLHSLKKYDQAKLFPTNLKISDINDVKKSEFIWIFHNLYLVLTPLKGKNDTDIESLFKEKERLRKHNGKCFNTVEKRNEEKDLSKDSFARNIIRANRKSIDFSNFHGLLNRITAVQKHYEGIKNDNGSKDIQPFLATLLKPSQSPP

SEQ ID NO: 1086 - protein, 612 aa, unidentified
  source 1..612: note = Related to NZ_VMHP01000002.1; note = Marinobacter halotolerans
MGRLDELRAVKTKSELAKLLGIKPSFLTYQLYVVGLASQYKNFHIPKKSGGLRSITAPDAKLKSIQSALSNLLLDCVDEINKETFPRSELANEKAQHAKVLKIKCNSARTKQPSLSHGFERKRSILTNAMVHVGQKNVLNIDLQDFFASFNFGRVRGFFIKNREFSLTPEIATTIAKIACFNNELPQGSPSSPVITNLITHSLDIKLAGLAEKYSCLYSRYADDITFSTREETFPHQIMRETRGEYQPGKRLRSEIRRSGFTINNKKTRILYRSSRQDVTGLVVNQKPSVKKEYWRTARAQCHSLFRTGKFTKSTDGQIFEGNINELEGQLNFIDQVDHYNRLRQKPALNPRYHLKKDELSKNKDSKKKRQYLLNSREKTFSKFLFYRIFYANTKTTILTEGKTDNTYLKSAIRELSHSYPSLAKPNPYELQCQFLNYSERTKFLLELHGGGDYFKSFVESYLEKFRGFTAPKPNHPVIIFVDNDKGPQELISRIKGLKGVQIHPIHLDIQKDIRQAEFLHLRANLYLILTPQTSSLGETDIEYFFKDKDRLRQHNGKSFNTVKKRDEAKDLSKAAFAQHIVKSQKKSIDFSDFTLLLDRIVAVQNHYDSIK

SEQ ID NO: 1087 - protein, 610 aa, unidentified
  source 1..610: note = Related to JAHMIN010000032.1; note = Hahella sp.
MSRLENLRAVVSRPQLANLLGIRPSFLTYTLYVRGVSSQYCKFSIPKKAGGKRYIKAPQKELKYIQSALSTLLLDCLDEINKEKFPKSELVSPKAEHSKTLKVKCNSARVKQPSLSHGFERQRSIITNSMMHLGKKNVLNIDLKDFFQSFNFGRVRGFFIKNEYFKLDPTIATTIAQIACYDNQLPQGSPCSPVITNLIAHSLDIRLARLAKKYSCTYSRYADDITFSTRERIFPPQLMREDDGIYTPGKRLKSEIQRSGFSLNDRKTRILYRDSRQDVTGLVVNQKPNVKKEYWRTVRAQCHWLFNIGAFTMVVDGKDIEGNINALEGKLNFIDQLDHYNRLRQKPALNPKYQLKREVKGRDSLKARRYLFSAREKTFSQFLFYRLFYANDKPTILTEGKTDNIYLKSAIQSLAASYPKLAIENPYQLLCHFVSYTERTRFLLELYGGADYLKGFIDSYKDNFEMYKAPKPRHPVIVFVDNDSGPKDIISRVNGLGEASVFPPKIEKVKDVRKADFTHLMKNLYLVLTPRSEADKDTDIEFFFKDEDRLRKFNGKYFNTVDNRDETKDLSKEAFARNIVKFQRKSIDFSKFTSLLDRVVAVIDHYETIK

SEQ ID NO: 1088 - protein, 609 aa, unidentified
  source 1..609: note = Related to CP091442.1; note = Pseudoalteromonas sp.
MSKLAKLRAAKTKPELADVLGVHPSFLTYTLYVRGTNSLYTSFNIPKKSGGVRTIQSPDSGLKSIQSALSNLLLDCIDEINLANFPDSELASPKASHSNILKVKCNSAKTKQPSLSHGFTRHRSIITNAMMHVNKKAILNIDLKDFFSSFNFGRVRGFFIKNKNFELDDNVATTIAQIACHDNELPQGSPCSPVITNLITHSLDIRLADLARKNSCTYSRYADDITFSTGKRKFPSEIVSEENGICALGKKLKSEVRRSGFSINSKKTRVLYKDSRQDVTGLIVNKKPNIKAEYWRTVRAQCNLLFKTGKFYDLINNKEVEGNIYELEGKLNFIDQLDHYNRLRQKPALNPQYHRQKDALAKGGNQKQRRYLYNNREKTFSNFLFYKLFYANPLTMILTEGKTDNIYLKAALSRLATAFPSLAKSQPYEPLCQFFKYTERTRFLLELHGGGDYFKSFVGSYEERYRLYKAPKPANPVIIFVDNDTGPDQLISRIKGMKGIGIYPTSLNKGDIRKSDFVHISNNLYLILTPQSNTGDNTDIEYFFTDFDRKRPYNGKCFNTVKLRNDNVDLSKDAFSRHIVQAKKNVIDFSGFHKLLERIVLVQNHYKTL

SEQ ID NO: 1089 - protein, 606 aa, unidentified
  source 1..606: note = Related to BLIJ01000065.1; note = Alteromonas sp.
MSRLDRLKAVNTKPQFARLLGIHPSLLTYTLYKKRPEHCYHEFKIPKKSGGKRTINAPDEKLKSIQRALADLLLDCLDEINAVYFPSAETLKPKAKHADILKVKCNSALSKQPALSHGFERKRSILTNAVMHLDKKHLLNIDLKDFFPSFNFGRVRGFFIKNNHFKLHPSTATLIAQIAILNNELPQGSPCSPVIANLITHHLDIRLASLAAKYSCTYTRYADDITFSTRRAAFPRQIMNEKDGGYIPSKRLASEVNRAGFRINSQKTRILYRDSRQEVTGLVANKKVGVKKEYWRTLRAQCHSLFTTDSFTKIVDGKKVEGNINELEGQLNFVDQVDRYNRLRQKQPLNPLLALRSEQKNGDKKSKRHLLNNRERTLSDFLFYKLFISNSKTTILTEGKTDNTYLKSAIQALAKRFPTLAETKPYQPLVQFMNYSERTRFLLELFGGCDYLKAFAENYSSRRKKYLKEKPTSPVILLLDNDQGPKDLINRFSKDKSITLLPSTSKNIRDAEFVHVCDNLYLVLTPISPKRKETDIEYFFMAKTRLLKDSKTGKCFNTISKRDEKRDLSKEAFAQLVKTNKGSINFSRFGPLLTRITKVQKHYAAL

SEQ ID NO: 1090 - protein, 618 aa, Vibrio sp.
  source 1..618: note = Related to NZ_CP016347.1; note = Vibrio natriegens
MSKLKYLKSVSTKPGFAKALGVDAVFLTRCLYINQPETQYHQFSIAKKSGGKRVITAPSDELKSLQKRLSILLLDCIDEINATKYPNSQRARPKLRKNGDPDYAAEVLKIKVPTTEIKQPSLSHGFVRERSIITNAMMHVGKKHVLNIDLKDFFDSFNFGRVRGFFIKNVNFQLDPHIATVIAQIACFDNKLPQGSPCSPVITNLITHALDIRLASLAKKYKCTYTRYADDITFSTRKADFPPQIMRQDTDGYIAGKKLRSEIERAGFAMNTSKTRIQYKDSRQDVTGLVVNKKPNTKKEYWRLARAKCNQLFKTGKFTTIHDGNEIEGNLNELEGQLNFIDQVDHYNRMRQKAPLSMEYEHKKVTKSTRNILTGRERTFSQFLYYRLFCGNDKPTILCEGKTDNVYLKSAISELSTSYPQLSVTKDGKYELLVRFVEYSKRTRFLLELFGGADYLRGFIDNFEKNMRLYDKVKPKHPVIVFLDNDEGPKQIVNLLKQKSFQDKIELIPSSMNKMDDIRSSEFIHVVKNLYVIFTPLTEDGKETDIEYFFDEKTRLFKHPKNGKCFNTISKRNSKKDLSKEAFATHVIKEKKKDVNFNGLKPLLDSIVKVINHYDSIK

SEQ ID NO: 1091 - protein, 617 aa, unidentified
  source 1..617: note = Related to AAXY01000057.1; note = Marinobacter sp.
MSKLRHLKSTSSKPGFAKVLDVDAAFLTRCLYIKKPETQYHQFSIAKKSGGTRVINAPSEELKSLQKSLSKLLLDCIDEINATKYPNSQWSKPKLRKNGETDYAAEVLKIKIPTAETKQPSLSHGFVRERSIITNAMMHVGMKHVLNIDLKDFFDSFNFGRVRGFFIRNANFQLDPHVATVIAQIACYDNKLPQGGPCSPVITNLITHSLDIRLASLARKYKCTYTRYADDMTFSTRRADFPAQIMRQSSNEYLAGKRLRREIESAGFAINSNKTRVQLKNSRQEVTGLVVNRKPNTKKEYWRLARAKCNHLFKIGRFTVAKNGNNVEGNLNELEGQLNFIDQVDHYNRMRQKAPSIPEYASSKIGKNTKNLLTGREKTFSQFLYYRLFYGNDKPTVLCEGKTDNVYLKSAISELNKYYPLLVDVKDEEYDLSIRFVRYSKRTRFLLEIFGGADYLRGFIDNFEKNVKLYEAIKPKNPVIVFLDNDEGPQQIVKLLSTERFQKKIEIIPSKLNKKNDIRKSHFIHVVKNLYVVFTPLTHEGKETDIEYFFNDKARLIKHSNGKCYNTVKNRDAKKDLSKDAFATHIIKENKKSIDFEGLKPLLNSIVNVINHYEKIK

SEQ ID NO: 1092 - protein, 617 aa, Vibrio sp.
  source 1..617: note = Related to JXXT01000002.1; note = Vibrio nigripulchritudo
MSKLNRLRLISTKPSFARILGVDAAFLTRCLYINKPENQYHQFPVKKKSGGERIIHAPSDELKSLQKCLSILLLDCIDEINAKKYPHSQHVKPKLRKNGEPDYAAEVLKIKIPSALSKQSTLAHGFVRDRSIITNAMMHVGQRHVLNIDLKDFFGSFNFGRVRGFFIKNAHFQLDPHIATVIAQIACFDNKLPQGSPCSPVITNLIAHSLDIRLASLAKKYKCTYTRYADDITFSTRQAEFPAGLMKQDANCYVPGRKLKSEIERAGFYINGNKTRIQHKDSRQEVTGLIVNKKPNIRKEYWRLVRAKCNQLFKTGKFTSKEEEKEVEGNLYELEGQLNFIDQVDHYNRLRQKSPLSNEYAVNKVGKNTRLILTGREKTFSQFLFYRMFCGNEKPTMLCEGKTDNVYLKAAISSLKGNYPQLARVSGEKYELLVRFVEYSKRTRFFLELFGGADYLRGFIDSFERNMKIYNSIKPVNPVIIFLDNDKGSQQIVNLLTSKTFVNRIKLFPVTLDAKQDIRKSEFIHIVKNLYVIFTPLTNTGNETDIEYFFDEKTRLMKHSNGKCFNTLQNRNSKADLSKDSFATHIVKEKKKDIDFIGFKSLLDSIVKVINHYDSLK

SEQ ID NO: 1093 - protein, 617 aa, Vibrio sp.
  source 1..617: note = Related to NZ_CP046804.1; note = Vibrio cidicii
MSRLKRLKSASTKPEFAKVLGIDAAFLTRCLYINKPENQYHQFSIPKKSGGERLINAPSEELKSLQKNLSILLLDCIDEINSEKYPDSQWSKPKLRKNGDPDYAAEVLKIKIPNAQVKQPSLSHGFVRERSILTNAMMHVGKKNVLNIDLESFFDSFNFGRVRGFFIKNANFNLDPHIATVIAQIACFDNKLPQGSPCSPVITNLISHTLDIRLASLAKKYNCTYTRYADDITFSTRKSEFPPQIMRQNESGYVPGRLLKSEIKRSGFSINSSKTRIQYKNSRQDVTGLVVNKKPNVKQEYWRLARAKCNQLFKTGKFTTIKDGNEIDGNLNELEGQLNFIDQVDHYNRMRQKTPLSTDYTHTKVGKNTKVILSGREKTFSNFLYYRLFCGNEKPTILCEGKTDNVYLKSAISELSKDYPQLAHRKGNKYELLVRFVEYSKRSRFLLELFGGADYLRGFVDNFEKNMKLYDAITPKHPVIVFLDNDEGPQQVVNLLKSKNFQKKIELIPSTLDKKEDIRKSEFIHVIKNLYIVFTPLAKDGGETDIEYFFDDKTRLMKLPNGKCFNTVKNRDSKNDLSKDAFATHIVKENKTKIDFNGLKPLLESVVKVINHYDSLR

SEQ ID NO: 1094 - protein, 617 aa, unidentified
  source 1..617: note = Alteromonadales bacterium TW-7; note = Related to AAVS01000020.1
MSKLKRLRSASTKPQLARVLEVDAAFLTRCLYINKTQNQYHQFSIAKKSGGTRLINAPSKELKSLQKKLSILLLDCIDEINAEKYPRSQLVKPKLRKNGDPDYAAEVLKIKISTAETKQPSLAHGFVKERSILTNAMMHVGKKNVLNIDLNDFFDCFNFGRVRGFFIKNENFKLDQHIATVIAQISCFDNKLPQGSPCSPVITNLITHSLDIRLASLAKKHKCTYTRYADDITFSTRLSEFPAQIMWHDSTTYRAGKALRKEISRSGFSINNSKTRIQYKDSRQNVTGLVVNKKPNIKQEYWRLVRAKCNKLFKTGKFTVVEDGEKKDGNISELEGQLNFIDQVDHYNRMRQKPPLSTDYSHNRVGRGTRSILNGREKTFSKFLFFRLFYGNQKPTILCEGKTDNIYLKSAISELSQSYPQLSSSKGDDYELLVRFVKYTKRTRFLLELFGGADYLRGFIDNFEKNTKAYAKITPEHPVIIFLDNDEGPNNIVKLLRDKGFQKKINLVPPTLDKSEGIRKANFIHVVENLYIIFTPLTPDGKETDIEYFFDDKTRLMKHPNGKCFNTLQKRDSKVDLSKDAFSTHIIKEKKKQIDFNGLRPLLDSVVNAIDHYNSVK

SEQ ID NO: 1095 - protein, 619 aa, unidentified
  source 1..619: note = Related to PYOV01000005.1; note = Photobacterium angustum
MSKLNRLRIASSKPDFAKVLEVDSSFLTRVLYINKPESQYHKFTIAKKSGGLREISAPSIELKSLQKSLSKLLLDCIDEINAKKYPYSQLNKPKLRKNGENDYAAEVLKIKIPTSSIKQPSISHGFVRDRSIITNAMMHLGKKNVLNIDLEDFFGSFNFGRVRGFFIKNKNFRLDPHIATIIAQIACYDNKLPQGSPSSPVITNLITHSLDMRLASLAKKFKCTYTRYADDITFSTRLIEFPAQIMKQNEDGYIAGKILRREIKHAGFSINESKTRIQYKNSRQDVTGLIVNKKPNTKKEYWRLVRAKCNHLFKTGYFVSIVDGKEIKGNINELEGQLNFIDQVDHYNRMRQRAPLNPEYARSSVGKHTRNLLTGREKTFRNFLFYRLFCGNDKPTILCEGKTDNIYLKSAISELVKEYPQLARKKASEYELLVRFVEYSKRTRFLLELYGGTDYLRNFIDSFEANMKVYSNIKPKNPVILFVDNDKGTSNIKNLLSSKSFIKKIKISPSSIDKNEQIRKSQFIHVVKNLYVVFTPLASNDDFTDVEYFFDDKARLMKHSNGKCFNTVRNRNDNKDLSKDAFATHIVKENKKNIDFTGFKPLLNSIVEVINHYESIKKA

SEQ ID NO: 1096 - protein, 617 aa, Aeromonas sp.
  source 1..617: note = Related to NZ_CP024930.1; note = Aeromonas veronii
MSKLQSLKSISSKPELAKLLGVDAAFLTRTLYIVRPENQYHQFTIDKKSGGKRVINAPSEELKSLQRKLSNLLLDCIDEINKIKYPTSQLAAPKVRENGDIDYTAKVLKIKIPSSKSKQPSLSHGFSRKRSIITNAMMHIGKKNILNIDIENFFDRFNFGRVRGYFIKNNDFKLDPHIATVIAQIACYDNKLPQGSPCSPVISNLICHSLDINLSSLAKKYKCTYTRYADDITFSTRKSEFPKKIAEQNEGYYTLGNELLYEIKRSGFSVNNGKTRIQYKNSRQDVTGLVVNKKPNTKKEYWRLARAKCNALFKTGTFTTIEDGVSVIGNLDELEGQLNFIDHVDHYNRLRQKAPLSPEYSLKTIGKSTNILLSGREKTFSQFLYYRLFYGNEKPTILCEGKTDNIYLKSAISELMAHYPSLAIKTDGKYELLIRFVEYTKRTRFLLELFGGTDYLKGFIENFHKNMAPYKNLKPKNPVIIFLDNDTGPSNIVSLLQGNKFQKMITLIPSHLDKKDDIRKSEFIHVMDNLYVIFTPLGNSGEETDIEYFFDDKTRLMKHSNGKFFNTVEKRDTKNDLSKDAFATHIVKEKKKSIDFTGLKVLLDPIAKVIEHYKNIK

SEQ ID NO: 1097 - protein, 617 aa, Aeromonas sp.
  source 1..617: note = Related to JAHUWA010000001.1
MLNLERLKQISTKPDFAKLLGVDAAFLTRTLYIVKPDNQYSQFTIDKKSGGKRIINAPSDELKSLQKKLSNLLLDCIDEINAKKFPKSQSIKPKLRKNDENDYAAEVLKIKIPTSESKQPSLSHGFVRERSIITNAMMHIGKKNVLNIDLENFFDSFNFGRVRGFFIKNNNFKLNDHIATVIAQIACYENKLPQGSPCSPVISNLITHSLDIKLAFLARKYKCTYTRYADDITFSTRKDDFPNQLARHDGNTYILGKKLLREIKSSGFSVNNNKTRIQFKNSRQDVTGLIVNKKPNTKKEYWRLARAKCNTLFKTGTFTSIKDNVEVKGNLNELEGQLNFIDHVDHYNRLRQKPPLVPEYTLKTIGKSTRILLSGREKTFSQFLYYRLFCGNEKPTILCEGKTDNIYLKSAISEMKKDYPLLADTKDDHYELLVRFVEYTKRTRFLLEIFGGADYLRGFIDNFEKNMKTYENVRPKKPVIVFLDNDTGPDKIVNLLQGKGFQDKITLIPSHLDKSCDIRRSEFIHITKNLYVIFTPRGSAGEETDIEYFFDEKTRMMKHSNGKFFNTIKKRDTKSDLSKDAFATHIIREKKKNIDFKGLKPLLDSIIKVINHYDDIK

SEQ ID NO: 1098 - protein, 615 aa, unidentified
  source 1..615: note = Related to NZ_MUNJ01000002.1; note = Plesiomonas shigelloides
MSKLKLLRKITSKPELAKLMGIAPVFLTKCLYVTRPEHQYHQFQIDKKSGGKRTISAPSEELKSLQKKLSLLLLDCLDEINSEKFPYSQVPSPKKRNNGDDYSANKLKIKIPSAKTKQPSLSHGFERNRSIITNAMMHIGKKNILNIDLADFFDQFNFGRVRGFFIKNKYFNLDTHIATVIAQIACYDNKLPQGSPSSPVITNLITHSLDIRLLSLAKKYKCNYTRYADDLTFSTRLDDFPEQIMKQVDGEYIPSSKLLHEITRSGFTINNKKTRIQFKSSRQDVTGLVVNKKPNVKSEYWRQVRAKCNSLFKTGEFFSIKNGKIIEGNINELQGQLNFIDQVDLYNRLRQKPPLQPEFELKKLGTSTKQILSSRERTFSQFLFYRLFIGNDRPTILCEGKTDNVYLKSAINSLKGDYPSLAKMEDGKYNLLINFVEYSKRTKFLLELSGGASYLRDFILNYEKNFKIYKDHSPKYPVIIFLDNDSGANTIINLLQQREWQRKISLSPNTLDKKDDIRKSNFIHVEYNLYVILTPRTPIGGDTDIEYFFDDKTRLLAHSNGKCFNTVSKRNPNTDLSKEAFATHIIKEKKNSIDFTSMKPLLNLIVDVVTDYNTR

SEQ ID NO: 1099 - protein, 336 aa, Pseudomonas sp.
  source 1..336: note = Related to DOLN01000112.1
MSRLDKLRSTSTKSGFADVLGVSAVFLTRCLYINKPENQYHQFTIDKKTGGKRVINSPSKDLKSLQKSLSDLLLDCVDEINSKKFPKSQLASPKLRKNKEPDYAAEVLKLKIPSANSKQPSLSHGFVRKRSIITNAMMHVGSKYVLNIDLQDFFDSFNFGRVRGFFIKNRNFQLNPDVATVIAQIACYDNKLPQGSPCSPVITNLISHSLDIRLASLAKKYKCTYTRYADDITFSTRMPTFPVQIMAQQDGCYYPSKALIGEIERAGFFVNNKKTRILYEDSRQEVTGLVANKKPNTKKEYWRTVRAKCDTLFKTGNFSTVIDGKKVEGNLNELEG

SEQ ID NO: 1100 - protein, 617 aa, unidentified
  source 1..617: note = Related to JABSPA010000005.1; note = Colwellia sp.
MSRLEHLKSITTRPSFAKALGVNPSFLTRCLYIIRPENQYHQFEIKKKSGGKRIIKAPSVDLKSLQKKLSDLLLDCIDEINASKFPKSQLASPKMRNKKDLDYAAKVLKIKIPGAESKQPSLSHGFVRDRSIITNAMMHLGKKNVLNIDLENFFDSFSFGRVCAFFMTNRNFNLNKKIATVIAQIACYERKLPQGSPCSPVITNLITHSLDIRLAVIAKKYKCTYSRYADDITFSTNKSTFPYQIMNQYADAYIPGKELIWEIERAGFSINDKKTRIQYKDSRQDVTGLIVNKKPNTKKEYWRTARAKCNSLFKKGKFTSIKDNVETDGNINELEGQLNFIDQVDHYNRMRQKAPFIPEYTIKNHGKNTKLLLSAREKTFSHFLFYRLFYGNDKPTILCEGKTDNVYLKSAISELQANYPSLATIKDKKYKLLLRFVEYSKRTRFLLELFGGADYLRGFIDNFEKNTKQFEAPKPQHPVIIFLDNDEGPQQIVNLLQSKSFHNKISLFPDGLDPKKDIRKATFLHITLNLYVIFTPLNSSGKETDIEYFFDRKTRLMKHSNGKCFNTVRKRNSRTDLSKDAFATHIVKAQKKRINFKKFKSLLDPITKVIEHYKTLK

SEQ ID NO: 1101 - protein, 616 aa, unidentified
  source 1..616: note = Related to NZ_CP048031.1; note = Shewanella sp.
MSQLNYLRRISTKPSFAKALGVDPRFLTRCLYIIKPENQYHQFTIEKRSGGKRIINAPGDDLKSLQKKLSDLLLDCIDEINISKYPSSQLAKPKMRNKKDLDYAATVLKIKIPTAESKQPSLSHGFVRERSIITNAMMHLGKKNVLNIDLKNFFDSFNFGRVRGFFIKNNNFKLDPHIATIIAQIACYDNKLPQGSPCSPVITNLITHSLDIRLAKLAKKYKCTYSRYADDITFSTRKSTFPKEIMNEDIDGYTPGKKLVGEIVHAGFSINHNKTRIQFKDSRQEVTGLIVNKKPNTKKEYWRTARAKCNNLFKKGKFTSIEDGFEIDGNLDELEGQLNFIDQVDHYNRMRQKAPLTAEYAINNIGKNTKNLLSARESTFSRFLFYRLFYGNDKPTILCEGKTDNVYLKSAISELLPKYPSLARIEDNNYKLLVRFVEYSKRTRFLLELFGGVDYLKDFINNFEKNTKCYTAPEPKHPVIIFLDNDDARIPNLLKGKSFNKKVTLFPSSLNSIDDVKKADFIHIFQNLYVVFTPLGKSGEDTDIEYFFHKKTRMIKHSNGKFFNTVDKRNPEVDLSKDAFAMHIIKAQKKSINFTRLKPLLNRIVKVTEHYDQIKK

SEQ ID NO: 1102 - protein, 617 aa, unidentified
  source 1..617: note = Related to JAHKRD010000030.1; note = Shewanella sp.
MSKLKYLKSISTKPSFAKALGVDPRFLTRCLYITRPENQYIQFTIDKKSGGKRIINAPKDDLKSLQKKLSIMLLDCIDEINISKYPSSQLAQPKMRNKNDLDYAAEVLKIKIQSTESKQPSLSHGFVRKRSIITNAMMHLGKKSILNIDLEDFFGSFNFGRIRGFFIKNENFKLDPHIATIIAQIACYNDQLPQGSPCSPVITNLISHSLDIQLAALAKRYKCTYSRYADDITFSTRRSTFPSEIMNYESDSYVPGRKLIREIKRAGFSINEKKTRIQYKDSRQDVTGLVVNKKPNTKKEYWRIARAKCNVLFKTGKFSSISNGIEVEGNINELAGQLNFIDQVDHYNRMRQKAPFTPEYSPRVIGKNTKVILSGREVTFSRFLFYRLFYGNNKPTILCEGKTDNVYLKSAISELIADYPTLAKIEDKKYELQLHFVEYSKRTRFLLELFGGADYLKGFIDNFEKNTLPFKAPLPQHPVIIFLDNDKGPEKIKQLLQGKTFNEKISLFPKGLDPKTDVRKANFIHVIKNLYVVFTPLKNTGEDTDIEYFFDSKTRLIPHQNGKFFNTIENRNSTTDLSKEAFATHIIKSKKKNINFKGLKPLLDRIVEVIEHYNTIK

SEQ ID NO: 1103 - protein, 618 aa, unidentified
  source 1..618: note = Related to NZ_SEUL01000049.1; note = Pseudoalteromonas fuliginea
MPRLTHLKTVSSKPGFARALNVDPRFLTRCLYVVRPENQYHQFSIDKKSGGQRLINAPSDDLKSLQSSLSNLLLDCIDEINKNKYPESQIASPKMLSPKKKDHIAEVLKIKIPSSEHKQPSLSHGFVRERSIITNAMMHLGKKNVLNIDLKDFFDSFNFGRVRSFFIKNINFRLDPSIATMIAQIACYKDTLPQGSPCSPVITNLITHSLDIRLASLAKDYKCTYTRYADDITFSTRKSVFPPQIMRGKVDDNHGYIPGEKLTNEIKRAGFLINHKKTRIQYKDSRQDVTGLIVNQRPNTKKEYWRTVRAKCNFLFKTGEFTSIKNDIVVAGNINELEGQLNFIDQVDHYNRIRQKSPLKPELALKNVGSNTKLLLSGREKTFSQFIFYRLFYGNDKPTILCEGKTDNIYIKSAISELVISYPKLARVAKNEYKLLVRFVEYSKRTRFLLELYGGASYLKDFIVNYRTQFKKYKAAKPQHPVIIIIDNDAGPKDAGIFGYISNQKEAKIYPQTLDLKKDLRSANFVHLFHNLYIVMTPKGIKDCDTDIEYFFTDKDRLREHSKKCFNTVAKRNADKDLSKGAFATHIIKAQKKNINFNGLKPLLDRIMMAIDHYDINK

SEQ ID NO: 1104 - protein, 619 aa, unidentified
  source 1..619: note = Related to NZ_CP011029.1; note = Pseudoalteromonas espejiana
MLSRLKNLKGAATKPQLASILNVSPVFLTKCLYIIKPENQYHQFEVNKKSGGKRVITAPSEDLKGLQSKLSELLLDCIDEINTLKYPDSQLVSPKKNISKKNDPSAEVLKVKISNAAIKQPYLSHGFTRQRSILTNAVMHLGQKSVLNIDLENFFDSFNFGRVRGFFIKNKNFELSPSIATVIAQIACYKDTLPQGSPCSPVITNLITHHLDIRLASLAKRYKCTYTRYADDITFSTRLSVFPPEIMCDSLNGFAPGKRLKRAIKHAGFSINERKTRIQYKNSRQDVTGLIVNKKPNVKSEYWRTARAKCNSLFNTGHFITNKNGRSVEGNINELEGQLNFIDQVDHYNRMRQSPPLSPEYSLKNYGKRTNGLLSGRETVFSKFLFYRLFYANEKPTILCEGKTDNVYLKSAINQLHNQYKQLVNIGDEYKLLVRFIEYSKRTRFLLELYGGADYLRGFIDTYAVKSKIYNAPKPENPVIIFIDNDDGPKQIETLLQSRNFNKKTTLVPNTLDPKKDVRKAEFIHVIDNLYVVFTPRGDQDEDTDIEYFFGDDARLRKHTNGMFFNTVQNRDPLKDLSKEVFATQIIKAQKKHINFNGLIPLLDRIVNVINHYDSVKGL

SEQ ID NO: 1105 - protein, 380 aa, unidentified
  source 1..380: note = Related to NZ_RRZA01000072.1; note = Pseudoalteromonas prydzensis
MSRLKYLKVAKTKPQLADVLGVSPVFLTKCLYVVKPENQYHQFEIDKKSGGKRKITAPKTELKSLQSKLSELLMDCIDEINKSKFPNSQQVSPKKNIQQKKDPAAEVLKIKISNSAIRQPSLSHGFTRQRSILTNAVMHLGQKNVLNIDLENFFDSFNFGRVRGFFIKNKNFELSPSIATVIAQIACYKDTLPQGSPCSPVITNLITHHLDIRLASLANRYKCTYTRYADDITFSTRLSIFPPEIMRDTLNGFAPGKRLKRAIKHAGFSINERKTRIQYKNSRQDVTGLIVNKTLGVKSEYWRTARAKCNSLFNTGSFTTERKGELVEGSINELEGQLNFIDQIDHYNRIRQKAPLQPEYSIKKVGKETRRLHSGREKNF

SEQ ID NO: 1106 - protein, 629 aa, unidentified
  source 1..629: note = Related to JAEMUI010000038.1; note = Marinomonas spartinae
MSKLNYLRSISSKPEFAKALNISPKFLTHTLYVVRPENQYHTFNIDKKSGGQRTINAPSDELKSLQAALSNLLLDCVGEINASKYPKSQLASPKLKNNKIDSDYSAEVLKIKISNSAIRQPSLSHGFTKDRSIITNAMMHIGKKNILNIDLENFFDCFNFGRVRGFFLKNKNFQFNPEIATVIAQIACYENKLPQGSPCSPIITNLIAHSLDIQLASLARKYKCTYTRYADDITFSTNLSTFPTEIMAEEKGIYTSGKKLKNEIERAGFSINDKKTRIQYKNSRQDVTGLVVNKKPNVKNEYWRTVRAKCNSLFKTGRFMTTKNGVEVEGNINELEGQLNFIDQIDHYNRMRQKPPLVSEYAIKKIGINDHSTKELLTGREKTFSQFLYYKSFYGNDKPTILCEGKTDNIYLKSAISELAINYPNLASFTSEISKKGIPYKKYNLLVNFFEYSRRTRFFLELFGGVGDLKKIILNFEKSQRKYQCSNPKNPVIILLDNDTGPKDIVALLQRKPLVNKITLVPQGLDPKTDVRKAQFIHVTRNLYVIFTPLDPSGNATDIEYFFDDKTRLMKYSGKCFNTVKNRNGTTDLSKDNFATHIVKAQKKGVDFNGLKPLLDSIVSVIKHYDTIK

SEQ ID NO: 1107 - protein, 621 aa, unidentified
  source 1..621: note = Related to NZ_UATK01000001.1; note = Photobacterium damselae
MTKIELLRKATHKRELAALLGCTTSALTYVLYILKVDTQYKQFEIDKRNGGKRIITAPTDRLKRLQASLSNLLLDCIDDINRIKYPNSQVNSPKLINKKFKDASADILKVKISNAKTKQPSLSHGFVRERSIITNAMMHLDKKNVLNIDLHNFFDSFNFGRVRGFFISNENFKLDPNIATVIAQIACYDNKLPQGSPCSPVISNLITHSLDIRLASLAKKNSCTYSRYADDITFSTRKSVFPTKIMRQEDGEYIPSKKLRNEIKKSGFTINNKKTRIQYKDSRQDVTGLIVNKKPNVKKEYWRTVKSQCHSLFQTGAFTKKVGDDIVEGNINELEGQLNFIDQVDLYNRLRQKKPLNPVYKHATHGYNTSILLSGRERTFSRFLYFTLFYGNTKPTILCEGKTDNVYLKSAINKLAATYPALAQAKTPNKEYELLIRFLEYSKRTRFLLELYGRTSYLNYFIGKFDKNFKFYKAPTPQHPVIIILDNDSGFVGKKDSGIAGKLKKIDSATAYPTTLKKDDFRNADFIHVIHNLYIVLTPLGTAKETAIEDLFDDETRQVKVSGKSFNHKDDRDNAKEYGKEVFAQKVIKAHKSSINFDGLKPLLDRVVQAIEHYDTISAAK

SEQ ID NO: 1108 - protein, 614 aa, unidentified
  source 1..614: note = Related to NZ_CP012737.1; note = Pseudoalteromonas sp.
MTKLEALKKITTKKELAALLGVKTSFLTYTLYFIKPHTQYTQFKIPKKNGGERIISSPNGKLKTLQKKLSILFLDSIDEINKAKFPEAEAFKNINDKIMYSPILKVKIGSAKIKQQPSLSHGFVRNRSIITNAMMHLGQKNVLNIDLSNFFDSFNFGRVRGFFIKNDHFKLDPAIATVIAQIACYDNKLPQGSPCSPVITNLITHSLDIRLASLAKKNSCTYSRYADDITFSTRKKSFPSNIMSELSGEFTPSKKLSFEIKRAGFSINNVKTRIQYKDSRQDVTGLIVNKKPNTKKEYWRTVRSQCNKLFKSGKFTKTVNDKVEDGNINELEGQLNFIDQVDSYNRLRQAVPINHNYATSKHGHNTSKLLSGRERTFSRFLYYRLFYGNDKPTIICEGKTDNVYLKSAINRLMTGYPTLANKTLNSKSNKTEYKLLIKILKYTKRTRFLLQLYGGTSYLNYFISKFDKQYEYYDAPKPQHPVIILLDNDSGFDCIEKELKKVQPAIILPPPLKKHDFRNADFIHVFHNLYIVLTPMNNQPKTMIEDLFDVATRQIQVDNKTFNPEKDFDKTKEYSKQIFAQKVVSTQKSTINFDGFKPFLDRIVRVIEHYDTIK

SEQ ID NO: 1109 - protein, 621 aa, unidentified
  source 1..621: note = Related to CP044399.1; note = Moritella marina
MNKLKSLQKVSTKSELASLLGVKASFLTHTLYVVKPSSQYTNFKIPKKSGGERSINAPTKKLKTLQSCLSKLLLDCIDEINTIKYPDLASYEVTRNKILKVKIPNSKIKQPSLAHGFVRNRSIITNAMMHVNQKNILNIDLNNFFDSFNFGRVRAFFIKNKNFKLPENIATTIAQIACNNNTLPQGSPCSPVISNLITHSLDIKLAYLAHEYSCRYSRYADDITFSTRKKAFPTKIMSYENNCYVAGKKLQGAIKQAGFSINDKKTRIQYKDSRQDVTGLIVNKKPNVKNEYWRRVRAQCHSLFTTGQFTKELKGEIVAGNINELEGQLNFIDQVDHYNRVRQSPPLDPKYHLKRDELLKTNQAKERQYLFTGRERTFSRFLYYRSFYANNKPTILCEGKTDNIYLKSAISERVKRHPTLASQKKGAVPYELLINFFNYSPRTRFLLELAGGTDYLKDFVINFNKHFNSFKAPKPKHPVIIVLDNDKGPNGLLHYLSNVKGASIIPNTLKLKTDYRKAEYIHVFHNLYVVLTPLSNKGKSQKIEDQYTDIESLFKKADLLRTYQKKCFNIASKRNEDIDLSKNAFANQIVKGQKKQVNFSGFNKLLNRIEEVIKHYDNMIF

SEQ ID NO: 1110 - protein, 575 aa, unidentified
  source 1..575: note = Related to RRZC01000044.1; note = Halomonas sp.
MPKKNGGKREINAPIEKLKSLQSSLSNLLLDCIDEINKVKFPRSEVNKNRDKSSKANNHEILKIKVPNADIKQQSLSHGFVRNRSIITNAMMHLGQKNVLNIDLKDFFDSFNFGRVRGFFIKNKNFKLDSHIATVIAQIACYDNKLPQGGPCSPVITNLITHALDIRLAALAEKYSCIYTRYADDLTFSTREKVFPEKIARLDNGKYAAGKKLKSEISRSGFSINDKKTRVQFKDSRQDVTGLVVNRKPNVKKEYWRTAKSQCHSLFRTGSFTKIVSDVVVEGNINELEGQLNFIDQVDSYNRLRQKAPLNYVYQFAKHGHNTLPLLSDRERTFSRFLYYRLFYGNAKPTILCEGKTDNVYLKTAIKRLVSAYPKLAKTRVNSETKKPSYDLLVRFLEYSKRTRFLLQLFGGTSYLSYFISKFEAQYAFYKAPKPQHPVLIVLDNDSGFYKEIENKLKKIETPTVYPVSLKKHDFRKADFIHVMHNLYIVLTPLSATGKDTMIEDLFDDTARGVVVSGKTFNPKDGRDNAKEYGKEVFAKKVIQDQRNKINFDGLKPLLDRMVKAIEHYDSIKNS

SEQ ID NO: 1111 - protein, 320 aa, unidentified
  source 1..320: note = Related to JAFWFN010000035.1; note = Halomonas sp.
MNKLNKLKAVTTKQELAELLGVKASFLTYVLYILRPENQYVQFSIPKKNGGKRKINAPIEKLKSLQSSLSNLLFDCVDEINKVKFPFSEINKDRDRNSKTNNYEILKVKVPNADVKQQSLSHGFVRNRSIITNAMMHLGQKNVLNIDLKDFFGSFNFGRVRGFFIKNKNFKLDSHIATVIAQIACYDNKLPQGGPCSPVITNLITHSLDIRLAALAERYSCIYTRYADDLTFSTREKFFPEKIARLDNGKYVAGKKLKSEISRSGFSINDKKTRVQFKDSRQDVTGLVVNRKPNVKKEYWRTAKSQCHSLFRTGSFTKVV

SEQ ID NO: 1112 - protein, 616 aa, Pseudomonas sp.
  source 1..616: note = Related to GL385078.1; note = Pseudomonas syringae
MKKIEALQAVRTKPELARLLGVKASMLTYVLYVLRPENQYSSFTIPKKSGGTRTINAPHDRLRLIQRALSDLLQDCIEDINDSKPKSAVKGKFIAAKKDDNPDYRRHKFFEDVFTPTLSHGFVRKRSIITNAMMHIDRKNVLNIDLKDFFDSFNFGRVRGFFIANNHFGLSPEIATVIAQIACYNHKLPQGSPCSPVITNLIGHILDIKLALLAREHSCTYTRYADDITFSTRSKHFPDALMREYKGIYVPGLELENRIRQAGFRVNSKKTRIQYQDSRQIVTGLVVNEKPNIRSEYWRTAKSQCHLLFKTGAFTEGDKEKSLPGNIEQLEGRLNFIDQLDFYNRLRQKPPLNSEYVLEKHGVDTRKLLGGRERTFGRFLYYRSFYASSSPTILCEGKTDNIYVKAAINRLAADYPSLARVKASESEYKLLVSIFKYTPRTRFLLGLYGGASYLKEFITRFEEAYSYYKAPDPENPVIIIMDNDGGFDGVDSLLKGKKLHATPFPKGAGKLEYRGADFIHVTKNLYIVLTPMSSSGGSSEIEDLFTPSTRSEPFDGKHLCLEKDIDRATQYGKDTFANKVILPKKNSIDFSGFKVLLDRVVMCIEHYKSAKLALSK

SEQ ID NO: 1113 - protein, 615 aa, Pseudomonas sp.
  source 1..615: note = Related to CP089282.1; note = Pseudomonas amygdali
MKKIDALRTVTTKPELARLLGIKASMLTYVLYVLRPETQYSIFEIPKKSGGTRTISAPHDKLKSIQRALADLLQDCIEDINDSKPKSAVKSKFINSKKNDNPDYRKSKFFEDVFTPTISHGFVRKRSIITNAMMHLNRKNVLNIDLKDFFDSFNFGRVRGFFIANDHFGLDEHIATVIAQIACYEHKLPQGSPCSPVITNLIGHILDIKLALLAREYRCTYTRYADDITFSTRSKEFPVELTREYKGTYIIGSVLENRIRQAGFRINPRKTRIQYKDSRQTVTGLVVNEKPNVRSEYWRTVKSQCHMLFKSGAFTEDGPEEPVPGNIDQLEGRLNFIDQLDFYNRLRQKPPLTPDYMLEKHGVNTHKLLSGRERTFSRFLYYRAFYGNARPTILCEGKTDNIYVKAAISRLAADYPRLAKIKTATSDYKLLVSIFKYTSRTRFLMGLYGGAAYLTDFVARFENTHRFYKAPRPTNPVIIIMDNDGGFDGVEGIFKGKKSNATPVPKGTGRTEYRGADFIHVVENLYVVLTPLGPSGSKSEIEDLFTSSTREELVDKKTLCLDKEIDRSSQYGKDTFANKVILPKKASIDFSGFKILLDRIVLCMEHYESSVLAST

SEQ ID NO: 1114 - protein, 479 aa, Pseudomonas sp.
  source 1..479: note = Related to GL384649.1; note = Pseudomonas amygdali
MMHLNRKNVLNVDLKNFFDSFNFGRVRGFFITNNHFRLAPEIATVIAQIACYDNKLPQGSPASPVITNLITHILDIRLSILAREQSCTYTRYADDITFSTREKVFPEQIMKEIGDTYSPGHLLSGEIRRAGFSLNAQKTRIQYKDSRQEVTGLVVNKKPNVKKEYWRTVKSQCHLLFKIGNFVEIINDEPQPGNINQLEGRLNFIDQVDYYNRKRQKPHLNPEYALSKHGTNTHELLSGRERTFSRFLYYRSFYGNDKPAIICEGKTDNIYLKSAINRLAPVYPRLATAKSTTSDYTLLVDIFNYSARTRFLLELYGGTSYLKDFIVRFEKHYSFYKAPRPQNPVIIILDNDKGFDEIDKLLKSEKSKSTAYPEIAGQNKYRGADFIHVIHNLYVVLTPLAATGGQTAVEDLFPQVTRDEIVDGKSFSTDKEIDRTTQYGKDVFANKVIAAKKGSIDFSGFSVLLNRIVSCIEHYDSIK

SEQ ID NO: 1115 - protein, 613 aa, Pseudomonas sp.
  source 1..613: note = Related to NZ_UTBG01000001.1; note = Pseudomonas viridiflava
MRKIDALKAVRTKPELASLLGVKASTLTYVLYVLKTSTQYKSFTIPKKTGGTRTIHAPHDRLKAIQSSLSDLLQDCIEEINSAKPKKAAKTKFVNTTKDKNPDYKKTKFLEDTFTPTLSHGFVRKRSIITNAMMHLNRKNVLNVDLKNFFDSFNFGRVRGFFITNNHFRLCEETATVIAQIACYENKLPQGSPCSPVITNLITHILDIRLAALARDNACTYTRYADDITFSTREKIFPEGIMRENDGEYSTGHLLNGEIKRAGFSLNIQKTRIQYSDSRQDVTGLIVNKKPNVKSEYWRTVKSQCHLLFKSGSFIEIIDGEPKRGNINQLEGRLNFIDQVDYYNRLRQKPPLNPEYEPSKHGHNTRELLSGRERTFSRFLYYRSFYGNEKATIICEGKTDNIYLKSAINRLAAAYPRLAKAKSASSAYQLLISLFNYSARTRFLLELYGGAPFLKEFISNFEENYELYKAPAPSNPVIIVFDNDAGFDIVDSLLRGKKIQAVAFPASSGRNEYRGADFIHVTKNLYIVLTPLTAAGTQTDIESLFTKVTRDEIFEGKTFSSAKDFDRALHFGKDTFANKIIAAKKGSIDFSGFNILLNRIVQCINHYDSIKQP

SEQ ID NO: 1116 - protein, 612 aa, Pseudomonas sp.
  source 1..612: note = Related to WIBD01000035.1
MKNIDALRAARTKPELALLLGVKASFLTYVLYVLKPDTLYRSFTLKKKSGGTRTIHAPYESLKSIQSSLSNLLQDCIEEINKAKPAKAIKTKFIITKKDKNSDHKKKKRPDHTFTPTLSHGFVRKRSIITNAMMHLNRKNVLNVDLKDFFDSFNFGRVRGFFITNRNFQLHPDIATVIAQIACYNNTLPQGSPCSPVITNLITHILDIKLAALARTYSCTYSRYVDDITFSTRKKIFPEQIMKDLEGSYTAGYLLNGEIQRAGFNLNPKKTRIRNQDSRQEVTGLVVNKKPNVNSKYWRTVKSQCHLLFKSGTFVDIIDDKPAPGNINQLEGRLNFIDQVDYYNRLRDKAPLNPEYMPHKPSNNTRRLLSGRELTFSRFLYFRSFYANEKVTIICEGKTDNIYLKAAIKKLSPAYPKLAKPKSATSAYQLLVSIFNYSARTRFLMELYGGTPYLKDFIAEFKENHKFYKAPKPANPVIIILDNDKGFNIVESLLRGDKVQATPYPRTPGQFEFRGANFIHVTENLYLVLTPLAPPPDRQTAIEDLFTQDTRDEQVDGKILSLEKEFDKATHYGKDAFANKVVLVKKSSIDFSGFNVILNRIMQCIEHYDSIK

SEQ ID NO: 1117 - protein, 611 aa, Pseudomonas sp.
  source 1..611: note = Related to NZ_LHVB01000014.1; note = Pseudomonas chlororaphis
MKKIDALRAVRTKPELALLLGIKASSLTYLLYVLKPSTQYSSFEIPKKSGGTRTIHSPSERLKSLQSSLSILLQDCIEEINKDKPARANKTKFITTKKDKASDSKKSKFIEYAFMSTLAHGFVRKRSIITNAMMHLNRKNVLNVDIKDFFDSFNFGRVRGFFITNNHFRLDPNIATVIAQIACYDNKLPQGSPCSPVITNLITHILDIRLAALAQANSCTYSRYADDITFSTREKLFPTQLMSEEGGTYIAGNELKREIQRAGFELNAKKTRIQYQSSRQDVTGLVVNKKPNVKSEYWRTVKSQCHLLFKSGKFTAKKGDEILEGNILELEGRLNFIDQVDFYNRLRQKPHLNPEYALSKHGLNTRQLLSGRERTFSRFLYYRSFYANDKPTILCEGKTDNIYMKSAISSLATDYPKLARPKSATSPYQLLISLFKYNERTRFLLQLYGGTSYLKDFIETFAMHYKFYKAPKPNNPVIIILDNDGGFDSINALLNGDKTRATCYPNTPGKNEYRDAEFIHVLENLYIVLTPRGVPDKHTAIEELFTQKVRDEVVSGKTFNHTNKIDITKEYGKEIFAKKVILAKKGSVDFSGFRVLLNRVVQCIEHYDSIK

SEQ ID NO: 1118 - protein, 609 aa, Pseudomonas sp.
  source 1..609: note = Related to NZ_VJOY01000005.1; note = Pseudomonas mangiferae
MKKIDALRAVRTKPQLALLLGVKASALTYLLYVLKPATQYSSFDIPKKSGGVRTINAPSERLKLVQSSLSELLQDCIEEINKAKPPRAPKGRFAKTEKEAGGKRSKHVEYVFTSTLSHGFVRKRSIITNALLHLNKKNVLNVDIKDFFDSFNFGRVRGFFISNNNFKLDPGIAKVIAQIACYDNKLPQGSPCSPVITNLITHGLDIRLAALAKKSSCTYSRYADDITFSTRERLFPSNIVKEIAGIYSYGDDLKAEFGRADFKLNEKKTRIQYHDSRQDVTGLVVNKKPNVKSEYWRLVKSQCHLLFKSGRFLVKEDGKVKDGNVLELEGRLNFIDQVDYYNRLRQKKPLNPEYALENHKLNTRKLLSGRERTFSRFLYYRYFYANEKPLVLCEGKTDNLYLKSAVNRLVAAYPRLAKAKTVNAPYHLLISFFKYSERTRFLLQLYGGASYLKDFIESYEKNYSFYKAPKPSNPVILVFDNDTGFNSVEALLKGSKMKEVVAHPVGSKKSSFRNSEFIHVFYNLYVVLTPLGAAKSTAIEDLFTRSTLDEVVSGKKFNPTKEIDVDKEYGKEVFAKKVVLAKKGSIDFSGFCPLLDRIVKVLEHYESTK

SEQ ID NO: 1119 - protein, 609 aa, Pseudomonas sp.
  source 1..609: note = Related to NZ_JYHV01000007.1; note = Pseudomonas stutzeri
MRKVDALRAVRTKPELALLLGVKASALTYLLYVLKPSTQYTSFNIAKKSGGIRKINSPSERLKAVQSSLSTLLQDCIDEINKAKPPRAPKGMFAKTDRLSDGKRAKRVEYVYTSTLSHGFVRKRSIITNALMHLNKNSVLNIDIKDFFESFNFGRVRGFFIKNNNFRLRPDVATVIAQIACYDNKLPQGSPCSPVITNLITHSLDIRLAALARKNSCTYSRYADDITFSTREKVFPSNLVRWDSEGYVYGDDLESEFARAGLKLNKKKTRIQYKDSRQDVTGLVVNRKPNVKCEYWRTVKSQCHLLFRTGKFAIKDGDEIKDGSIFELEGRLNFIDQVDYYNRLRQKIPLNPEYALANHKLNTRGLLSGRERTFSRFLYYRAFYGNDKPTILCEGKTDNVYIRSAINRLAAEYPKLARAKTSTKPYELLVSLFKYNERTRFLLQLYGGSSYLKDFIETYEKHYDFYMAPKPANPVIVILDNDTGFNSIEVLLKSKMTNAAVYPTGLGVAGYRNSDFIHVLHNLYLVLTPLGTAKSTAIEDLFTRSTLKEIVSGKTFNPSNKMDPAKEYGKEIFAKKVVLAKKGNIDFVGFRPILDRLVQCIDHYESIKG

SEQ ID NO: 1120 - protein, 609 aa, Pseudomonas sp.
  source 1..609: note = Related to NZ_AVEF02000221.1; note = Pseudomonas syringae
MRKIDALRAVRTKPELALLLGVKASALTYLLYVLKPSTQYSSFEIPKKTGGTRTIHSPSERLKVVQSSLSMLLQDCIEDINKAKPPRAPKGKFAKTEKLPAIKRTKLVDYVFTSTLSHGFVRKRSIITNALMHLNKKKVLNVDIKNFFDSFNFGRVRGFFIKNNNFRLDPNIATVIAQIACYDNKLPQGSPCSPVITNLITHGLDIKLAALAKKNSCTYSRYADDITFSTREKVFPLNVMKEEAEGYVCGDGLKSEIGRAGFTLNNKKTRIQYKDSRQDVTGLVVNKKPNVKCEYWRTVKSQCHLLFKSGGFVTKNGDEIEEGNIFELEGRLNFIDQVDYYNRLRQKAPLNPEYDLAKHGLNTRNVLSGRERTFSRFLYYRSFYGNDKPTILCEGKTDNIYIKSAISRLAAVYPRLAKVKALTSAYQLLVSLFNYTERTRFLLQLYGGTSYLKDFIETYEQHYNFYKAPKPINPVIIILDNDTGFNSIETLLKSNKKNQAVVYPIGVRGAGCRNADFIHVVHNLYIVLTPLGKEKSTAIEDLFTRPTLDEIVSGKKFNPSNKMDITKEYGKEIFAKKIVLVKKGSIDFSGFRVLLSRIVQCIEHYDSVK

SEQ ID NO: 1121 - protein, 607 aa, Pseudomonas sp.
  source 1..607: note = Related to QLTL01000007.1
MRKIDALRAVRTKPELALLLGIKASALTYLLYVLKPSTQYARFEIPKKSGGTRTIFAPSERLKAVQSSLSILLQDCIEEINKAKPPRAPKGRFAKNEGKTRGRRAKRVDYVFTSTLSHGFVRKRSIITNALMHLGKKNVLNIDINNFFDSFNFGRVRGFFITNNNFRLDPNVATVLAQIACYDNKLPQGSPCSPVITNLIAHSLDIRLAALAKKNSCTYSRYADDITFSTRKNVFPIAIAKDVSGSYECGLDIEREIIRAGFKLNAKKTRVQYKDSRQDVTGLVVNEKPNVKSEYWRTVKSQCHSLFRTGEFVINNGAVSRRGTLFELEGRLNFIDQVDYYNRLRQKLPLNREYALADHKLNTRELLSGRERTFSRFLYYRHFYANDKPVIICEGQTDNIYIRSAIHSLAAAYPRLANVKTPVAPYKLLISLFGYSERTKFLLQLYGGANYLKSFIEQYERHYGFYQAPKPKNPVIIMFDNDSGFGTTENFLKGKSSAVVYPVASRGAGYRHAEFIHVIHNLYIVLTPLGGAKSTAIEDLFLKSTLDEKVSGKKFNPDKNIDTATEYGKEVFAKKVILAKKGSIDFSGFSTILNRTVQCIEHYDSIK

SEQ ID NO: 1122 - protein, 608 aa, Pseudomonas sp.
  source 1..608: note = Related to NZ_CP018743.1; note = Pseudomonas putida
MRKIDALRAVRTKPELALLLGIKASALTYLLYKLKPSTQYHTFEIPKKSGGTRTIHSPSERLKALQSSLSNLLQDCIEDINKEKPARTPKGRFAKLYKNLQGKRGKHINYVYISTLSHGFVRDRSIITNALMHFRKKNVLNIDIKDFFDSFNFGRVRGFFISNKNFRLNDEIATVIAQIACYDNKLPQGSPCSPVITNLIAHSLDVRLAALAKKYSCTYSRYADDLTISTREKLFPPNIMKEDAGVYTCGRDLVSEISRAGFSLNHKKTRIQYKDHRQDVTGLVVNKKPNVKCEYWRTVRSQCHLLFRTGKFLTKVGDEVRDGSIFELEGRLNFIDQVDYYNRLRQKPALNPEYALSKHGVNTRELLSGRETTFSRFLYYRHFYANEKPVILCEGKTDNVYIKSAINVLAAAYPRLAKAKTANSPYELLVSMFNYTERTRFLLQLYGGASYLKDFIETFKKHYGFYKAPKPSNPVIILLDNDTGFDSICSLLKGKSFGAEAYPPGLAMNDCRDAEFIHVGLNLYVVLTPRVAAKHSAIEDMFTKATLGEVVGGKTFNPSNKMDSSKEYGKEIFAKKVVLAKKGSINFSGFNVILKRIVQCIEHYDKIK

SEQ ID NO: 1123 - protein, 403 aa, Pseudomonas sp.
  source 1..403: note = Related to NZ_JZRI01000162.1
MRKIDALRAVRTKPELARLLGVRASELTYVLYVLKPPTQYISFKIPKKSGGDRTIHSPSDRLKAIQSSLSDLLLDCIDDINKSKPGKPHLDRFVKGKKEKLLDSKKKKPLEYIFSPTLSHGFVRNRSIITNAMMHLHKKNVLNVDLQNFFDSFNFGRVRGFFISNRHFQLDANVATVIAQIACYDNKLPQGSPSSPVITNLITHSLDISLAKLAFEHSCTYSRYADDITFSTREKIFPPQIMSEESGSYTAGSQLTHEITKAGFSLNSKKNRIQYNSSRQDVTGLVVNKKPNVKCEYWRTVRSQCHLLFKSGSFVTKINDEEVVGNINKLEGRLNFIDQVDYYNRLRQKPALNPEYTLSKHAINTRELLSGRETTFSRFLYYRAFYANEKPTILCEGCLLYTS

SEQ ID NO: 1124 - protein, 614 aa, Aeromonas sp.
  source 1..614: note = Related to JAGDEY010000009.1; note = Aeromonas veronii
MKKLDALRAAKTKPELAHLLGVKPSSLTFLLYKLKPSTQYSSFDIPKKNGGSRTIHAPSKKLKKLQSSLSNYLQDCIDEINSAKPAFSNKKKFIKIDKDRVLDGKTKNFTEYKFISTLSHGFVRERSIITNALMHLNKRNVLNIDLKDFFESFNFGRVRGFFISNRNFCLDPDIATVIAQIACYDNKLPQGSPCSPVITNLISHILDIQLAALAKANSCVYSRYADDITFSTRERVFPSDIMSIEAGEYIVGRKLRGIIKRAGFSLNEKKTRIQYKDSRQDVTGLVVNKKPNVKSEYWRTVKSQCHSLFKNGTFTVKKGCDIVEGSISELEGRLNFIDQIDLYNRRRQQPKINPEIALCEPGINTRILLNGREKTFSRFLYYCYFYANKKPMIICEGKTDNIYIKLAMSKLATDYPLLAKPKSSNSAYEPLVSLFKYSKRTRFLLQLYGGTSYLKNFIETYKKNFAFYKAPKPCFPIIIILDNDAGFKDINSWLDKSKYVTPYNINIKASENNKFRYAEFIHVVENLYIVLTPRENPDKNSAIEDLFNPEILKEEVSGKTFNPSNSKIDITKEYGKEIFAKKVIFAKRNSIDFSRFKVLLDRIVKCLEHYDSNK

SEQ ID NO: 1125 - protein, 500 aa, Aeromonas sp.
  source 1..500: note = Related to NZ_UETN01000024.1; note = Aeromonas allosaccharophila
MRKIDALQKVKTKPELAELLGIKASSLTYLLYVLKPSTQYSYFEIPKKNGGRRTIHAPSKRLKKLQSSLSKFLQDCIEEINNERPASTHKSRFVKINKDRVLDGKKTKFIEHKFTSTLSHGFVRDRSIITNAMMHLNKKNVLNVDIDNFFDRFNFGRVRGFFIKNRHFSLDPNIATVIAQIACFDNKLPQGSPCSPVITNLITHILDIKLAALANDNSCVYTRYADDITFSTRERVFPKEIMRLEDGVYTPSEKFERVIKKAGFKLNEKKTRIQYKDSRQDVTGLVVNKKPSVKSEYWRTVKSQCHSLFKSGHFTVKKHDEIIEGSISELEGRLNFIDQIDLYNRLRQKPCIPPEISIQQHGINTRELLSGREKTFSRFLYYRYFYAHDKPMILCEGKTDNIYIKLAMNKLAVDYPKLAKPKTATSAYEPLVSLFKYNKRTRFLLQLYGGTNYLKEFITTYKKHYFFIKHQSLVIQLLLSWITTKDSTLLTPCLKEIKSM

SEQ ID NO: 1126 - protein, 586 aa, Pseudomonas sp.
  source 1..586: note = Related to JACAQA010000043.1
MRKVDALRAVRTKSELALLLGFKPAAFTYLLYKLKPSTQYQSFTIPKKSGGTRTIYAPSERLKALQTSLSLLLQDCSEEIEKAWVGGSDSKSTLSHGFVRKRSIITNAMMHLHKKNILNVDLKDFFDSFNFGRVRGFFITNREFCLNPDIATAIAQIACHDNKLPQGSPCSPVITNLITNILDIRLAALARSHSCTYSRYADDLTFSTREKVFPSQIMKEDVGSYTPGKKLKSEIKRAGFELNHKKTRIQYMDSRQDVTGLIVNKKPNTRYEYWRTVRSQCHSLFKSGSFTKKVDGKFIEGNIFELQGQLNFIDQIDYFNRLRQHPPLNPEYALSNHLINTRKLLTGREVVFSRFLYYRHFYGNETATILCEGKTDNVYLKSALNKLALKYPRLAIPKSAANPYKLLVSFMNYTERTRFLLQLYGGTSYLHVFLNSFEEHYKFYNAPKPKNPVVVVLDNDSGFNSIDGLLKGKLSGTPYPDTLSKSEFRKADFIHVTKNLYVVLNPLGPKGEFSAIESLFSPATRNIKISGKSFNPENNMDKNTEFGKEIFASKVVVANKDTIDFSGFDVLLSRITMCLEHYDLIR

SEQ ID NO: 1127 - protein, 588 aa, Pseudomonas sp.
  source 1..588: note = Related to POEK01000001.1
MRKINALRAAKTKPELALLLGVKATALTYVLYVLKPDTQYSTFTIPKKSGGLRTICSPSDRLKTIQSALSELLQDCLDELTAVKVKENHDYKSNLSHGFLRNKSIITNAIVHTGQRNVLNLDLKDFFDKFNFGRVRGFFISNKDFQLNEHIATVIAQIACYDNRLPQGSPCSPVITNLITHILDIKLAALAESYSCIYSRYADDITFSTRERLFPPKLMKEIAGEYIPGKKLRSEIRRAGFEINAPKTRIQFQDSRQDVTGLVVNKKPNVKSEYWRTVKSQCHSLFRTGSFKKKVDGTFADGNIYELEGQLNFIDQVDYSNRLRQKPPLDTEYEQRKSNIKTRELLSGRETTFSRFLYYKFFYANEKPTIICEGKTDNIYLKSAISSLAANYPKLATPKSANNPYELLVKFFNYNNRTRFLLQLHGGTNYLHTFINDFESHYDFYKAPRPKQPIIIILDNDSGFNGIDGLLKGKASAKRYPVAKGKKKDFRNANFIHVAHNLYIVLTPPTATGGHTAIESLFTAATLNEKVQKKTFNPESKINTTTEYGKEIFAKKVILANKKTINFSGFDVILKRVIQCMKHYETAK

SEQ ID NO: 1128 - protein, 589 aa, Pseudomonas sp.
  source 1..589: note = Related to NZ_LT629790.1; note = Pseudomonas mediterranea
MKKISALRLAKTKPDLALLMGIDASFLTNILYRLKPTTQYTSFTIPKKSGGVRTIYAPSDELKSIQSALSNLLQDCIQEINTSKGPKFKSTLSHGFVRDRSILTNAIMHLNKRNVLNIDLKDFFDQFNFGRVRGYFISNKIFQLDPAVATVIAQIACYDNKLPQGSPCSPVITNLITHSLDIRLASLARDNSCTYTRYADDITISTRKKDFPSNLTSDRASGYVIGSRLAAEIKRAGFSVNSTKTRIQYEDSRQDVTGLIVNKKLGTKSEYWRTVKSQCHALFQTGKFLENSSNPPQAGSIFVLEGKLSFIDQVDFFNRKRSKPLLNPEYELSKHGSKTRKLLNGRERTFSRFLFYKHFYGNTKPTIVCEGKTDNVYLKAAINKRAAAFPSLAKAKSGNAPYELLVHFINYTNRTRFLLELYGGTPYLKEFMLDYDEQFKFYKAPMPTHPVIIILDNDDGFGKIEGVLKGNKYSPTVFPVTLPVTDFRNAEFIHVVHNLYIVLTPLKGKGNKSSIEDLFTKKTRATKLGGKVFNKQNKTDSDTEYGKEYFASKVVAPNKHKINFSGFNPLLGRIDQCIQHFATVKLVKP

SEQ ID NO: 1129 - protein, 592 aa, Pseudomonas sp.
  source 1..592: note = Related to JAJSQA010000022.1; note = Pseudomonas monteilii
MKKISALRLAKTKPDLALLMGIDASFLTNILYRLKPTTQYTSFTIPKKSSGVRTIYAPSDELKSIQSALSTLLQDCIQEINTSKGPKFKSTLFHGFVRDRSILTNAIMHLNQRNVLNIDLKDFFDQFNFGRVRGYFISNKIFQLDPAIATVIAQIACYDNKLPQGSPCSPVITNLITHSLDIRLASLARDNSCTYTRYADDITISTRKKTFPNNLMSGQTSGYIIGSRLAEEIKRAGFSVNSAKTRIQYKDSRQDVTGLVVNKKPGTKSEYWRTVKSQCHALFQTGKFLENSSNPPQAGNIFVLEGKLSFIDQIDFFNRKRNKALLNPEYELSKHGSKTRKLLNGRERTFSKFLFYKHFYGNTKPTILCEGKTDNVYLKAAINNRATAFPSLAKAKSGNAPYELLVNFINYTNRTRFLLELYGGTPYLKEFILDYDEHFKFYKAPMPTHPVIIILDNDDGFGKIEGALKGKRYNPTIFPITLPPTDFRNAEFIHIVHNLYIVLTPLKGKDTKSSIEDLFTKKLRATKLGGKVFNKENKTDSDTEYGKEYFASKVVTPNKHKINFSGFNPLLGRINQCIQHFATLKPVKPVKP

SEQ ID NO: 1130 - protein, 590 aa, Pseudomonas sp.
  source 1..590: note = Related to NZ_CP076652.1; note = Pseudomonas savastanoi
MKMISALRVAKTKPDLALLMGIDASFLTNILYRLKPATQYTSFTIPKKSGGVRTIYAPSDELKSIQRALSNLLQNCMQEINTSKGTKFNPTLSHGFVRNRSILTNAIMHLNKKNVLNIDLNNFFDQFNFGRVRGYFISNKNFQLDPAVATVIAQIACYDNKLPQGSPCSPVITNLITHSLDIRLASLAKDNSCTYTRYADDITISTRREAFPNNLTSDGASGYIIESRLAAEIKRAGFSINPAKTRIQYKDSRQDVTGLVVNKKPATKSEYWRTVRSQCHALFQTGKFLENNSNPPQTGNIFVLEGKLNFIDQIDLFNRKRSKPLLNPEYEPSKNKSKTRKLLNGRERTFSRFLFYKYFYGNTKPTIICEGKTDNVYLKAAINKRASAFPSLAKPKSGNDPYELLVRFINYTSRTRFLLELYGGTPYLKEFILDYDEYFNFYRAPVPTHPVIIILDNDDGFGKIEGALKGKRYNPTIFPSTLPANDFRNAEFIYIAHNLYIVLTPRKGKTEKSSIEELFPIKIRATKLGGKVFNKQNKTDSETEYGKEYFASKVVTPNKDKINFSGFNPLLERINKCIQHFTTVKLVKPL

SEQ ID NO: 1131 - protein, 607 aa, Pseudomonas sp.
  source 1..607: note = Related to NZ_JAHTKI010000003.1; note = Pseudomonas botevensis
MRKSARKPPHFPAWQQRVLKKIDDLRAARTKPDLALLLKIDSSHLTNVLYRLRPETQYKSFTIRKKSGGDRTIHAPSDELKSIQKALSTLLQDCAQEIEKSNGPKFKSTLAHGFVRDRSILTNSVMHLNRKNVLNIDLKDFFDGFNFGRVRGFFIANRNFQLHPEVATVIAQIACYDNKLPQGSPCSPVITNLITHALDIRLASLAKDNSCIYTRYADDITISSREKEFPLTIMAEGASSYTPGKRLQLEIKRAGFEINHPKTRIQYKDSRQDVTGLIVNRKPGVKSEYWRTVRSQCHSLFNTGAFKEDVSGTPTEGNIFVLEGKLNFIDQIDFFNRKRNKPILNPNYEPSNHGSNTRKLLSGRERTLSRFLYYKYFYGNAKPTVVCEGQTDNIYLKAAINRLAVGYPKLVRPKTVAAPYELLVQFINYTGRTKFLLELAGGTDYLKKFVAEFGSYFKSYKAPVPTRPVILILDNDDGFNAIEGILKGNKYKPTIFPSGLAANDFRKAEFIHVVHNLYIVLTPLAKSGTKTSIEDLFPQSVRDTKLGEKTFNKENKIDIMKEYGKEFFATKVVTPKRNEIDFSGFNIILKRLEQCIEHFATMTLTKS

SEQ ID NO: 1132 - protein, 587 aa, Pseudomonas sp.
  source 1..587: note = Related to NZ_LN854573.1
MISALRDAKTKPQLALLLGIDASFLTNVLYRLKPSSQYKSFTIPKKSGGVRTIYAPSEELKSLQRALSSLLQDCQQEIYKSKGPKFKSTLSHGFVRERSIMTNAVMHLNKKSVLNIDLKDFFDQFNFGRVRGFFISNTNFQLDPAVATVIAQIACYDNKLPQGSPCSPVISNLITHSLDIRLASLAKDNSCTYTRYADDITISTREKDFPVNLMSEEAGEYSPGKKLESEIRRAGFEINHKKTRIQYKDSRQDVTGLIVNKRPGVKCEYWRTVRSQCHALFNTGEFIENESSNSEKGNVFVLEGRLNFIDQIDYFNRKRSKPILNPEYQLSDHGSKTRRLLSGRERTFSRFLYYKMFYGNAKPTILCEGKTDNVYLKAALNRLAAGFPKLVKPKNGKDPYELLVQFFNYTERTRFLLELSGGTPYLREFIASFDEHFNYFKAPVPTRPVIMVFDNDDGFKVIESVLKGKKVKPVVYPNTLAASDFRNSDFIHVIHNLYIVLTPRAAANGDTAIEDLFPQTVRDVKLGGKGFTKKNNIDKDTEYGKEFFASKVVVPNRNNIDFSGFDIFLKRIMQCIEHFDTVKLTKP

SEQ ID NO: 1133 - protein, 570 aa, Pseudomonas sp.
  source 1..570: note = Related to NZ_VLKY01000029.1; note = Pseudomonas duriflava
MGVNASHLTNVLYRMKPENLYKSFTIAKKSGGVRTIHAPVDELKSIQTALSILLQDCVQEINKSKGDKFTSTLSHGFVRERSILTNAVMHLSQKNVLNIDLKDFFESFNFGRVRGFFIANKNFQLDPAVATVIAQIACYDNKLPQGSPCSPVITNLITHSLDIRLASLAKENSCTYSRYADDITISTRKKEFPSNLMTDGQQGYSPGKRLQSEIKRAGFEINRSKTRIQYKDSRQDVTGLIVNTKLAVKKEYWRTVRSQCHSLFQTGAFKENASGTPEEGNIFALEGRLNFIDQIDLFNRKRNKTAPALDHDSSQKKYNTRRLLSNRERTFSRFLYYKLFYGNAKPTIVCEGKTDNIYLKSAIGRLAGAYPNLAKPKSGNDPYELLVRFVKYTERTRFLLELSGGTPYLKEFILGFDEHFKYYKAPAPKQPVILVFDNDDGFGKIEGVLKGKKYSPTIFPTTLPTDAFRKAEFIHVAHNLYIVLTPLKEKGEHTSIEDLFPQAVRDIKLGGKKFNKENEIDIDIEYGKEYFAKKVVLPNKNDIDFSGFNIILTRMVQCIEHFATLTLTKP

SEQ ID NO: 1134 - protein, 589 aa, Pseudomonas sp.
  source 1..589: note = Related to NZ_CP044074.1; note = Pseudomonas oryzihabitans
MLKIDALRQIKTKPELALLLGINASHLTNVLYIKRLETQYSSFTIPKKSGGVRTIYAPSDELKSIQAALSHLLQDCIQEIRNSKGEVSKSTLSHGFVRGRSIITNAVMHLRQKNVLNLDLKDFFEGFNFGRVRGFFIANKDFQLDPVIATVIAQIACFNNKLPQGSPCSPVITNLITHSLDIRLASLAKKNSCRYSRYADDLTISTRKKDFPSNLMAEGVSGYSPGKKLQAEIKRAGFEINSSKTRIQYKDSRQDVTGLVVNKKPAIKSEYWRTVRSQCHALFQTGAFIESTSGTPEDGNIFVLEGRLNFIDQIDLFNRKRNRFDFVSEWDSSQKKINTRRLLSGRERTFSRFLYYKLFYGNSKPTVVCEGKTDNVYLRCAMAQRANGFPELFKSKAGDEPSELLVQFVKYTERTRFLLELAGGTSYLKEFILNFDEHFKYYKAPAPTHPVIIVLDNDDGFGKIEGVLNSKKFKAVSFPATLEGGSFRQAEFIHVVHNLYIVLTPLQGKGEHTSIEDLFPQAVRDIKLGEKKFSKKNEIDAATQYGKEFFASKVITPNKNTIDFSGFDIILSRMVNCIKHFASVDLAKS

SEQ ID NO: 1135 - protein, 586 aa, unidentified
  source 1..586: note = Related to NZ_PNRF01000034.1; note = Halomonas endophytica
MSKLEALRKIKTKHELATLLGIKTSVLTYTLYVLKPDTQYSSFTLKKRSGGERTIFAPSERLKSIQSTLSELLQDCRDEINNKKQDDGKFNSTLSHGFVRRHSIITNSMMHLNQKNVLNIDLENFFDCFNFGRVRGFFIANNNFKLDPHIATVIAQIACHNNKLPQGSPCSPTISNLITHSLDIQLANLARTYSCRYTRYADDITISTRENLFPRKIMRHEDGKFIAGKRLRREIKRAGFTINEKKTRIQYRDSRQDVTGLVVNKKPNIKSEYWRTVKSQCHALFSTGSFKDKENGEFIDGNEKILEGRLNFIDQIDRFNRLRQKTPLNPDYALAKYGYDTSKQLSGRERTFSRFLYYRFFYGNKFPTILCEGKTDNVYLKCAIHMLTSGYPQLAKEKTETEPYKLLLTFLKYTKRTRFLLQLHGGTSYLSFFINSFDKHYNFYKAPKPNNPAIIIADNDSGFSSIESKLRKIDSAKGYHGKKAGKNYRQAEFIHVVHNLYIVLTPTTKTNKETAIEDLFDSSTRKIQVSGKSFNPSNDMNNDTEYGKEVFAKKVIQAQKGSINFNGFKPLLNRIVAAMNHYDAIK

SEQ ID NO: 1136 - protein, 587 aa, unidentified
  source 1..587: note = Related to QOAT01000087.1; note = Thiothrix sp.
MSKLEALNKSTSKPQLAALLGVKAQFLTHVLYRLKPATQYTNFTIPKKSGGTRTIFAPSEKLKSLQSSLSTLLLDCIDEINEANTVKYTYKHALSHGFVRECSIMTNAVMHLNQKNVLNIDLKDFFDSFNFGRVRGFFIKNNHFKLDPHIATVIAQIACYDNKLPQGSPCSPVITNLITHPLDIKLASLARKHSCIYSRYADDMTFSTRKAVFPSQIMRQEHGKFITGKKLKNEIKRAGFFINDKKTRIQYKDSRQDVTGLIVNVKPNVKKEYWRTVKSQCNRLFHTGAFIKKTAAGDIDGNINELEGQLNFIDQVDRFNRSRKKPPLNHTYKLDNHGINKTPLLSGREKTFSKFLYYRLFYGNTKPTILCEGKTDNIYLKSAISILVKKYPNLASTKTNKAAYELLIRLVKYSKRTRFLLGLYGGASYLSYFTSKFDKQYVLYNEAPKPQHPVIIILDNDSGSTSVKKQFEKINSATAYPATLPKKDYKNADFIHVTHNLYIVLTPLTTKGNDTDIEYFFDDPTRLKQHNDKCFNTADKRDDKADLSKEAFAKNIIKAQKGSINFDGFKPLLDRIVAVITHYDSIK

SEQ ID NO: 1137 - protein, 587 aa, unidentified
  source 1..587: note = Gammaproteobacteria bacterium; note = Related to JAHJJI010000033.1
MSKLEALKQITTKPRLAALLGVKVQTLTHVLYILKPSTQYTGFTIPKKNGGTRSILSPSDKLKSLQSSLSNLLLDCIDEINETKHKKNYRYKHALSHGFVRECSIMTNALMHLNKKNVLNIDLKDFFDSFNFGRVRGFFIKNNHFKLDPHIATVIAQIACYENKLPQGSPCSPVITNLITHSLDIRLASLAKKYSCTYSRYADDMTFSTRESVFPRQIMGQEEGQFIIGKELKSEIERAGFSIHDKKTRIQYKDSRQDVTGLIVNKKPNVKKEYWRTVKSQCHLLFQTGAFIKKTVNGDVEGNINELNGQLNFIDQVDRFNRSREKPPLNPIYQLQNHGQNTTSLLSGREKTFSQFLFYRLFYANIKPTILCEGKTDNIYLKSVISILAEHYPKLANPKTKKNPYELLIQFVEYSKRSRFLLQLYGGASYLNYFVSQFDKHYRHYKAPTPQQPVIIVLDNDSGSSSIVTKLKALDSVKAYPATVKKEDCAKADFIHVVHNLYIVLTPLNAKNEPTDIESLFDDSIRLKQHDGKCFNTRDKRDEKVDLSKDAFANHIINAQKNTLNFDTLKPLLDRVVAAISHYDSIK

SEQ ID NO: 1138 - protein, 584 aa, unidentified
  source 1..584: note = Related to NVWS02000073.1; note = Zetaproteobacteria bacterium
MNKLERLKKITTKPALANLLEVNPSFLTHVLYILKPNTQYTTFTIPKKSGGIRTIKAPSVKLKSLQSNLSKLLLDCIDEINKSKSLEEKNYKQTLSHGFVRKRSIMTNALMHLNQKNVLNIDLKDFFDSFNFGRVRGFFIKNHNFQLDPAIATVIAQIACDDNKLPQGSPCSPVITNLITHSLDIKLASLARKHSCIYSRYADDMTFSTRKSVFPQQIICQEGDHFVTGKNMNSEIVRAGFSINENKTRIQYKDSRQDVTGLIVNKKPNVKKEYWRTVKSQCHSLFRTGTFTKKTAAGVVAGNIKELEGQLNFIDQVDRFNRPRQKAPLNPIYQYKNYGNDKTPLLSGREKTFSKFLYYRLFYGNTKPTILCEGKTDNTYLKSAISILAGSYPILASAKTRGSAYELLIRTVKYSKRTRFLLGLYGGAPYLCSFIKAFEKHYKFHKASKPKCPVVIVLDNDSGFKNFPKILKGIKSATPHPTTLESDDYRNAEFIHVIHNLYIVLTPLRSKGEETDIEYLFDDATRLKQHSGKCFNIVDKRNDETDLSKDAFAKHIIKAQKASINFDGLRPLLDRITSAINHYN

SEQ ID NO: 1139 - protein, 601 aa, unidentified
  source 1..601: note = Related to NZ_BDMN01000304.1
MKNLRALKDIRTKPELAKLLDVTPQNLTYTLYKIGRKNLYISFDIPKRNGGIRTIYAPVCNLKLIQSRLSNLLQDCIDEINNKPNKSSKLAHGFVRKGSIITNANVHKNQKYVLNIDLSNFFDSFNFGRVRGFFIKNRNFELDPHIATVLANIACFNNKLPQGSPCSPVITNLITHSLDIRLASLAKKNSCSYSRYADDITISTRKAVFPNQIMEQHENGKYLAGKKLTHEITRAGFSINEKKTRIQHQYSKQDVTGLTVNKKLNVKKIYWRTVRSQCYQLFCTGTFYKTTYKGREQGNINELEGQLNFIDQVDHFNRIRKTYNKNLHNSHHRKIGNSRERLFGRFLFFRSFYGNSQPTILCEGKTDIIYLKSAIKILATDFPNLARNNPKKGGYKLLIRFIKNSNRTNFFMDLPKDGGYGCLVTFMKKFNENSLGYKAPSPQHPVIIVVDNDKGFDNFTTAINQTKKEYSRKNKSTINPSNPTEEKDYRKKGFIHVIRNLYVVLTPLRDGESASDIEALFDEDTRLKKHEGRCFNTVLNRNDKDDLSKNAFATHIIKKQKTSINFSNFKCLLNRISGAIDHYAENGSVAKSVKTDYILVL

SEQ ID NO: 1140 - protein, 591 aa, unidentified
  source 1..591: note = Related to NZ_VTUU01000001.1; note = Marinobacter salinexigens
MSKLTTLKSITTKKELADLLEIKRSNLTYTLYVLKPSTQYFQFQIPKKNGGFRTIDAPAKRLKDIQSKLSDLFLDCIDEINKGKEKNQHNEKHGIHTYPMLSHGFSRKKSIITNALMHINNKNVLNLDLDDFFDSFNFGRVRGFFIKNRNFELHPDIATVIAQIACYNNKLPQGSPCSPVITNLITHSLDIKLASLARKYSCTYSRYADDITFSTREEVFPRQLMAEEKGKYTPGKRLRREIESSGFTINSKKTRIQYKDSRQDVTGLIVNKKPNIKKEYWRTAKSQCHSLFRTGTFYKLTDQGMAIGNINELEGQLNFIDQVDFFNRLRQKPPLNPLYKLENHRKNTSNLLTGREKTFSRFLFYRYFYGNNKPTILCEGKTDNVYLKSAINVLQDHYPRLAKSKSKHGEYKPIVHFFNYSKRTRFLLEIFGGADYLKGFVENYQKNYSFYKAPKPKNPVILLLDNDSGSNGIINLIKGLRTTTIHPSTTKKNDIKNADFIHIMHNLYLILTPLNGSSDTAIEDLFDATTKSIKVGGKSFNPGKPDTSKEYGKEIFANRVVKEKKNSINFDGFKPLLNRISAVIEHYSKHT

SEQ ID NO: 1141 - protein, 599 aa, Aeromonas sp.
  source 1..599: note = Related to NZ_CP045311.1; note = Aeromonas dhakensis
MSILINLQNAKTKKDLAAILDINTSTLTNALYRKKVSSLYTEFKIPKKKGGERIIYAPQRELKIIQKKLSLILQDCLEEITSNDEKISNLSHGFMREKSIYTNATHHKNKKNVLNIDLKDFFDCFNFGRVRGFFIKNKNFELHQDIATVIAQIACYNNSLPQGSPCSPIISNLITHSLDIKLSQLASRYSCFYTRYADDITFSTRECIFPTPLARIENNEYVIGKKLRQEITRSGFEINTIKTRIQYLSSRQDVTGLIVNKKVNVKKEYWKSVRAKCDFLFKNGYYYVLDDTGKEIKGSLSQLYGQLNFIDQIDYLNKLKKPIEINPLYILAKHGNNKTPLFSSRERVFSHFLFYKSFYGNENTTVICEGKTDIIYIRCAIKSLYKSYPSLVDKDGIIKFDFFKYTRRTRYLLSLHGGTTYIADFIKNYRQYYSLYKSAKPTKPVIIILDNDKGLGDIIGGLQKERKPRLVTADGETTLNGINSLKKSLYVHVCFNLYLLIVPHLNQKETSIESLFDKSVLDTKLNGKSFTTENEFSHEKFYGKHVFATAVIENNKHKVDFSGFNQIFKAIEKIQDDYKDVQKNTAKPPIKGSTINATP

SEQ ID NO: 1142 - protein, 415 aa, Aeromonas sp.
  source 1..415: note = Related to NZ_CP012504.1; note = Aeromonas veronii
MAEILDINTSTLTNALYRKKVSSLYSEFKIPKKKGGERTIFAPQRELKIIQKKLSLILQDCLEEMTSEDERTPNLSHGFMREKSIYTNASCHKNKKNVLNIDLKDFFDSFNFGRVRGFFIKNKKFELHPDIATVIAQIACYNNSLPQGSPCSPIISNLITHSLDIRLSQLASRHSCFYTRYADDITFSTREYIFPTSLARIENDDYVIGKKLRQEIRRSGFEINSIKTRIQYHTSRQDVTGLIVNKKVNVRKEYWKDVRAKCESLFRTGTYYILDDNEKAKPGTLSQLYGQLNFIDQIDYSNKIRKPIKTNPLYVLAKHGSNKAPLFSSREKTFSRFLFYKNFYGNEKTTIICEGKTDIIYLRCAIKSLHNLHPSLVDKDGLANFEFFKYTRRTKYLLSLNGGTPYLSDFSRELL

SEQ ID NO: 1143 - protein, 610 aa, unidentified
  source 1..610: note = Gammaproteobacteria bacterium; note = Related to JABXIW010000056.1
MLADKLDSLKNIKTKRELAILLGVKPSFLTHTLYIRKPENCYSEFEIPKKKGGYRKIKAPNPQLKSLQSKLSVLLLDCMDIIKSINFPNVISHKRLSVSRNHLKIKVPGSPRKESTLSHGFERNRSILTNAVMHTNQKNILNIDLKDYFDSFNFGRVRGFFIKNRNFQLHSDIATVIAQIACFEDKLPQGSPCSPVITNLITHSLDIRLASLSKKHSCTYTRYADDISISTRKKTFPAKIAKEVNGEYVLGKKLRQEIKRSGFKINNTKTRIQYKDSRQDVTGLVVNNKPNVKKEYWRTVRSQCHSLFHTGEFTQRNSDGELEEGNINRLEGKLNFIDQVDRYNRMRQKEKINHLYALSNYGHKMSPYWSGREKTFSRFIFYRLFYSNVKPTILCEGKTDNVYLKAAINELVKDYPKLASPPTKDERYNLLVRFVEHTKRTKFLLELSGGSSYISFFIGNYKSRYGFYKAPKDNAPVILVLDNDSGFDCIEKKINKIDSVQIYPTTLKKDKLREAEFIHITENLYIVLTPISATAKKTDMESLFDDKTRLIKYDNKCFNTIDKRDEDKDLSKDSFSRHVIKNQKTSINFDGYRPLLDRLNKVIEHYDKLK

SEQ ID NO: 1144 - protein, 588 aa, unidentified
  source 1..588: note = Related to WOBJ01000032.1; note = Aliivibrio fischeri
MDTITKLKNCRSKIDLALLLNCKPSHLTYLLYKQSPSQKYTQFSVNKKNGGIRNISAPISQLKELQSNLSHLLLDCIDDINATKSMKSTLSHGFVREKSIITNAEMHKNTKNVLNIDLENFFASFNFGRVRGFFISNNNFLLNKDIATVIAQIACHNNELPQGSPCSPVITNLITHSLDIRLANLAKKYSCTYSRYADDITFSTRKTQFPKEIMCERENVFTPSRRLNGEIIRAGFKINPKKTRIQYKDSRQDVTGLIVNKKIGVKKEYRQITKSMCNSLFHSGGFTKLVDGKHEKGSIEELEGRLNFIDSIDLYNRLTFPEKLSIHYPHVKHGIKTKKLLTGRERTLSKFLFYKNFFANEKPKILCEGKTDNIYLMAALNNLSSNYPSLASPATATKLFEPLVSFLNYSKRTKFLLELAGGTSYLVGFILDYHKYYSFYKAEKSNNPVIIILDNDDGLGEVIKAIAKIKTCVVEAPVIAGQNINDQVKSSRFVHVCHNLYLVITPLDQGKDTMIENLFEPQLWATPIKGRTFDPTEKKKPTDNYYGKNIFATEVVNPKKGQINFDGFKPLFDRMVEVLEHYKVNRQP

SEQ ID NO: 1145 - protein, 582 aa, Vibrio sp.
  source 1..582: note = Related to NZ_JABEQC010000006.1; note = Vibrio plantisponsor
MNSITQLKNCNTRVDLALLLKVKPAVLTFTLYKKGPQNNYTSFNIPKKNGGVRTINAPIGKLKTLQTNLSKLLLDCIDDINKERGFNSGLAHGFVRERSIITNAIMHKNSKNVLNIDLDNFFGSFNFGRVRGFFQKNRNFLLNDEVATTIAQIACCNNELPQGSPCSPVITNLITHSLDIQLLKLANKYSCTYSRYADDITFSTRKSKFPPEIMVENNGVYNPSKRLKHEIKRADFKINDKKTRIQYRDSRQDVTGLIVNKKIGVKKEYRRTTKSMCNSLFHTGSYTKIVNDKHVAGTINELEGRLNFIDSIDLYNRINYPEKLSIHYTHRNYGYKTRALLTGREKTFSKFLFYKWFFAPSKPTILCEGKTDNIYLKSAIFQLAAHYPKLVKATPFEHLVNYFSYNKRSRFLLELSGGTSYLAGFISSYSDHYSLYSAPKSGQPIIIILDNDSGLNDIISALAKIDTCTVYPIDKATGNIKEDIKTADFIHVVHNLYIVLTPLNGKNDSMIENLFNPALWSTPIQGRTFDPTEKRTPKNSFYGKNTFATEVIKRQKATIDFSGFHPLFERMTLAITHYEGIR

SEQ ID NO: 1146 - protein, 588 aa, Vibrio sp.
  source 1..588: note = Related to NZ_SMJS01000006.1; note = Vibrio echinoideorum
MNSIEKLKKCSSRNDLSILLDVKPSILSYVLFVESDASKYQEFTISKKTGGERLIKAPNDRLKEIQKSLSDLLLGCIDDINKEKNISNTLSHGFVKEKSIITNAEMHKKSKNILNIDLGNFFDSFNFGRVRGFFIKNNNFLLDPNVATAVAQIACHNNSLPQGSPCSPVITNLITHSLDISLAKLAKKNSCRYTRYADDITFSTRKNSFPVEIMAELDGVYKASKRLDKEISRAGFVINEKKTRIQYKDSRQDVTGLVVNEKVGIKKEYRRTVKAMCNSLFHTGSYTRLINDEHVEGSILELEGRLNFIDSVDRHNRVHYPEKLSTHYQHRHHGIRSREVWSSREKTLSKFLFYKWFYANSKTTILCEGKTDNVYLSSAIYKLKGKYPSLIDAKAKSGEPKSLVKFMDYSRRTKFILELAGGTSYLANFIDAYKERYEFYKSEKPEYPVLIILDNDDGLNDNGGIIAKLQKISTMSMHPTPPKKGNMKSKIKNSEFIHVMHNLYVVITPLNSGNDTMIENLFEQKLWSTPLNKRTFDPTEKKEPKSSYYGKNDFATRVVKKKQDSINFNGFIPLLDRMQRAIEHYKTV

SEQ ID NO: 1147 - protein, 585 aa, unidentified
  source 1..585: note = Related to NZ_CP028355.1; note = Shewanella baltica
MDAIDKLQSCKTRRDLAILLNYNPSHFTHLLYHSIPEQRYKSFLIPKKNGGERSISAPNEKLKQLQRNLSNLLLECIDNINKRNGVNNSLSHGFVRERSIITNAEMHKNKKNVLNIDLENFFGSFNFGRVSGFFIKNNSFLLEEVIATTIAQICCFNNELPQGSPCSPVITNLITHSLDIRLASLAKKYSCTYTRYVDDITFSTRKSTFPIQIMNFEYGEYLPSQRLLHEITRSGFNINNSKTRIQFKDSRQDVTGLIVNKKVGVKREYRQLTKAMCNKLFNTGRFTKEIDGQEIEGSLLELEGQLNFIDSIDYYNRVNYPQNLSIHYTHRNFGFRTKLLLNGREKILSKFLFYKNFYSSDKPTILCEGKTDNVYLLSALHALSSSFKKLATPPTKTTDFKTEIKFLNYTKRTKFLLELAGGTSYLAMFIANYHSNYIQYKAPKPKHPVIIILDNDEGLKDIINELEKIKTCTFSPPKTKGSTTRDAVKTSTFVHVVHNLYLVITPLSDGNDTMIENFFEKELWETVVNGRKFDPTEKKEPKNIFYGKNIFANDVVKLNRKKINFEGFRPLFYRLEKVISNYNKI

SEQ ID NO: 1148 - protein, 584 aa, Vibrio sp.
  source 1..584: note = Related to NZ_CAJFAE010000018.1; note = Vibrio jasicida
MNAITQLKNCHSRIDLAILLKCKPSFLSYVLYKKAASSKYHEFEIDKKNGGKRKICAPADDLKSIQRNLSDLLLDCIDDINKDKNYYNTLSHGFSREKSIISNAEMHRGQKNVLNIDLDNFFGSFNFGRVRGFFIKNRNFELNEEVATTIAQIACYENQLPQGSPCSPVITNLIAHPLDIRLAKLAKQHSCIYTRYADDITFSTRLKDFPAKLMAQPTPNEYVVGSKLNREIQRAGFNINHDKTRIQYKDSRQDVTGLVVNKKIGVKREYRQLTKAMCNSLFHTGSYTKLVGDNHIDGSLDELEGRLNFIDYVDLHNRLQYPEKLSIHYPHRNYGSKTRALLTSRETTLSRFLFYKYFVGNEKATVLCEGKTDNIYLKAALRQLAAHYPTLQNESNHECYLDFLNYSKRTKFLLELFGGTAYLAGFITSYNDLYSYYKGPKANNPVIIVLDNDDGFDAIASALNKTKSCTINPTPTHTTGHNFNSTEYKNSNFIHVCHNLYVVLTPLNNGSDTMIEDLFDRSLWQTSISGRTFDPTGKLKPSSSYYGKNIFATEVVAPRQSSINFDGFKPLLDRLTDVVGNYAP

SEQ ID NO: 1149 - protein, 585 aa, unidentified
  source 1..585: note = Related to WMDE01000033.1; note = Photobacterium carnosum
MNKILQLKNCRTRIDLAILLKCKPSFLTFLLYKTKQEDHYEEFEIPKKTGGIRKICSPKGDLKLLQKRLSLLLLDCIDDINSKNKIKNTLSHGFEREKSIITNAEMHRGKKNVLNIDLNNFFDEFNFGRVRGFFISNKDFQLTPEVATTIAQIACYKNKLPQGGPASPVITNLITHILDVILSRLAKKNSCIYTRYADDITFSTRKKLFPSGIMEETDANIYIPSKSLNHEIKRAGFSINSKKTRIQYKDSRQDVTGLTVNKKVGVKREYRQLTKSMCNSLFHTGEYTKKVNNEDVAGTLKELEGRINFIDSIDFYNRKKHPKKLSIHYQQKNHGLNTRLLLSGREKLLSKFLFYKNFIGNDKVTILCEGKTDNIYIKSALKTLVNNYPKLAEKKAEEPYKSYLNILNYSKRTKFFLELAGGTPYLNFFIKNYEKHYNFYKSVPAEKPVIIILDNDDGFKLIINTIKEIKNHTCLPYPNRRQTPIEYLKNADLIHVTHNLYIILTPLSNGNDTMIENLFPPDLWNQDIQGRTFDPTEKLKPEENYYGKKTFATEVIAPNRDHINFDGFRPLFDRLTNVIEHYEKI

SEQ ID NO: 1150 - protein, 587 aa, Vibrio parahaemolyticus
  source 1..587: note = Related to CP040103.1
MNSIESLKSCVTRKDLARLLSCAPSHLTYVLYKLPAATKYKQFPVSKKSGGVRQINAPTTDLKKIQRCLANLLQDCIENISEEHEYDNKAAHGFVRKRSIISNAEMHKRQKNVANLDLESFFDSFNFGRVRGFFIKNRHFALSEEVATTIAQIACHNGVLPQGSPCSPVITNLIAHSLDIRLINLARKHSCVYTRYADDLTFSTRKATFPPQILREEDGKIIPSKTLRNEIKRAGFSINHKKTRIQYKDSRQDVTGLVVNKKVNVSSDYSRLTKAMCHSLYTKGFYTKEENGKLVQGTIKELNGRLLFIDSVDKYNRINYPDKLSVHYNHKTHGYRTRVLHNGREKTFSKFLFYKHFFANTKVCVLCEGKTDNIYLKCALDSIGAQFPKLYTPAGNGKDAITHIELFKYSKRTRFLMELYGGSSYLGGFIQSYKERLKSYKKLPLTRPVIILLDNDEGLSKHIRTEMKSAHATIYINGKIVTNFDKNIKKADFVHITDNLYAILTPLKADGSDSMIEDFFEPAVLNRQVNGRTFDPKEEKKPPEKFYNKNTFATQVVEADKKNINFNGFNSIFERISLAINHFESRT

SEQ ID NO: 1151 - protein, 617 aa, unidentified
  source 1..617: note = Related to NZ_JAFFZP010000001.1; note = Amphritea pacifica
MVMDDEHSKLLKLARYNRLFSCDSRSELASLLHVSPVFLTNILYIQKPENLYRSFNIPKKSGGIRQIEAPAESLKEIQSKLANLLLDCIDALNTIKGNDSNLTGSFNNTLSHGFSRKKSIITNAERHRNRKIILNTDIEDFFGSFNFGRVRGFFLKNRNFSLSENIATTIAQIACYNNALPQGSPCSPVISNLICHSMDVRLAKLAKRHSLYYTRYADDLTFSTNKRTLPSEIAIENGSRYEIGSVFQREIHRSGFSINHNKTRVNFKDSRQVITGLTVNKKINTHRNYWRLERSKCHYLFMTGDIPDDGSSTDLASKINRLHGRLNFIDTMDRHNRVNLSKIEQHLISHKSINGILKEDIEEILLGKENGKNSRTKKKLNSREETFSKFLFYKNFYNNQKPLIILEGKTDNIYIGCALERLFSHYKDLIKYDIKEKKYEKNIKLYEHTKRARYLLDIHAGADHLFEFVRQYDKRYSYYKAPIDNHPVILLLDNDTGPKAIINFLKNTLLKRSGIDPKNEDFVHICHNLYLVLTPLNKGRDTSMEDFFDKSVLGTTIKGKTFDPSNEKSTGTTYGKHVFSTEVVKKNKNTISFASFRPILDRVTAVINDYASKKSSS

SEQ ID NO: 1152 - protein, 615 aa, unidentified
  source 1..615: note = Related to NZ_PYGI01000034.1; note = Marinobacterium halophilum
MDEKKARSRKLDRYFRLSNCTTRSELASLLNISSVFLTNVIYIQKPDNLYRSFNIPKKSGGHRVIFAPAPQLKEIQSSLAHLLLDCIDAINIKKGENLKLGKPFISTLSHGFSRKKSIITNAEKHRNRRVILNTDIEDFFGSFNFGRVRGFFLKNRNFQLFPDIATTIAQIACYNNALPQGSPSSPVISNLICHTMDIRLAKLASKHSLYYTRYADDLTFSTNKKEIPVEIAINKGGQYEVGIALKKEIHRSGLSINHGKTRVNFKDSRQDVTGLTVNKKINTNRHYWRLERSRCHYLFMTGDIPDDGGSYDLESKISRLHGRLNFIDTIDRHNRVNLAKIEQHIISNKSINGILKEDIEEVLLGKDNNKKTKRNKKLNSREINFSRFLFYRNFYNNSKPLIICEGKTDNIYISCALESLSPSYPGLIEHDKKEKKYKKLIKLYEHTKRARYLLDIHGGADHLLDFIRQYEKRFSYYKAPISNSPVILLLDNDTGPKAIIQYLKNTLLKGTGIDPKNEEFIHICKNLYLVLTPLSNKKDTSMEDFFENTVLKTKVNGKSFNPSNDAATDTTYGKHIFSTEVVKKHKNSISFDMFRPIFDRIVAVIEHYESIKNSL

SEQ ID NO: 1153 - protein, 588 aa, Aeromonas sp.
  source 1..588: note = Related to NZ_CP077301.1
MSRLALLKQATTKRMLAKVLDVNPSFLTKTLYLTSDELKYKSFEIPKRNGDPRTIYAPNKELKDLQSRLSVLLLDCIDEINKERKITPKLSHGFVRNRSIITNAKNHIHKKNVLNIDLNDFFGSFNFGRVRGFFIKNQHFELHEHIATVIAQIACYKNFLPQGSPCSPVITNLIMHSVDIRLAKLAKKNSCTYTRYADDITFSTRENVFPKDIAIADKNKVHLGRRLSKEITDNGFTINEKKTRVQLMDSRQDVTGLVVNKKVNIKSDYWRITRAMCHSLFQTGSYIKCEQNGQAVAGTLYELDGRLNFIDYIDKYNNVKEKGPIDNRFSLRNHGLNYREKLNVREKTFSRFLFYKYFFGHNKPTVLCEGKTDNIYIKAAILRLSEKFELLSNAKTDEKEYELLVNFLEYNKRTRYLLDLYGGASYLKRFVERYRSDYSYYRAPAATQPVIIVADNDSGSTELISYLVNHKPLYPELKKDKAESNKIIKESSFVHVEKNLYIVFTPLIDGRDSFMENLFLPETLNIEVDGRKFSPQQEADTKNSYGKNTFATKVVSAKKHSIPFSGFEPLLTRMEEAIIHYRTKIEKK

SEQ ID NO: 1154 - protein, 581 aa, unidentified
  source 1..581: note = Related to NZ_KB902175.1; note = Mariprofundus ferrooxydans
MTELERLRKATTKVDLAKILNLNAPFLTRTLYINKIENQYTQFQIPKRSGGHRTINAPTSELKDIQSRLSKLLLNCIDEINASKNVEPRLSHGFTRKRSIITNAEKHVHQKNVLNIDLSNFFDSFNFGRVRGFFIKNNNFLLHKDIATVIAKIACLNDGLPQGSPCSPVITNLISHSLDIQLASLAKKNSCTYSRYADDITFSTRNREFKPELVKVDGVDIFIGSKLLREVERAGFKINETKTRVQFKDSRQDVTGLVVNKKVSIKSEYWRTTRAMCHQLFISGSYTIKTSTGTREGTINELQGRLNFIDSIDRYNHMRPKGPPDKLHIPIQDRKNYREKLNVREKVFSKFLYYRNFHANEKPTILCEGKTDNIYLKAAIHSLSKQYGLLAKSKTKTTPFELLIKFFNYSKRTRYLLDLHGGGSYLKDFVQHYQENLKYYQKTIPKNPVILLLDNDSGPKELIDLLVHSKKFPDFPNGKDDIKNGEFVHITSNLYLILTPLKGNKDTMIENFFDKKTLSIKVDGRSFDYSKEADSTTKYGKNTFATKVVLENKSSISFKGFKPILSRIEKVIKHYKALSGG

SEQ ID NO: 1155 - protein, 585 aa, unidentified
  source 1..585: note = Related to JABWTG010000018.1; note = Desulfuromonas acetoxidans
MTKLERIRLAKDKKDFAKLLKVSTVFLTNTLYLTPIEDQYEEFQIPKRSGGFRTIHAPTAELKDLQSRLSNLLLDCIDDINKEKEIISTLSHGFVRKRSIITNARLHVRQKNVLNIDLEDFFGSFNFGRVRGFFLKNNNFKLDKNIATIIAKIACLNDTLPQGSPCSPVITNLITHPLDIRLAQLAKKSSSVYTRYADDITFSTRERNFSEKIVSIENKKVTLSKKLKEEIRRSGFNINHKKTRLQFADSRQDVTGLIVNKKINIKREYWRETRAMCHSLFKTGEFTINENGNLRKGTIDELYGKLNFIDSIDRYNHYNCKESLDHRYSLKDRGIDTHREKLNGRESTFSDFLYYKNFIANNKPTLLFEGKTDNIYIKYALKSKSNTSNELKPTKNDNDQLELPVSLFDYTKRTRYLLDLYGGGNYLKFFSQRYKKSLKYYNVKTPQNPVILVLDNDNGPNGLIGWLSSQKIIFPKIEEDNKNNSIRNSDFIHIVSNLYLILTPRDNGNDSMMENLFDDKALSYKIDGREFEPSNEYDSTTKYGKNTFSLKVVKDKHKEINFDGFIPLLLRIAKVIKYHKKFVNS

SEQ ID NO: 1156 - protein, 586 aa, unidentified
  source 1..586: note = Related to WJFN01000003.1; note = Morganella morganii
MVHRRNYLLLKQAKTKPELASLLDVSAAFLTRTLYRPGELSHVNSHYHQFDITKKSGGVRKISAPSDELKELQRRLSDLLLDCKEVIHFDNKVECTLSHGFEREKSIITNARIHRGKKNVLNLDLADFFGSFNFGRVRGYFISNKDFKLDPHIATTLAQIACYKNSLPQGSPCSPVIANLITNSLDIKLAKLAKRNGCSYTRYADDITFSTRKEIFPKDILKNVENTILGSKLLGEIRRSGFSVNPTKTRLQFKDSRQEVTGLVVNKKVSVKSEYWRLTRAMAHSLFKTGKFQIIEQDGSYRNGHLSELEGRLTFIDSVDFYNNLEKKKKPEPKYEPKVHTGINKFRGRLNSREKIYGMFLQYKNFFANEYPTILTEGKTDNVYLKSALSQLQALYPNLVNSKSATTEYSPKLKFPDLNRKTMYLLDIGDGATPFVRFVQRYVDDLKNFEDKKAKNPVILILDNDSGPKDLLNHLVKSVKSCPNDILMLKSSGFIHLFHNLYLILTPLNSGGKDSAMEDLFDSTTLATVIDGKTFSPEKNIDITKQYGKHIFSTKVVRSNKAKINFDKFKYLFDEIEKVKLHFLTL

SEQ ID NO: 1157 - protein, 562 aa, unidentified
  source 1..562: note = Related to NZ_QKLW01000003.1; note = Marinomonas alcarazii
MIHRRNYLLLKQTKTKPELAEILGVSAAFLTRTLYKPGVQSHVNSHYHQFDVAKKSGGVRTISAPSDELKDLQRKLSDLLLDCKSVIHLDNKVECSLSHGFERERSIITNARIHRGKKNVLNLDLADFFGSFNFGRVRGYFISNRDFKLDPHIATVIAQIACYENRLPQGSPCSPVIANLITNSLDIKLSKLAKRNGCSYTRYADDITFSTRKKIFPTAILKDAENVILGSKLLGEIRRAGFSVNPKKTRLQFKDSRQEATGLVINKKVSVKSEYWRLTRAMANSLFKTGKFLIAEQDGSYREGKLSELEGRLTFIDSIDFYNNIEEKKKPEPKSEPKIHNGINKFRGKLNSREKVYAEFLQYKHFFANEYPTILTEGKTDKSDYSPKLKFPDLNRKTMYFLDIGDGATPFVRFVQRYADDLKRFENKKAKNPVILVLDNDTGPKDLLKHLVNKVKSCPNDMGTLKSSGFIHLFHNLYLILTPLNAGGKDSAMEDLFDAATIGTVIDGKTFSTADHIDISKHYGKHIFSTKVVRSNKAKINFDKFKYIFDEIEKVKLHYKKL

SEQ ID NO: 1158 - protein, 586 aa, unidentified
  source 1..586: note = Related to NZ_FOGS01000013.1; note = Halomonas subterranea
MIHRRNYLLLRKAKTKPELASILGVSAAFLTRTLYRSGVKSHVNSHYHQFDIAKKSGGVRTISAPSDELKDLQRKLSDLLLDCKEVIYLDKKVECLLSHGFERERSIITNARIHRGKRNVLNLDLADFFGSFNFGRVRGYFIANREFELDPHIATVIAQIACYKDSLPQGSPCSPVIANLITNSLDIKLSKLAKSNGSSYTRYADDITFSTRKKSFPAAIVKDVKSITLGSKLLGEIRRAGFSVNPTKTRLQFKDSRQEATGLVVNKKVSVKSEYWRLTRAMAHSLFKTGKFQIAEQDGSFRDGHLSELEGRLTFIDSIDFYNNLEKKKQPESKFEPKIHTGINKFRGKLNSREKVYGRFLQYKHFFANEYPTILTEGKTDSVYLKSALNQLQASYPNLVNFKSSKEEYSPKLKFPDLNRKTMYLLDIGDGATSFLRFVQRYTDDLKYFEGKKAKNPVILVLDNDAGPKDLLNHLVKKVKSCPDDIAVLKSGGYIHLFHNLYLILTQLNAGGKDSAMEDLFDAETLSTVIDGKTFSPAKHIDVSKHYGKHIFSTKVVRANKEKINFDKFKYIFNEIERVKLHFSTL

SEQ ID NO: 1159 - protein, 601 aa, unidentified
  source 1..601: note = Related to BMQV01000045.1; note = Shewanella saliphila
MSYFFALTIEECNLIHRRNYLLLKQAKTKPQLASILGVSAAFLTRTLYKPGVESHVNSHYHQFDITKKSGGVRTISAPSDELKDLQRKLSDLLLDCKAVIHLDNKIECTLSHGFERKRSIITNARIHRNKKNVLNLDLADFFGSFNFGRVRGYFIANRDWKLDPHIATIIAQIACYKDTLPQGSPCSPVIANLITNSLDIKLSKLAKRNGCSYTRYADDITFSTRKKAFPTAIVKDVKNITLGSKVLGEIRRAGFAVNPKKTRLQFKDSRQEATGLVVNKKVSVKSEYWRTTRAMAHSLFKTGKFQVAEQNGSFRDGHLSELEGRLTFIDSVDFYNNLENKNHPEPKFEPKVHNGLNKFRGKLNSREIVYGRFLQYKHFFANEYPTILTEGKTDNVYLKSALSRLQTTYPKLVNPKSAKAKYSPKLKFPNLNRKTMYLLDLGDGATPFVRFVQRYADDLKYYECKKAKNPVILVLDNDTGPKELLNHLAKKVKSCPDDIATLKSSGFIHLFHNLYLILTPLNAGGKDSAMEDLFDAATLGKTINGKTFSTANHFDDTKHFGKHVFSTKIVRSGKSSINFDKFKYIFDEIVKVKIHFSKIKN

SEQ ID NO: 1160 - protein, 586 aa, unidentified
  source 1..586: note = Related to NC_008750.1; note = Shewanella sp.
MIHRRNYLLLKQAKTKPELALILGVPAAFLTNTLYKPGVNSHVNSHYHQFDITKKSGGVRTISAPSDELKDLQRRLSDLLLDCKAVIQFDKKIECTLSHGFEREKSIITNARIHRGKKNVLNLDLADFFGSFNFGRVRGYFIANKDFKLNPHIATVIAQIACYKDTLPQGSPCSPVIANLITNSLDIKLSKLAKKNGCSYTRYADDITFSTRKKCFPIAIVKNVESLTLGSKLLGEIKRAGFSINTSKTRLQFKDSRQEATGLVVNKKVSVKSEYWRLTRAMAHTLFKTGKFQITDQDGSVKDGNISELEGRLNFIDAVDFYNNLEKKKHPEPKFEPKAHTGINKFRGVLNSREKVYGRFLQYKLFFANEFPTILTEGKTDNVYLKSALNRLQNLYPNLVTPKSANIKYSPKLKFPDLNRKTMYFLDIGDGATPFTRFVQRYADDLKHFENKKAQNPVILVLDNDSGPKDLLNHLVNKVKSCPNDIATLKNSGFIHLFHNLYLILTPLNVGGKDSAMEDLFDTATLGRTLNGKTFSTAKDFDETKHYGKHLFSTKVIRSDKENINFNKFKYIFDEIEKVKNHFSNI

SEQ ID NO: 1161 - protein, 582 aa, unidentified
  source 1..582: note = Related to BAEQ01000054.1; note = Glaciecola pallidula
MIHRRNYLLLKKAQTKPELASILGIPAAFLTRVVYKPGVSTHYHQFKIPKKSGGARSISAPSSELKDIQRRLSDLLLDCKAVIHVDNKVECTLSHGFERERSIITNARVHSNKKNILNLDLEDFFGSFNFGRVRGYFIANKHFKLHPHIATVLAQIACFENKLPQGSPCSPAIANLITSSLDIKLSTLAKRSGCSYTRYADDITFSTRKSAFPVAIIKDDENLTLGSKLLGEIRRAGFSVNPRKTRLQFKDSRQEATGLVVNKKVSVKSEYWRLTRAMAHSLFKNGKFHIPQQDGTHRDGLVSELEGRLTFIDSVDFFNNLANKKHPASKFEPRVHSGLNGFRGKLNSREVVYGRFLHYKHFFANEYPTILTEGKTDNVYLKSALSILQGTYPNLVTAKTATGPYKPKLKFPHLNRKTMYLLDIGDGATPFVRFVQRYANDLKQFEDKKAINPVILILDNDDGPNVLLNHLVNKVKSCPNDKATLKNSGFIHIFHNLYLILTPLKAGGKDSAMEDLFDKATLARKVGGKTFSTAEHFDNAKHYGKHIFSTKIVRSDKNNINFDKFNHLFEEVEKVIQHYETL

SEQ ID NO: 1162 - protein, 582 aa, unidentified
  source 1..582: note = Related to NZ_RXNU01000007.1; note = Shewanella canadensis
MIHRRRYLLLKQAKTKPQLASLLGVSASFLTRVLYKPGANTHYHKFDIPKKSGGIRKISAPTSELKDIQRKLSDLLLDCKMVNHIDNEIECSLSHGFERERSIITNARVHRGKKNVLNLDLEGFFDSFNFGRVRGYFIANRDFKLDPHIATVIAQIACYNDTLPQGSPCSPVIANLITNSLDIRLARLARKNGCSYTRYADDMTFSTRKSEFPFGIVKDAGNRILGAKLLGEIRRSGFSVNNKKTRVQFKDSRQEVTGLVVNKKINVKSEYWRSTRAMAHNQFKNGSFEVVGINGESRVGTLSELEGRLTFIDSVDYYNNLQNKKHPKPIFEPMKHNGLYQFRDKLNSREVVYSRFLHYKHFFANELPTILTEGKTDNIYLKSALSMLQPIYPNLVKPKTINNQYEPKLKFPNLNDKTMYFLDLGDGATPFLRFVKRYVEDYKYYGNQEAKSPVILVLDNDDGPETLLKHLVKNVKSCPNDLVTLKKSGFIHIFHNLYLILTPLNAGGKDSMMEDLFSPATLSTVIGGKTFSTAKNIDITKEYGKHIFSTKVVRSNKSTISFDKFKYIFNEIEKVKAHFTSL

SEQ ID NO: 1163 - protein, 587 aa, unidentified
  source 1..587: note = Related to NZ_RSFE01000007.1; note = Pseudidiomarina gelatinasegens
MILIHRRDYQLLKKAKTKPELASLLGITAAFLTRVLYHPGANDHYHQFEIDKKSGGKRKISAPSNELKDIQSRLSTLLQNCLDVIRFDTEVSRECLVSHGFERERSIITNAAIHKGKRNILNLDLDDFFGQFNFGRVRGYFIANKHFELDPHIATVIAQIACYENSLPQGSPCSPVIANLITASLDMKLLNLAKSCGCSYSRYADDITFSTRKKEFPSSIVKVLEPLELGGKLIGEIRRAGFSVNALKTRLQYKDSRQEATGLVVNRKVSIKSEYWRLVRAMAFRLFKKGEFEILDVNGEPRMGTLNELEGRLAFIDAIDRYNNIVARRRPKAPWGTIKHTGLNAFKGRHNSREAVYSRFLFYKYFYSSEYPTILTEGKTDNVYLKSALSELQGSYPSLVSPKGQDNAYSPKLKFPNLNKRTMYLLDLGDGATPVAKLVQRYETELAYFHGKKATSPAILILDNDSGPSELLKELAKPKYRSCPNSVTDIKKSGFLHIFENLYLILTPLNSGGKDSMMEDLFDAKTLATPINGKTFSTLSSFDTAKHYGKHVFSTKVVRSSKSSIKFDRFRYIFDEIEKVKAHFAKL

SEQ ID NO: 1164 - protein, 577 aa, unidentified
  source 1..577: note = Related to NZ_JAGPNM010000010.1; note = Rheinheimera sp.
MLLQHARTKPDLALILGVSAAFLTRVLYRPGVDSHYHQFNIVKKSGGTRIINAPSEELKEIQRRLATLLQDCLEVVHFDNKISLECTVSHGFERNRSIITNASVHQGKKKVLNLDLNDFFGSFNFGRVRGYFISNRHFKLNPHIATVIAQIACYDNCLPQGSPCSPVIANLITNSLDMKLSRLAERGGCSYSRYADDITFSTRKSHFPKSIVKAIEPVELGGKLLGEIRRAGFSVNARKTRLQYKDSRQETTGLVVNKKVSIKSEYWRLTRTMAHRLFKKGAYEITEADGELRPGTLNELEGRLAFIDSVDRHNNVVDSRRPKPPYEIEKHSGLLGFKARHNSREAVYSRFLFYKHFYANEYPTILTEGKTDNVYLKSALSELQSSYPKLVNPKTNSKPYKPKLKFPDLDKRTMYFLDLGDGATPFLRFIKRYEAERSYFHDNKAKSPVILILDNDDGPSTILKHLAKEVKSCPNSVDDIKKSGFLHIFQNLYLILTPLKSGGKDSMMEDLFDTKTLNTTIDGKTFSTQSSFDGSKHYGKHVFSTKVIRSQKSSVNFDGFKHIFNEIEKVIAHFEKL

SEQ ID NO: 1165 - protein, 572 aa, unidentified
  source 1..572: note = Related to NZ_JADZGP010000013.1; note = Shewanella algae
MLKQIKTKPELAALLKICPSFLTNTLYIKKSTTNYHDFEIPKKSGGVRTISAPPEDLKEIQRKLADLLQDCKQVIHFDKSIKCSLSHGFEREKSIITNASIHKRKKTVLNLDLEDFFGKFNFGRVRGFFISNKDFRLDPHIATVVAQIACYNDKLPQGSPCSPVIANLITNSLDIKLSKMARKYGCSYTRYADDITFSTRKIEFPKSIIKNNVPLELGGKLLGEIRRSGFSVNPNKTRLQFKDSRQEATGLVINKKVNIKSEYWRDTRAMAHRLFKKGKFDVYDSDGNVRDGKISELEGRLAFIDSIDYFNNVNSKNKVDKQKNGGLNSHLEKLNSRERIYARFLHYKNFFANEHPTILTEGKTDNVYLKAALCNLQNIYPNLVSKKTDTSQYIPLLRFPNLNSKTMYFMDLGDGATPFLRFVQRYTVDFNYYENQKPKSPVIMILDNDDGPKTLLNHLVKNIKSCPNTLPELKSKGFVHLFKNLYIILTPLNTDGSDSMMEDLFDKKTLGTVLDGKTFSTEKSFDEKKHYGKHIFSSKVVRSNKANVNFDKFTYIFNEIEKVRAHFSTLKF

SEQ ID NO: 1166 - protein, 585 aa, unidentified
  source 1..585: note = Related to NC_016745.1; note = Oceanimonas sp.
MIRKRRYLLLKRATTKPELADLMNIDPSFLTRVLYVEKTKSHYTEFKIDKKSGGFRTIFAPSAELKDIQRSLSDLLLDCKDVIQFEKGVKFTLSHGFEREKSIITNASVHRNKKNVLNLDLEDFFGSINFGRVRGYFISNNNFNLDPHIATVIAQIACHNNSLPQGSPCSPVISNLIAQSLDIKLSKIARKNGCSYTRYADDITFSTRKEKFSKSIVKDVENVKVGSVVLKEIKRSGFSVNDKKTRVLFKDSRQEATGLVINKKVSVKREYWRETRAMAHSLFKKDFFEIQEGNSNARKGTLSELEGRLNFIDSIDHYNNIHEEKKPAHKYELKKHSGLYDYKNKLNSREKVYSKFLYYKYFISSEFSTILTEGKTDNVYLKLALSSMRNLYPKLVEVDKETKLYRPLLKFPNLNSKTRYFLDLDGGASHFTRFVQRYVKECEYYGERKPKSPVIMILDNDDGPKSLLNHLANHVKSCPNNIDSIRGSKHLRLFKNLYLILTPLGEYSKESMMEDLFEPTLLDTKLDGKAFSRNDKFDSDKYYGKHVFSTKVVAKNKAQVNFDGFKYIFDRILEVNKHYASLDKV

SEQ ID NO: 1167 - protein, 580 aa, Aeromonas sp.
  source 1..580: note = Related to NZ_JRBE01000001.1; note = Aeromonas veronii
MIHKRNYLLLKLAKTKPELAALLNISPSFLTRVLYHPGVEHHYNSFTIPKSSGGARSINAPSKELKDIQKRLANLLLDCKDVILRDNKVKCTFSHGFERKKSIITNAAQHQNKKVVLNLDLSDFFGSFNFGRVRGFFISNRYFKLDPHIATVIAQIACFNNSLPQGSPCSPIISNLISNSLDIRLSTLAQKNGCTYTRYADDVTFSTRKPTLPTSILKELNPVTLGSRLIKEIESAGFLINHKKTRVQLKDSRQEATGLIVNKKVNIRAEYWRDVRAMAHSLFKYGSYEIKEMNGNKRKGTIQELEGRLTFIDHLDHYNNIIRSKKPKPIFEPAKHLGLFHFRNKLSSREKTYSIFLFYKHFYANSYPTIMTEGKTDNIYLKCALNSLQNEYPSLAKKKSITQQYEPKLSFLNLNKKTMYFLDIEGGASHFQRFVARYESEFKYFTNQSPSAPVIMILDNDSGPNALINDLSKKQSSNSVPIRKQRFTHIIHNLYLILTPLGNSENTMMEDLFDKNTLSIKIDGKSFSKKDNFDIKKEYGKHIFSTKVITQHRDTIDFHKFKYIFDAIVDVCSHFSGNKG

SEQ ID NO: 1168 - protein, 585 aa, Vibrio sp.
  source 1..585: note = Related to ABBKEB010000006.1; note = Vibrio vulnificus
MINLLPYFLLKQAKSKSDLASALGVTPSFLTNVLYRQRPENLYTDFDINKKSGGKRTISAPSDQLKDLQRRLSVLLLNCKDAIHYNQGTKFTVSHGFEREKSIVSNAAVHRNKKNVLNLDLMDFFGTINFGRVKGFFEKNRSFALAPEVALTIAQIACYQGKLPQGSPCSPVIANLIANTLDMRLVKLAKKCGCSYTRYADDITFSTRKSAFPKEIVKFTDGHSYELGGKLVNEIKRAGFDINPDKTRVQYQNSRQDVTGLIVNKKVNVKSEYWREVRAMAHQQFKKGSFHIADSDGKPRAGELSELEGKLTFIDQVDKYNNIQRKKQPKILFSLAPLKLSEHRLTLNSREKTYSRFLYYKYFYANNYPTILTEGKTDNVYLKCALNRLQKDYPTLVESTHSKTTQYKPKLLFPHLDKRTYYFLDLDGGATHFLRFIQRFSEEFSYFENQKPKSPVILVLDNDDGPKTILTHLAGKVKNCPNTVDEIRNKPFIHIFHNLYLVLTPLSGGGGTAMEDLFTQDTLQQVVDGKVFSRKDKLDTNKEYGKHIFSTKVVRDKMQEVDFAGFKPVFDAILAVNAHFSRLRF

SEQ ID NO: 1169 - protein, 587 aa, Vibrio sp.
  source 1..587: note = Related to MAKF01000119.1; note = Vibrio splendidus
MSKNKSLLKLQEAQTKPDLAKLLGLKSHFLTYILYKTDIDSHYKEFEVKKKTGGVRVISAPSPELKDIQRRLSKLLLDCKDAIMVKNDIKKECMLSHGFERHKSIASNAYVHIGKKNVLNIDLEDFFGTINFGRVRGFFIKNRDFQLDPDVATVLAQIACHNNKLPQGSPCSPVIANLITNSLDIKLSKLSKSKGCSYSRYADDITISTRKAEFDKSIVKLVNGDITLGKRLVQEISRSGFSINPKKTRVQFKDSRQDATGLVVNKKVSVKSDYWRTVRAMAHSQFKKGSYETVNKKTGLVMKGSLAELGGKLAFIDSIDRFNNYLKKSHPKPIYELVQHKKSASYRNRLNGREAVYSRFTYYRTFYANEYPTILTEGVTDPIYLKSALYGLRQMYPNLVRRKLLDKTYKPKLLFPEFDSRTKYFWDLDDGAGTFSKFLERFESEFHYFKNQKPKNPVILVLDNDDGVGTLLGKLTNKKYPNCPVKTEDMRNQEFTHIFHNLYMILTPRKKGQAESDIEELFDEKTKAIKLDGKSFSKEPNPENEYGKKPFALKVVRANRDTIDFTNFKPIFDTIEKVKLDFEKRYS

SEQ ID NO: 1170 - protein, 604 aa, Vibrio sp.
  source 1..604: note = Related to CP016228.1; note = Vibrio crassostreae
MPAAQGSVYKPTFFLPIYVTFMKSTQQDSIDCLNELKNAKTKSDLAHILGITPSFLTRVLYVEGTQNQYVQFSITKRSGGTRTISAPSIELKDIQSRLSKLLLDCNDALNFREGRKGGASHGFERKKSIISNAEKHKNQKNVLNLDLEDFFGTVNFGRIRGYFIKSKDFALNSDVATTIAHIACYDRKLPQGSPCSPVIANLIARILDVRLVKVAKKYGCTYTRYADDITFSTRKKVFPSSIVESVNDKDVVLGTSITREIRKCDFKINHKKTRVQFKDSRQDVTGLIVNKKVNIKREYWRDARSKCHKLFTDGEFFTKNSNGDKVVGKIKELEGTLTFIDSVDEYNNKRPKGYEKPVFQKIHKQKHYRIRLNVRERTYSEFLYYKWFCANETPTILTEGKTDVVYLKAALSQLASDYPMLAKSEPYKPQINFFGCSGKTNYLLNLDGGAAHFIDFVNSYELNASMYKNIKKTSPVIMILDNDTGPVNLLNQLKGKYGLPQTVDEIRKSNFLHIKSNLYLILTPLNGSSKTDMEDMFEDHVLNAEVKGKKFNKSNNINTSKEYGKHIFSLKVVQARKSKISFSGFCPIFDAINNVINHYDKMKS

SEQ ID NO: 1171 - protein, 597 aa, unidentified
  source 1..597: note = Related to NZ_LR134189.1; note = Providencia rustigianii
MRKGVPAYSNLSEIIYMRNNMSSLNKLKSARNKVELAKVLGVSPVFITNILYIIKKENQYTTFTIKKKSGGDRVISAPNDSLKNLQQKLSDVLLNCLDQIRKDENISTNISHGFERKKSIITNAMKHIKKKNVLNLDLEDFFDCFNFGRVRGFFIKNNRFSLNEEVATVIAQIACFDNKLPQGSPCSPVITNLICSSLDIKLNKLAKKNKCTYTRYADDITFSTNKQSFDTEIVSSKSTFSDIIIGNELDKEIKKSGFKINSRKTRLQTKNSRQDVTGLVVNKKINTKVEYSKSVRAMCNTLFKTGSYTLIDRKTHEERNGTVNELGGMLSFIDYIDRYNNIIYKKSIDRPINNKVKIEKKLNKRERVYSDFIYFNKFHNNDFPTIITEGHTDQIHIKCALTSLNGNYNNLIENHDKNYHLKFRFLKLSNKLKWLLNISEGTDPIKKFISNYICNYRKYPCFKAKKPVIIILDNDSGSKGSGGILSILTNGSFSNITEDRNSLRRKNYIHVYENLYIIFTPMISDKDSCIEDLYDKEILETKLNGKKFKNSNIDLKVDEYSKNHFAKYVIQNNIENINFSNFKSILNTIDEIIRIYQ

SEQ ID NO: 1172 - protein, 575 aa, unidentified
  source 1..575: note = Related to WLUH01000023.1; note = Providencia sp.
MSSLTKLKSAKNKVELAAVLGVSPVFLTKTLYKIKVENLYTSFTIKKKSGGDREILAPDDSLKDLQQRLSNILLNCLDDIRKNESTSTNISHGFERKKSIITNALKHTKRKIVLNLDLENFFDCFNFGRVRGFFIKNDRFLLNEEVATVIAQISCVYNKLPQGSPCSPVITNLICSSLDIKLNKIARKNKCTYTRYADDITFSTSKISFGNEIVSPNSTNKDIVLGKKLKKEIIKSGFTINYKKIRIQNKNSRQDVTGLVVNNKVNTKIEYHKNVRAMCHNLFKTGNFNLIDRETKKERIGTIDELEGMLSFIDNIDKHNNIIYKKNIKTNSKKSKLEKNLNKRERVYSDFIYFRKFHSNELPTIITEGHTDQIHIKCALTSLYSDFPNLIEMKNENYHLKFNFLKLSKKNKWLLGMGEGTDPIRFFISNYIKNYNKYPCFKAKKPVIILLDNDSGSKGSGGILSLLTQGTFSNIKENRNELRKKKYIHVYENLYVIFTPLIKGNDSCIEDLYDRKTLEKKLNGKKFKNSNLNLKPDEYSKNHFAKYVIQDNIENINFDNFKQILESLDKIILEY

SEQ ID NO: 1173 - protein, 581 aa, Proteus sp.
  source 1..581: note = Related to JAGKMM010000039.1; note = Proteus mirabilis
MKSRSLDLLRQTNNKVDLAKLLGVSPVFLTNTLYRIKVETLYNQIKIPKKTGGIRYIYSPDSRLKEIQRNLSNLLLNCLDEIRAENKTKAIISHGFEREKNIITNAKKHINKNIVLNLDLESFFDSFNFGRVRGFFIKNKYFLLNDEVATVIAQISCLNIQIGERKISILPQGSPCSPVITNLISSSMDIKLNSLAKRNRCTYTRYADDITISTNLMSFGKQIVKDVDENNNVSLGNKLISYIEKSGFVINDKKTRIQYKNSRQDVTGLLVNKKINPSRKYSDILRSMCNSLFNSGEFELIDKEKKKRKGTINELEGKLSFVDQIDRFNNKDILSKGGVLLKNRRENLYSKFIYFKKFIFNDEVTVITEGHTDHIYIRSAAISRKDKFNDLIKEDNKKIKLNFSFLKINNKIEYLLDVREGTSSIKKFIERFPENYSKYNIGKPKKPVIIILDNDSGSSGSGGIFQLLISDKFKNITNDKDEIRNVEFIHVFGNLYIIFTPLKDGKDTSMEDLFSDEILNKKMNEKKFNRTNKKCKNDEFGKDYFARFVIKPNVKTIDFSKFDTIFNRIKLVISDYEKKEI

SEQ ID NO: 1174 - protein, 585 aa, Proteus sp.
  source 1..585: note = Related to JH815505.1; note = Proteus mirabilis
MTSPLIKLKSCKSKPDLAHLLRLDPVFLTRVVYIRNTDNLYTDFSIKKKNGTNRIISAPDSELKEIQSKLSKLLQDCLDDIRESLKLNNTISHGFERKKSIITNAEKHKRRKWILNLDLSNFFDEFNFGRVRGYFLKNKNFSLDETICNLIAKIACYKNRLPQGSPCSPVITNLILLSLDQRLNKICKSVGCTYTRYADDITISTNKSFFPTKIVTSYDNESIVLNKKFLKEITSSGFSLNEDKIRLHNKTYRQEVTGLTVNQFVNVNAKYARKVRAMTHSLFINGIFHLVDKKTREIRAGTINELAGMLGFIDSLDKHNNKNIRDRTLQYSNKDKKLEHNKREKLYANFLYYKAFYANTRPMIITEGKTDITYLRVALNSLAGSYPSLIEKKLVGSDSICDYKLTFFKNSGKTKYFLNLDGGTGHLKDFLSKFDKKSKQYKGNENMNPVIMILDNDSGSDGSGGIFSILNGKSFPNITSSKDELRNKEWLWVIQNLYIIFTPLNGAKDSSMEDLFDKETLDIKLGNKVFNKTNKPCTENQYGKEAFATGVVLKQRENIDFSGFSLIFNSIVKIIEHYNSIKQMN

SEQ ID NO: 1175 - protein, 578 aa, unidentified
  source 1..578: note = Related to NZ_CP086257.1; note = Providencia rettgeri
MPTRLEKLKKCTSKPDFARLLGVDPVFLTRVVYIRNTEKLYTEFKIKKKNGDDRIISAPDKELKEIQSKLSKLLLDCLDNIRSSLEIDNNFSHGFERKKSIISNAEKHKRKKWILNIDLKNFFDEFNYGRVRGYFLKNNYFSLNENICNLIAKIACYKNKLPQGSPCSPVITNLILLSLDRRLNQICKNSGCTYTRYADDITISTNKSIFPKKIISSYEENSITLGKKFINEIISSGFTLNEKKIRLHDTTHRQEVTGLTVNQFVNVENKYARKVRAMVHSLFTKGEFYLIDKVTQEARLGTVNELTGMLGFIDSLDKYNNKILKNTIKQSNFNIELNKREKIYANFLYFKSFYFNAKPVLLTEGKTDITYLRVALDSLAYKYPDLIGYKENGRNKIRDYKLTFFKNSPKTKYLLNLDGGSSHLKEFLNNFEKKARIYKTSGEINPVIIILDNDSGSGGNNGIFESLMNKLRGKISSKEELRSKKWIWVTQNLYIIFTPLNGKKESSMEDLFDKDTLNIKLGGKVFNRTNSKCTAEQYGKEVFANGVVLKKRKSINFSGFSPIFDAISEIITYHNSSK

SEQ ID NO: 1176 - protein, 573 aa, unidentified
  source 1..573: note = Related to NZ_JAJAVX010000005.1; note = Yersinia bercovieri
MATRLEKLKECYSKPDFSRLLGVDPVFLTRVIYIRNTDKLYSEFTIKKKNGSDRVISSPDSELKEIQSKLSNLLQDCLENIRESLKLENNLSHGFERKRSIISNAEKHKQKKRVLNLDLSNFFDEFNFGRVRGYFLKNNQFLLNESICNLIAKIACYNNKLPQGSPCSPVITNLILLSLDQRLNKICRNAGCTYTRYADDITISTNKSIFPKNIITSHEDDLVTLNKRFIKKITSSGFSLNERKIRLLDTKCKQEVTGLTVNKFVNVDDKYARKVRAMAHRLFIDGEFHLIDKKTHKKRVGKINELAGMLGFIDSLDKHNNTFPHNKKLSLNKRERIYSKFIYYTAFCANTIPTILTEGKTDITYLRVALNSLADKYPNLIGDKKVANETVRDYKVKFFKNSAKTKYFLHLDGGSSHLKEFLVSFDKKTDGYKTVRNSNPVIMILDNDSGSTGGNGIFQALIGKSFPNITMSRDELRSQKWIWAVKNLYIVFTPLNGSKDSSMEDLFDVPTLQTKLEGKVFNRTNEKCAENEYGKEAFATGVVLRQRKSIDFSKFSSIFDSIIEIIDHHKDKE

SEQ ID NO: 1177 - protein, 574 aa, unidentified
  source 1..574: note = Related to NZ_VOUX01000033.1; note = Serratia bockelmannii
MTTRLEKLKACNSKPDFARLLGIDPVFMTRVIYIRNTDNLYSQFAIKKKNGSDRIISAPDSELKEIQSKLSDLLQDCLNNFRENLKEDNHFSHGFERNRSIITNAEKHKSKKWVLNIDLCNFFDEFNFGRVRGYFLKNNNFSLNTELSTLIAKIACHQDKLPQGSPCSPVITNLILVSLDRRLSNLCNSVGCTYTRYADDITISTNKKEFPKGIIRDHDEKSITLNNKFLNEITSSGFKINHNKLRLLDKKIRQEVTGLTVNRFVNVDRRYAKTVRAMAHSLFKKGEYTLIDKKTRKERVGNINELGGMLSFIDFVDKYNNRLPHSIKSSHNNREKVYSDFLYYSAFWANTKPTILTEGKTDITYLRVALDAVSEKHPNLIGNKNPGNKTVRDYGIKFFKNTSKTKYLLNLDGGAPHLKDFIVGFEKKTEAFKVIANQKPVIVILDNDSGSAGANGIFQILIGKSFPNITLTRDELRNQKWTWVTRNLYIIFTPLNGLKDSSMEDLFHSSVLQTTLGGKVFNRTNTKCKDNEYGKEFFATGVVLKKRKTIDFSNFNYIFESISEIIEHNNSRKK

SEQ ID NO: 1178 - protein, 574 aa, unidentified
  source 1..574: note = Related to NZ_CP067391.1; note = Klebsiella grimontii
MTTRLDKLKSCNSKPDLARLLGIDPVFMTRVIYIRNTDNLYSQFTIKKKNGSDRHISPPDPELKEIQSKLSDLLQDCLNNIRENSKEENNFSHGFERNRSIITNAEKHKSKKWVLNIDLSNFFDEFNFGRVRGYFLKNKNFSLNTELSTLIAKIACHQDKLPQGSPCSPVITNLILLSLDRRLSNLCNRAGCTYTRYADDITISTNKKEFPRKIIKSHNENSIDLNKKFLKEIISSGFQINLNKLRLFDRKCRQEVTGLTVNRFVNVDNKYAKKVRAMAHSLFTKGGYTLTDEKTREQRAGNINELGGMLSFIDYVDKHNNRLPHATKTSLNKRENVYSDFLYYSAFWANPKPTILTEGKTDITYLRVALDSLSANYPNLIGNKKIGNKIVRDYGVKFFKNTTKSKYFLNLDGGASHLKDFIVGYEKKTNAFKAIAEQKPVIIVLDNDSGSGGSNGIFQTLIGKAFPNITLSKDELRNQKWTWVTKNLYLIFTPLNGLNDSSMEDLFHSSVLQTKLGGKVFNRTNAKCKDNEYGKEFFATGVVLKQRKAINFSNFNYIFESITEIIDHNASRKP

SEQ ID NO: 1179 - protein, 576 aa, unidentified
  source 1..576: note = Related to UKYY01000005.1; note = Klebsiella pneumoniae
MTTPLDKLNSCNSKPDFARLLGIDPVFLTRVVYIRNTDNLYSQFTIKKKNGSDRFISAPDDELKEIQRKLSNLLQDCLSNIRESLKVENNYSHGFERNKNIITNAEKHKNKKWVLNLDLSNFFDDFNFGRVRGYFLKNNNFSLNAEISTLIAKIACHNNKLPQGSPCSPVITNLILFSLDRRLSRICQQVGCTYTRYADDITISTNKSTFPRNIIKSLENEKINLNRKFLKEITSSGFSLNPEKIRLHDRKCRQEVTGLTVNQFVNVDNKYAKKVRSMVHHLFTQGEYQLVDKKTGEKRNGKINELAGMLGFIDSLDKYNNSLSHERNATLNKRERLYGEFKYYTTFWANTIPVILTEGKTDITYLKVALSSLAAKYPNLIGEKKLSNKVVHDYKIKFFRNTAKNKYFLDLDGGTSHLKNFMMKYNKKTDAFKLVATQQPVIIVLDNDSGSTGSDGIFNALVGKSFPNITDSMVTLRNKKWVWVTKNLYIIFTPLNGKSDSAMEDLFEDSVLQRQLGGKVFNRTNKRCEANEYGKEAFATGIVLKQRDNINFSKFSSIFDSVMEIIQHHAHQKSSS

SEQ ID NO: 1180 - protein, 580 aa, unidentified
  source 1..580: note = Related to JAHVXV010000003.1; note = Pantoea allii
MTTRLKKLQNCKSKPDFARLLGIKPVFLTRVVYIRNTEKLYTDFKINKKNGDKRIISSPDPELKEIQSRLSTLLQDCLTDIRDSHEVINNLSHGFERERSIITNAEKHKRKKWVLNLDLSNFFDEFNFGRVRGYFIKNSNFKLNEEVSNIISKIACYNNRLPQGSPCSPVITNLILHSLDQRLNLICKKVGCTYTRYADDITISTNKSEFPKKIIASCESNIVNLNQIFLKEITKSGFSLNFSKVRLLGKNCRQEVTGLTVNKIVNVSDKYTRNVRAMANNLFKNGEFYLFDKQTNQKRLGSINELTGIFGFIDSLDKHNNKISHKNQGSLNKRERLYSDFLYYKSFCANEKPMILTEGKTDITYLKVALDSLAKDYPTLIGDKEERMSYVRDYKISFFKNSIKSKYLLKLDGGTPHLKDFLVNYDKKSSKYSKSKNEKPVIMILDNDSGSNGGGGIFQCLLGKSFPNITIDSKKSLRDEKWIWVTKNLYIIFTPLNGKQESSMEDFFDESVLKRTLSKKTFNRSNNKCKDNEYGKEAFAKGVVLKRRKKINFTKFSIIFDSINEIINHHESVNNLKTIA

SEQ ID NO: 1181 - protein, 572 aa, unidentified
  source 1..572: note = Related to CP003085.1; note = Pantoea ananatis
MTTQLARLKLCFSKPDFARLLELDPVFLTRVVYMRDTEKLYTDFTILKKNKTQRVISAPDEELKEIQRKISDLLLDCLTTIRNENKSNNKLSHGFELGKNIITNAERHKSKKWVLNIDLLNFFDQFNYGRVSGYFIKNKFFELHSNIANLIAKIACYKNKLPQGSPCSPVISNLILQSLDQRLNNICKKNGCTYSRYADDITISTNKKKFPKAIVSNHSDKEINLNNGFIKEILRAGFSINNDKTRLRFNTLRQEVTGLTVNSKISVDDKYSRRVRSMVHKLFLSGEYTLIDKKTREPRFGTINEIQGMLGFVDSIDKYNNNLPNNSKHTPNKRERLLADFIYFTRFHFNTKPTIITEGKTDITYLRVALNALCKKYPSLIEKKKSYKGEINDYKFSFFIKNAKTKFLLKLEDGSSHIKNFIKDYDRNIEKYKADGGVNPVIIILDNDSGSTGSGGIFSLLLSNVFPNIKLSREDIRKVDWLWVTKNLYVIFTPLKDGQDSSLEDLFDTKTLATTLNGKVFNNTNKDCKPNEYGKEYFAKHVVLKNKDTIDFKNFIKIFDSIEEIIKHHSKK

SEQ ID NO: 1182 - protein, 571 aa, Citrobacter sp.
  source 1..571: note = Related to CP056336.1; note = Citrobacter freundii
MSTKIELLKQCTTKPDFARLLGLDPVFLTRIVYRKDTENLYSNFTILKKDMSERHISSPDSKLKEIQRKVADLLLNCIEDIRVLTESKNLLSHGFEKQRSIITNAERHKRKKWVLNIDLSNFFDQFNYGRVRGYFIKNTHFALDENIANMIAKIACYQNKLPQGSPCSPVITNLILSSLDQRLNKICKNSGCSYSRYADDITISTNKKTFPSEIVKSYDAEHVELNKNFTKEIMRAGFSLNDKKTRLQGRTQRQEVTGLTVNYNLSTDVNYSKKVRAMVHHLFMDGNYTLIDKKTRKPRNGTINEVEGMLGFIDSIDKYNNKLAYRAKGGLNKREKLYANFIYYRSFHSNEKVTILTEGKTDVTYLKVALHMLKGKYPTLISSKTVSHKTVNDYKLSFFKNNNKSNYFLGLGEGSSHFKNFVKKYQGKISEFKAVGGRKPVIIISDNDSGANELISLLNGKGFPHITSDKNELRKNKWLWITENLYIILTPFDGKTDTSIEDLFDTKTLSRSLNGKTFNRTNKECALNEFGKEYFAKHVILKDRDLIDFNMFSYIFDAILEIIKEHDSKVS

SEQ ID NO: 1183 - protein, 646 aa, Escherichia coli
  source 1..646: note = Related to CP061264.1
MFINTHVGRFVGCESQPVALMAGGIASLKSLIQSYTAGVLCEGVPACVSPWPFFLWDEEEMTKTSKLDALRAATSREDLAKILDVKLVFLTNVLYRIGSDNQYTQFTIPKKGKGVRTISAPTDRLKDIQRRICDLLSDCRDEIFAIRKISNNYSFGFERGKSIILNAYKHRGKQIILNIDLKDFFESFNFGRVRGYFLSNQDFLLNPVVATTLAKAACYNGTLPQGSPCSPIISNLICNIMDMRLAKLAKKYGCTYSRYADDITISTNKNTFPLEMATVQPEGVVLGKVLVKEIENSGFEINDSKTRLTYKTSRQEVTGLTVNRIVNIDRCYYKKTRALAHALYRTGEYKVPDENGVLVSGGLDKLEGMFGFIDQVDKFNNIKKKLNKQPDRYVLTNATLHGFKLKLNAREKAYSKFIYYKFFHGNTCPTIITEGKTDRIYLKAALHSLETSYPELFREKTDSKKKEINLNIFKSNEKTKCFLDLSGGTADLKKFVERYKNNYASYYGSVPKQPVIMVLDNDTGPSDLLNFLRNKVKSCPDDVTEMRKMKYIHVFYNLYIVLTPLSPSGEQTSMEDLFPKDILDIKIDGKKFNKNNDGDSKTEYGKHIFSMRVVRDKKRKIDFKAFCCIFDAIKDIKEHYKLMLNS

SEQ ID NO: 1184 - protein, 493 aa, Enterobacter sp.
  source 1..493: note = Related to NZ_QZCS01000001.1; note = Enterobacter chuandaensis
MKKNKSIILNAYRHRNKRIILNIDLSNFFGSFNFGRVRGYFMSNKDFLLNPIVATTIAKAACYRGVLPQGSPCSPVISNLICSIMDMRLAKLAKQYGCSYSRYADDITFSTNKPSFPTELALLQPEGVILGKYLVNEIKRAGFEINDAKTRLAYKPSRLEVTGLTVNKIVNVERRYSDKTRALAHTLYTTGEYKLPDENGDEVAGSLDKLEGMFGFIDQLDKFNNIQKKKSKQPEKYALAPATLHSFKSKLNAREKAYGKFIYYKFFHGNTCPTIVTEGKTDRIYLKAALRALSNNYPELYRERKDKKGKEIDLNILKITDKLNYFLNISGGTADLKKFVERYREHYSSYYGSIAKQPVIMVLDNDTGPNELLNFLKNKVKQCPDDVGAIRRMRYLHIFHNLYLVLTPLTEGGNETSMEDFFPTEVLSIELDGKIFNKNNDGDSKTEYGKHVFSVKIVKDKKRVIDFNRFSYIFDIVREIKIDYQKILIKNKP

SEQ ID NO: 1185 - protein, 518 aa, unidentified
  source 1..518: note = Related to NZ_JAJNQS010000015.1; note = Lelliottia nimipressuralis
MVATSKLLLLKVASSRADLAKLLDVKLVFLTNILYRIGTDSQYKDFSIPKKGKGVRLISAPEDSLKDLQRRIADLLMDCRDENFKIKKIKNNYSFGFERNKSIISNAFRHRGKNIILNIDLKDFFESFNFGRVRGYFLSNRDFLLNPIVATTLAKAACYKGSLPQGSPCSPVITNFICSIMDIRLAKLAKSLGCSYSRYADDITFSTNKKEFPAELAISLPEGVVLGGILVSEIKRAGFDINDAKTRLSYKSTRQEVTGLTINRFVNVDRKYSNKTRALAHSLYSKGEYKLPDEDGKLVVGSIEKLEGRFGFIDQIDKFNNIQNKLSKQPEKYAPIHITLKNYRLKLNAREKAYSKFIYFKFFHGHASPTILTEGKTDRVYLKSAIRSLSTKFPEFLKKSADGKRNDINLNIFKSDEKSSYFINMSGGSADLKKFIERYMDEYSSYYGSIPKHPVIMLLDNDSGSDEVLNFLKNKVKSCPDDTDIMRKMSFIHVFKNLYIILTPLNASGEQTAMDYRV

SEQ ID NO: 1186 - protein, 591 aa, unidentified
  source 1..591: note = Related to NZ_CP084222.1; note = Arsenophonus sp.
MTDTKKIDALKNASSRSDLAKLLNVNVIFLTNILYKVGTDNQYKQFSIPKRGTGIRVISAPNDKLKDLQRRIANLLIDCRQELFNSKKIKNNFSFGFEKDKSIISNASRHKGKRIILNLDLRDFFGSFNFGRVRGYFISNRDFKLTPVVATTLAQAACYKGVLPQGSPCSPVITNFICNIMDMRLAKLAKELGCTYTRYADDITFSTNKKIFPEELAIPELEGVILGSRLVNEITKAGFKVNDAKTRLAYKSSRQEVTGLTVNQIVNVDRRYAKKVRALAQTLYSTGKYKLPDKNGNMILGNLARLEGMFSFINFIDKSNNIENKKNKQPEKYVKVQEKLNGYRLRLNAREKAYSKFIYYKYFHGNTIPTILTEGKTDRIYLTTALHSLSAIYPNLIEETNNGKKIKLNICKSNTKASYFLDLSGGTANLKKFVMRYRDEYELYYGTDAKNPVIIILDNDSGPNKLLDHLKNKVENCPNDVKSMRRMKYIHVTHNLYIVLTPLSESVRETSMEDLFSPEVLNITLNGKYFNKANDQDTETEYSKHIFSTKVVRDKNRNIDFKGFKPIFDAIEAIIKHYQELSKSRIINKAR

SEQ ID NO: 1187 - protein, 586 aa, unidentified
  source 1..586: note = Related to QKNL01000001.1; note = Klebsiella pneumoniae
MKNTPGLDDLKAATTRRDLAKLLNVKLVFLTNVLYRIGVDNQYSNFPIPKRSGGVRIISAPSSKLKDLQSKIAKLLINCRQEIFAINGIENNLSHGFEKDRTIITNALKHRGKNVVLNLDLSDFFKSFNFGRVRGFFLYNKDFKLHPDIATTIAKAACYQGSLPQGSPCSPVITNLICNILDVRLAMLAKKLGCAYSRYADDITFSTNKKDIPEELALNVTDGVTLGRKLRNEIERAGFEINDSKTRLSFKPARHEVTGLTVNRFVNVDRRYSKKVRALAHRLYQTGSYTIKNADGEVDGTLQQLEGMFGFIDQIDKFNNIVNKKNRKKEKYILAKQSILEHRSRLNAREKAYAKFIYYKNFHGSIIPTIMTEGKTDRVYIKTALLSLSGRYPGFIIRDNKTKKEKINLKIINPQFKEKYFLDIEDGAASFEKFVRRYDSEFKSFYGTKANNPVVMILDNDTGPNELLNYISRECPTCPNTVEDIRKMPFVHVMHNLYLILTPLDATGGMTAMEDLFDAKTLGKDLEGRKFNRGKKFNPKKEFGKDEFSIKVVRDMAKDIDFNGFNSIFEALTDVVKHYRDSIKAP

SEQ ID NO: 1188 - protein, 441 aa, Escherichia coli
  source 1..441: note = Related to AP022044.1
MFKPTYLARLQACCNKFELADLLQIKVTFLTNVLYRIRPENQYKKFTIKKKSGGEREIFAPDEKLKDIQQRLSELLYICQEEIWAKNNIKQNVSHGFEKNKTIITNAERHRDKNIVFNIDIENFFPSFNFGRVRGYFIANQNFKLHPNVATIIAQIACLDGSLPQGSPCSPVITNLICRILDFRLSKLAVTYGCSYSRYADDITFSTNKKNIPDALVSNEKENEPGKILVEEIHRAGFTLNHNKNRVSRCTSRQQVTGLTVNKKINVSREYIKNTRAMAHSLYFEGSYTLIEKDGKHRKGTLSELEGRFAFIDMLDKYNNVEAKKNARPERYVVKGFGLDFKQRLNSREKAYSKFLYYKNFYGNEQITILTEGKTDPVYLKCAIDSLFLDYPQLVREEKNTKNRVLKVNLFKTNDKKKIFSRFVWWSCRLFEVFQTTWFTL

SEQ ID NO: 1189 - protein, 589 aa, Enterobacter sp.
  source 1..589: note = Related to JABXQH010000001.1
MEFTIMFTPSYLERLKSCKTKFEFARLLQIKVSFLTNVLYRIRPEHQYERFIIKKKSGGDREIFAPTEKLKDIQRRLSDLLYVCQSEIWKTNNITPSLSHGFEKNKTIITNAERHRNKTNVLNIDLEDFFPTFNFGRVRGYFIANQYFNLHPSIATIIAQIACYDGKLPQGSPCSPVISNLICNILDIRLSKLALSNGCSYSRYADDITFSTNKNQFPDSIVINENSNELGPLLVNEIEKAGFKINNNKTRILRHTSRQEVTGLTVNKKINVNKDYIKKTRAMAHALYKEGDFTLLDISGKPRKGTLNELEGRFVYIDMLDKYNNINAKKHTLPEKYVLKKTGINFTLKLNSRETAFSNFLHYKYFYGNIKPTVLTEGKTDPIYLKCAIDSLYLSYPALVRVDDRTKNRILNITLFKTNAKKEYFLDLYGGAADYVRFFRRHREQCKKFERQPPKNPVIIVLDNDTGPSDFINNIIKEYSHLPRKSEDVRKHKFLHLENNLYVLLTPLLAGDKQSCMEDFFKDEVLTKTINGKSFDKSNNHDSTTTFGKDRFANNIIRENRQTIDFSLFKPILDAMVDINNHFKNLYYP

SEQ ID NO: 1190 - protein, 579 aa, unidentified
  source 1..579: note = Related to CP047281.1; note = Klebsiella quasipneumoniae
MVAPTTIERLRLITTRQELAALLNLKAHFLTNILYRNGVNTQYSQFRIPKKDGSFRLISSPSSKLKDIQKRLAELLYECQANIHFERKINPVLSHGFEKNKTIVTNATRHRNKRILLNIDLENFFESINFGRVRGFFIANNDFKLSPLIATTIAQIACFNNSLPQGSPCSPIISNLICTILDIRLSKLAQKNGCQYSRYADDITFSTNKKEFPQELVIDNDVVNVGAVLLKEIERAGFRINHRKTRLLYSTSRQEVTGLTVNKKVNVDNRYYKKVRAMAHTLYKDQSFAIIKENAKPQKGTLNQLEGMMSFIDSIDKYNNKLKLANKQPQKYQSFNYGLNYEGKLNRREKTLSKFLYYKYFHGLHVPTILVEGKTDRVYLKCALRSLFLTYPTLVKKNNATGNINYSLNFFRESTRTSYFLDISGGAAEFEKFITRYPEQYKRFNHTPLYPVIMILDNDSGTRTIVRKISKSLGVTEDSIKKNSFTHIIHNLYIVLTPLLPGDRDSCMEDLFDSSVLSTVIDGRSFDKSNNYNKSTHYGKNDFSLKVIKVNEKNINFSGFLPVLNAVRDCLVHYNNISK

SEQ ID NO: 1191 - protein, 585 aa, unidentified
  source 1..585: note = Related to WBVV01000002.1; note = Klebsiella pneumoniae
MAPLSILERLQNAANRQDLASILNLKTAFLTDVIYRLKAETQYTQFTIPKKNGAPRVISAPTTKLKDIQRRLADVLYLCRAEIYKKYNINPVLSHGFEKEKSIITNAERHRGKTLLLNIDLEDYFDSFNFGRVRGFFLSNRDFRLNNTVATTIAQIACFQNGLPQGSPCSPIISNLISGVLDIRLSKLAKKYGCNYSRYADDLTFSTNKKTFPKEIADVGGESVTLSPTLIKEIIKAGFKINDKKTRVCYKTSRQDVTGLTVNKKVNVGKEYAKVTRAMAHSLYKDGSFVIVTESGKIEKGTCAKLEGRFGFIDSIDKYNNLKLKNARQLEKYQSVNHGLNYTAKLNSREKAYSYFLYYKNFHGMEMPTILTEGKTDRVYLKCALKSLANSYPLLFNSSDDSSKNEYRVNFFKATEKTSYFLDISGGATDFKRFILRYQEQKKRFEKFKPKHPVIMLLDNDSGPKDLLNHLKDKVKNCPNDVDTIRKARYTHIFDNLYLLLTPLLPGGKESCMEDLFDSTVLSTVLDGKTFNKSNDTDTKTEYGKHVFSTKVIKANCKTISFEKFKVIFDGIEEIIADYSKRCKV

SEQ ID NO: 1192 - protein, 545 aa, unidentified
  source 1..545: note = Related to JAGOYO010000023.1; note = Vitreoscilla sp.
MKISRLKLLSSPSELAQLLNIPQKFFLYHLYGQQPTNQYMQWSIPKKNGGKRNITSPNPELKMIQSRLANYLQECLQEIRSNQNFHINLSHGFEVDKSILTNAEIHIGQKYILNIDLENFFHSINFGRIRGFFIKNVHFQLHPTIATCIAHIACYNNYLPQGSPCSPVISNLICSVLDIRLKNLAKKYKCFYTRYADDLTFSTYLKYFPEQIAKSNYYLNVELSALLIKEIQKAGFNINPTKTRLQHTNIRQEVTGLTVNKKLSVHTDYRNLCRAKAHHLFSHGYYFTFDKQTLSQRSGSLKELEGQLAFINSLDKYNREINKAKTEKTNKRENLYGKFIFYKNFLCNEKTILLTEGKTDIQHIKCALIGLKLNTLSNSLQFYKHSPSKTFLMTYICQQKLNFCAGSPGLKAFIKAYNRLYKSILKGKHKPSNPVIIIVDNDHEGEDIKKIIMKEFNIPINTNQPTRIIYNLFIIFLSPPSFMSSHTNTAPHRNIEIEDLYPQYILDTQLNGKKFNRTNHESTDTEYGKDSFVSKVIKSKIDKPI

SEQ ID NO: 1193 - protein, 582 aa, Bacillus sp.
  source 1..582: note = Related to CP024204.1; note = Bacillus altitudinis
MKEFNQIKTRNELADFLNIPRKQLSYVLYVKGINNLYNSFKIRKKNGGFREINAPLEELKGIQRRLQEVLYKKIGNKWINRNISHGFERNRSIITNAIVHRNKRIVLNIDLENFFESIHFGRVRGFFNKNKNFSLPIDVATVIAQIACYEGRLPQGAPSSPIISNLICEILDYRLLKIAKKYKVNYTRYADDLTFSTNDKNFLFLQREFYEEISQELIRTGFKINEKKNRLQLRDSRQVVTGLVVNKKINVNRIYYKETRAMAYQLYKQGSFKINDEPATINQLEGRFAFINQLTWHNNLVDGITANFNNFTSREQQYQRFLFYKYFFANSKPVIVTEGKTDVRYLKSALKSLYKDYPKLIVKHKDGSFEFKIHFLKKTKRLSYFLGIYKDGANALNNIYQFFGSKNSKLNYLNYFKKISGNSPENPVILLFDNEIKSGNKKPIGKFLNYAGLDDEKKTTLKKENMVNIVDSLYLLTVPLINGKLECDIEDLFDNNTLFLKIEGKEFSKKDSYDVSKYYGKEIFSQHISQNYSDINFNQFRPVLDNINKIIDVYTRQNDNMLVNLELKKVDKRNMNKVELFK

SEQ ID NO: 1194 - protein, 582 aa, Bacillus sp.
  source 1..582: note = Related to JH791914.1; note = Bacillus cereus
MREFNEIKTRNELADFLNVPRKQLSYVLYKKGVDNLYTSFEINKKNGSVRKINAPLEELKDVQRKLAEVLYKHMRNKWKKKNISHGFEKNKSIITNAKIHRNKRLVLNIDIENFFESIHFGRVRGYFSKNNNFLLPIEVATVIAQISCYKGKLPQGAPSSPIISNLICEILDHRLLKIAKKYKLDYTRYADDLTFSTNDKKFLGLQKAFYKVISKELIRAGFKINEKKNRLQLRDSRQVVTGLVVNKKINVNRIYYKETRAMAHQLYKEGSFEINGEPATLNQLEGRFAFINQLTWYNNKVDGIKTNFNNFTSRERQYQRFLFYKYFFSNSKPVIVTEGKTDVTYLKSALKSLYKEYPNLITKHSDGTFEFKVSFLKKTKRLGYFLGIYQDGGSALNNIYNFFGSKKSTLNYLNDFKKISGNLPKNPVILMFDNEIKSGKKKPIGQFLSHAGLADKKRLILESEYMVDVIDSLYLLTVPLIDGKSECDIEDLFEKSTLSHKIEGREFSKKDHYDTSKCYGKEIFSQYILKNYSDINFSEFRSVLNNINNIIDIYKKRLADAEHNLEAENIDKSSADKMLLEI

SEQ ID NO: 1195 - protein, 581 aa, unidentified
  source 1..581: note = Related to JACWFJ010000008.1; note = Cytobacillus firmus
MMEFDEIKTRNELADYLNVSRKQLSYVLYVKGINNLYTSFEIHKKNGGVRKINAPLEELKDIQRKLTEALHSHMKKKSKKKNNISHAFEIDKSIITNAEVHRNKRLVLNIDLKDFFGSIHFGRVRGFFNKNNKFLLPIEVATVIAQISCFEGKLPQGAPSSPIISNLICEILDYRLSKISKKYKLDYTRYADDLTFSTNDKNFLGLQDEFYIEISKELIRAGFSINEDKKRLQLKDSRQVVTGIVVNNKLNVNRDYYKETRAMAHQLYKQGKFEINGEVATLNQLEGRFAFINQLTWYNNKKNGIKPKSFRNLLSRELQYQKFLFYKYFFANPKPLIVTEGKTDIVYLKSALKNLHSEYPNLITKNSDGSFEFKVSFLKKTKRLKYFLGIYQDGGSALNNIYDFFTGKKNTPDFLSYFRLISNTLPKNPVILIFDNEGKNKPLGLFLNHAVLDVKKREILDSSYMVDLIDNLYLLTVPLIDGKSECDIEDLFEDITLSYEISGRKFTKEDKYDTSKYYGKDMFSKYILNNYADINFNEFRSILDNINSIIGIYTNGIVGTGQELEAKNIDKSSADKVLLEI

SEQ ID NO: 1196 - protein, 583 aa, unidentified
  source 1..583: note = Related to NZ_ML122604.1; note = Rummeliibacillus sp.
MSEFSEIKTRNDLADFLNIPRKQLTYVLYVKGINNLYTSFEIYKKSGGARRINAPIEELKDIQRKLAEALYKHKKRKWKKKNNISHGFEKDKSIITNAKIHRNKRFVLNIDLENFFESFHFGRVRGFFIKNHNFLLPIEVATVIAQISCYEGKLPQGAPSSPIITNLICEILDYRVSKMAKKYKLNYTRYADDLTFSTNDKNFLRLQTEFLKNISKELIRAGFKINEKKTRLQLRDSRQVVTGLVVNKKINVNRIYYKETRAMAHQLYKQGEFEIKGEPATLNQLEGRFAFINQLTWYNNKIDGVKHHFNNLTSRELQYQKFLFYKFFFANPKPLIVTEGKTDIAYLKSALKNLYKEYPNLISKNSDGTFEFKVSFLKKTKRLKYFLGIYQDGGNALNNIYNFFDSKKPAPNYLSYFKTISNTLPMNPVILMFDNEIKSGNKKPIGKFLNYANLDAAKRETLENNYMVDIIDNLYLLTVPLIGGKSECDIEDLFEEITLLNKIDGKKFIKADKYDVTKYYGKEIFSKYIINNYTDINFTKFRAVLDKISNIIETYTKGLVDTGHNLETKIKDKSSADKVPLEI

SEQ ID NO: 1197 - protein, 585 aa, Bacillus sp.
  source 1..585: note = Related to NFCM01000080.1; note = Bacillus thuringiensis
MMEFQDIKTRNDLADFLGIPRKKLSYLLYKKEINTLYTSFEINKKNGGVRKINAPLAELKDIQRKLSEALYKHKKKKQDIKNNLSHAFEKEKSIITNAKIHRNKRLVLNIDLENFFGSFHFGRVRGFFIKNNNFLLSSEVATVIAQLTCYEGKLPQGAPTSPIITNLICEILDQRLLKISKKYKLDYTRYADDLTFSTNDKNFLERQTEFYELLSSELIRAGFKINEKKKRLQLRDSRQVVTGLVVNKKINVNRIFYKETRAMAHQLYKEGKFEINGKLATLNQLEGRFSFINQLTRYNNKIDGDKHNFNILSSRERQYQKFLFYKYFYANPKPIIVTEGKTDIAYLKAALKNLHNDYPNLITKSSDGSFEFKVSFLNKTKRLAHFLGIFQDGGSALNNIYNFFDDKAKKTTPSYLDYFKEISNTLPTNPVILMFDNEINSKKNKPIGSFINHAKLGDKKKGILLEQNMVNIVDNLYLLTVPLIDGKLECDIEDLFEKSTLSQKINGREFCKKDKYDYSKYYGKEIFSKYILDNYTDINFNEFRSVLNNINNIIDIYTKGLVDTGGNPKAKSLDKSSEDKVPLEV

SEQ ID NO: 1198 - protein, 582 aa, Bacillus sp.
  source 1..582: note = Related to NZ_CP015611.1; note = Bacillus safensis
MEFQDIKTRNDLADFLRIPRKKLSYLLYKKGINTLYTSFEINKKSGGFRKINAPLAELKDIQRKLSEALYKHKKKKRNIKNNLSHAFEKEKSIITNAKIHRNKRLVLNIDLENFFGSFHFGRVRGFFIKNNNFLLPTEVATVIAQLTCYEGKLPQGAPTSPIITNLICEILDQRLLKISKKYKLDYTRYADDLTFSTNDKKFLERQTEFYEILSSELKRAGFKINEKKKRLQFRDSRQVVTGLVVNKKINVNRIYYKETRAMAHQLYKKGSFEINGQPAKLNKLEGRFAFINQLTWYNNKVEGIKTHFSNFTSRELQYQRFLFYKYFFANPKPLIVTEGKTDVIYLKSALKSLYKEYPNLITKHTDGRFEFKVSFLKKTKRLGYFLGIYQDGGSALNNIYNFFGSKKSNLNYLNDFKKISGNLPTNPVILMFDNEIKSGKKKPIGQFFIHAGLADEKRKKLENEYMVNIIDSLYLLTVPLIGGKPECDIEDLFEKSTLSHKIEGKEFSKKDNYDVSKYYGKEIFSQYILKNYSDINFNEFRSVLDNINNIMDIYQKRLADTERNLEAKNIEKSSADKVLLEV

SEQ ID NO: 1199 - protein, 583 aa, Bacillus sp.
  source 1..583: note = Related to CP048002.1; note = Bacillus velezensis
MREFNDIGTRNELADFLKIPRKQLSYVLYVKSINNLYTSFEIHKKNGGVRNIKAPLEELKDIQRKLAEALYKHKKKKQGRKNKLSHAFEKNKSIITNAEIHRNKRLVLNIDLENFFESFHFGRVRGFFTKNKNFLLPIEVATIIAQLSCYEGKLPQGAPTSPIISNLICGILDYRLLKITKKYKLNYTRYADDLTFSTNDKNFLNVQTKFYEEISNELIQAGFKINEKKTRLQYKDSRQTVTGLVVNSKINVNRTFYKETRAMAHQLYKQGNFKINSESADLNQLEGRFAFINQLTRYNNQKDGDKHNFYNLSSRELQYQKFLFYKYFFANPKPLIVTEGKTDIVYLKAALKKLYNEYPDLITKDINGTFEFKVSFLKKTKRLGYFLNIQEGGTGLKNINDFFNSNNAKKSAMNYLNYFKTISNTLPQSPVILMFDNEIKSGKKKPIGDFLHHAKVDNEQVDTLKSEHKINIIDNLYLLTVPLIGKSECDIEDLFDNTTLSHKINGKKFIKKDDYDTSKYYGKDIFSKYILDNYLNIDFNNFRSVLDNINNIINIYMKRVVDTGRNIETTKNIDESEKVPLEI

SEQ ID NO: 1200 - protein, 584 aa, unidentified
  source 1..584: note = Related to nan
MMEFNDIKTRNGLADFLKIPRKQLSYLLYFKDVNNLYTSFEIRKKNGGSRKIKAPIEELKDIQKKLAEALYKHKKEKRGKKNNISHAFEKDKSIITNAKIHRNKRLVLNIDLENYFESFHFGRVRGFFAKNNDFLLPIEVATVIAQISCYEGKLPQGAPSSPIISNLISKILDHKIMKIAKKYKLDYTRYADDLTFSTNDKKFLDLQSEFYEEISKEIKRAGFKINEKKKRLQFRDSRQVVTGLVVNKKINVNRVYYKETRAMAHQLYKYGKFGINGKPATLNQLEGRFTFINQLIWYNNKINGEYSNFNYLHSRELQYQKFLFYKYFFAHPKPLIVTEGKTDIAYLKSALKSLYKEYPNLITKKDDGTFEFKVSFLNKTKRLKYFLGINQDGGSALNNIYNYFDSKKPAPNYLSYFKQISNNSPINPIILMFDNEIESGKNKPIGKFLKHVGLDDGKKVILEDKYMVNLIDNLFLLTVPLIDGKAECDIEDLFKDDALLHKIDGREFIKKDKYDVSKYYGKEIFSRYISDNYSNINFKNFKSVLNNISNIIDIYTHRLVDTEHDTEGKKIDESNANKVPLSII

SEQ ID NO: 1201 - protein, 585 aa, Bacillus sp.
  source 1..585: note = Related to CP048852.1; note = Bacillus tequilensis
MMKFNDIETRNDLADFLKIPKSQLSYLLYFKDVNNSYTSFDISKKNGGIRKIKAPTDELKEIQRKLAEALYKHREKKQNNNNISHAFKKDKSIITNAKIHRNKRFVLNIDLENYFESFHFGRVRGFFANNKNFLLPMKVATVIAQISCYDGKLPQGAPTSPIISNLISEILDRRIMKIAKKYKLYYTRYADDLTFSTNDKNFSNLQTEFYEEISEEITNSGFKINDKKNRLQFRDSRQVVTGLVVNKKINVNRIYYKETRAMAHQLYTHGKFEINGEPATPNQLEGRFSFINQLTWYNNKIDGEKHTFYNLSSRELQYQKFLFYKYFFANSKPLIVTEGKTDIAYLKSALKNLYAEYPNLINRNSDGTFEFKVSFLKKTKRLAYFLKINQDGGSALNNIYDFYNDRKRNKSTPNYLRIFKELSNTSPENPVILMFDNEIKSEGKKPIGSFLNHAKLNFKKKTKLSNDYMVDIVDNLYLLTVPLVKGKSECDIEDLFDDGALSQIIDGKEFTKENDYDHSKYYGKEIFSKYVESDYSNINFDRFKSVLDNMNFIIDTYKKEHLNKEHSLDTINTDNSNKDQVPLEV

SEQ ID NO: 1202 - protein, 562 aa, unidentified
  source 1..562: note = Related to JADPRZ010000022.1; note = Sporosarcina sp.
MRAFYDVKNRNEFADLLKIPRKQLSYVLYIKGINNLYASFEIPKKDGGIRKINAPLEELKVIQRKLAEALYEHKKSKRKNNNISHAFEKDKSIITNAKIHRNKRFVLNIDLEGFFESFHFGRIRGFFLKNKDFLLSEEVATVIAQISCYEGKLPQGAPSSPVITNLICEILDHRISKVAKKYKMNYTRYADDLTFSTNDRKFLDLHVKFYGEISEELIRAGFIINEKKTRLQFRDSRQVVTGLVVNKKINVNRIYYKETRAMAHQLYKHGNFEINGEPATLNQLEGRFSFINQLTWYNNKIDGSKNHFSNLKSRELQYQKFLFYKYFFSNPKPLIVTEGKTDIAYLKSALKNLYNEYPNLITKNSDGTFEFKVSFLKKTKRLRYFLGINLDGGSALNNIYNFFDSKKPAPNYLNYFKSTSNTSPTNPVVLMFDNEIISGREKPIGKFLNHSALDTIKRKTLEKEYMVDVIDNLYLLTVPLIDGKPECDIEDLFEDITISHRIDGKEFTKDNKYDNSKYYGKEMFSKYILNNYSDINFNEFRLVLDNLNNIMNNYKNAFVERV

SEQ ID NO: 1203 - protein, 317 aa, unidentified
  source 1..317: note = Related to NZ_LQYA01000064.1; note = Sporosarcina koreensis
MKEFYNIKTRNEFADFLNIPRKQLSYVLYVKGVKNLYTTFEIPKKNGGIRKINAPLEELKDIQTKLAEALYNHKEKGRKKNNNISHAFEKQKNIITNAKIHRNKRFVLNIDLENFFESFHFGRVRGFFNKNGNFLFPIEVATVIAQISCYEGKLPQGGPSSPIITNLICEILDFRIMKIAKKYKLHYTRYADDLTFSTNDKKFLNLQDEFYNEISKEIVRAGFNVNEKKTRLQFRDSRQVVTGLVVNKKINVNRVYYKETRAMAHQLYKQGSFEINGEPATLNQLEGRLSFINQLTWYNNKIDNIKHHFNNLSTRER

SEQ ID NO: 1204 - protein, 583 aa, unidentified
  source 1..583: note = Related to NZ_QRDZ01000063.1; note = Cohnella phaseoli
MGEFNDIKTRNELADFLKVPRKQLSYILYVKGSNNLYTSFEISKKNGGTRNINAPSKELKDIQKKLAEALYNHKKKRGSADKISHAFEIDKGIITNAENHRNKRFVLNIDLEDFFDSFHFGRVRGFFNINIHFSLPIEVATAIAQISCYEGKLPQGAPSSPIITNLISEILDHRLLKIAKQYKLDYTRYADDLTFSTNDKNFLELQTEFYIKASEVIIRAGFKINEKKTRLQLRDSKQVVTGLVVNKKININSVYYKETRAMAHHLYKYGEFEINDKPATLYQLEGRFAFINQLTWYNNKLDGEKHHFQRLCSRERQYQKFLFYKYFFANPKPLIVTEGKTDVAYLKSALKKLYNEYPNLITKNSNGKFEFKISFLNKTKRLKHFMGIFQDGGTALKNIYDFFDSKKSDTTNYLSFFKKTSNTLPINPVILMFDNEIHSGDKKPIGNFLNHAKLDEKKREDLKHKNFVDIIDNLYLLTTPLIGDKSECDIEDLFEDSVLSHKIDGKEFTKKDKYDVSKYYGKEIFSKYILTNYSSINFTNFRTILDNIDNIINTHRKGGAGAGHDLEEKNIDMISAGKVLLEI

SEQ ID NO: 1205 - protein, 559 aa, unidentified
  source 1..559: note = Related to NZ_CP073365.1; note = Paenibacillus tritici
MGEFNNIKTRNGLADFLKVPRKKLSYILFVKGTNNLYSSFEINKKNGGTRKINAPSEELKDIQKKLAEALYNHKKKKQRGSLEKISHAFEIDKGIITNAENHRNKRFVLNIDLEDFFDSFHFGRVRGYFHKNDHFSLPLEVATAIAQISCYEGSLPQGSPSSPIITNLICEILDHRILKITKQYRLDYTRYADDLTFSTNDKTFLESQTELYKRISEEINRAGFKINDKKTRLQHKDSQQVVTGLVVNKKINVSSVYYKETRAMAHNLYKYGEFNINGNLATLKQLEGRLSFINQLTWYNNKIDGEKHHFQHLCSRERQYQKFLFYKYFFANPKPLIVTEGKTDVVYLKSALKKLHKDYPSLIIKKSNEEFEFKVSFLNKTKRLKHFMGIFQDGGTALKNIYDFFASSKSNINYLSYFKKTSNKSPNNPVILMFDNEIESGNKKPIGNFLNHTKADDRTKMDLKQKYFINIIDNLYLLTIPLIGGKSECDIEDLFEDSVISHKIEGREFTKKDEYDISKYYGKEIFSKYISKNYSSIDFTNFRSILDNIDNIIKCTGCK

SEQ ID NO: 1206 - protein, 492 aa, unidentified
  source 1..492: note = Related to NZ_BMEY01000002.1; note = Ornithinibacillus halotolerans
MITNARRHRNKRIVYNIDLEDFFETIHFGRVRGFFNKNRNFQLPIEVATVLAQISCFKGKLPQGSPSSPIISNLICQILDNRLLKVAKKYKLVYTRYADDLTFSTNDNKFLDNQFNFYKDLSEEINRSGFKINENKNRIQYKESRQVVTGIVVNKKLNVNRDYYKETRAMAHQLYKTGSFEISGESGTINQLEGRFAFINQLTRYNNELDNQKHDFHNLSSREYQYQKFLFYKTFYYNPKPVIVTEGKTDILYLKAALKNLYDEYPKLITKNNDGTFKYNISFLKRTKRLKHFLNINMDGASALTNIYDFFSNRNNKKAPNYLKYFKSLNNSLPKNPVILLFDNELNNNEKPISHFCRKVAKIGDEKIEALKTEFKVNLTENLYLLTVPLIGEKSECEIEDLFDESTLLERIEGKTFTKAAKYDVTKYYGKEIFSKYILKNYADVNFNEFRAVLDNINDIIDQYNVDFVTVGDKAKEVQLKRSDIDKVPVEI

SEQ ID NO: 1207 - protein, 575 aa, unidentified
  source 1..575: note = Related to FNNT01000003.1; note = Paenibacillus sp.
MEQFNNLKSRNEFSDFLNIPRKQLSYLLYIKKINNSYTTFEIQKKSGGVRKISAPSDELKAVQKKLVEALYKHRKSGNGNKFSHAFEKQKSIITNARIHRKKRFVLNIDLENFFESIHFGRVRGFFNKNKNFLLPIEVATIVAQLSCYEGKLPQGAPSSPIISNLICEILDYRLFKIAKKYKLNYTRYADDLTFSTNDNNFVNNQDDFYNILYTELEKSGFKINEKKKRLQLNSSRQEVTGLVVNEKLNVNRVYYKETRAMAHQLYKQGEFTVNGNKATLLQLEGRFSFINQLTWYNNKIDDRKHNFHNLSSRELQYQKFLFYKYFFANPKPLIVTEGKTDVVYLKSALKSLYKEYPNLITKNKDGAFQLKVSFLNKTKRLQYFMGIFRDGGSALNNIYNFYDHKKSLPDYLKYFQNISNTSPSNPVFLLFDNEIKSKSKKPIGQFLNHISLTEKRKSLLEIDYIVKLIGNLYLLTVPLVKGKEECDVEDLFDNTVLSHTISGRIFTKEDNYDVSKYYGKDIFSKYILKNYNNINFNDFKPILDNISQVVDSYSKETVTNGVLEISHKDKVPLEV

SEQ ID NO: 1208 - protein, 565 aa, unidentified
  source 1..565: note = Related to JAIEZV010000001.1; note = Halobacillus sp.
MLKFNEIKTRNELAEYLNIPRRQLSYILYVKGINNLYTSFEIPKKNGGSRKINAPSGDLKDIQLKLAEALYAHVKKKLNKKNNISHAFEKNKSIITNAKIHRNKRWVLNIDLENFFESIHFGRVRGFFNKNNNFLLPIEVATVIAQISCYEGKLPQGGPSSPVISNLICEILDYRLLKIAKKYKLNYTRYADDLTFSTNEKKFPELQMDFYKEISKEIRRAGFIVNEKKKRLQYEDSRQEVTGLVVNKKVNVNRTYYKKTRAMAHQLYKQGSFEIDGEPATINQLEGRFAFINQLTWYNNKIDGVKRNFRNLSSREREYQKFLFYKYFFSNPKPLIVTEGKTDIAYIKSALKNLHDEYPDLISKNSDGTFELKVSFLKKTKRLKYFLGIYQDGGSALNNIYEFFDSRKPIPNYIKYFKKISNSLPQNPVFLMFDNEIRSGKKKPIGKFIDHVKLGDEKKGILEKDYMVNIVDNLNILTVPLIKGKSECDIEDLFDDTVLSHIINGKEFNKKDNYDSSKYYGKEIFSKHILKNYTSVDFSEFRSVLNNINNIVNDQKKALKEKSMV

SEQ ID NO: 1209 - protein, 558 aa, unidentified
  source 1..558: note = Related to NZ_RBVX01000055.1; note = Salibacterium salarium
MKELHNVKTRNEFADFLKIPRKKLSYILYIKKVNNLYHSFEIYKKSGGIRKINAPTVELKDIQQKLAKALYKHQADKWNKKRNNLSHAFEKKKSIITNAKIHRNKRFVLNIDLENFFESFNFGRVRGFFIKNNHLLLPNEVATVIAQLSCYQGKLPQGAPSSPIITNLICEILDLRLLKIARRYKVDYTRYADDLTFSTNKNSFLEQETRFLEEISKELKRSGFEINEKKTRLQFKDSRQVVTGLVVNKKVNVKRDYYKNTRAMAHTLYTQGKFEIDGEEATIDQLEGRFSFINQLDWSNNMKINRNNKDYKNRFASFKSSEREYQKFLFYKYFYANSKPLIITEGKTDIAYLKSALKNLYSEYPDLITKKNDGTFEFKISFLKKSKRLNYFLDINKDGAEGLKKIYNLFCEKGDVRNYSKYFNKISDTFPNNPVILVYDNEPSNGKPLNQIINYAGLERETIRDKLMITIVDNLYLLTVPPVNEPSESDIEDLFDIKTLEHKINGKTFNKNNEMDPTKHYGKERFSQFISENYCDINFDNFKHILNNISDIVKEYKK

SEQ ID NO: 1210 - protein, 550 aa, unidentified
  source 1..550: note = Related to LFJO01000006.1; note = Alkalihalobacillus pseudalcaliphilus
MMEFYDIRTRRDLVDFLHISQKRFTYLLYRKGIDNLYTSFDLHKKSGGIRKIHVPNDELKSIQKALETILYTHKSGLLGGENNISHGFERKKSIITNAKIHRNKRLVLNIDLEDFFESFHFGRVRGYFKNNKNFLFSMEVATIIAQLTCYKGTLPQGAPSSPIITNLICKILDHRLLKISKKYKLDYTRYADDLTFSTNNKKFLEQQTEFYERIKGEIIRAGFKINDNKTRLQIKDTRQMVTGLVVNKKINVNRIFYKKTRAMAFQLYKEGNFQIEGKPGSLNQLEGRFAFINQLCRYNNKIDGEKHSFHNLNSRETQYQKFLFYKYFYANPKPLIVTEGKTDIAYLKSALKNLHLDYPNLITKKGGNFEFKVSFLKRTKRLRYFLNIDKDGADSLKNIYNYYDDKKQGPNYFSYFREISKDVPKNPVIFMFDNEIESGAKKPIGNFLKHSSIKAEKIEFLKTEYKIGLTSNLYLLTVPSIPGLPESDIEDLFNETTLSTLIGGKSXIDFNKFRPLLDKLNDTLEEYTKKRSKTLGVIKVSEKVKEPLNV

SEQ ID NO: 1211 - protein, 569 aa, Bacillus sp.
  source 1..569: note = Related to NVIC01000027.1; note = Bacillus toyonensis
MKKFNDIKTRDDLSDFLKIPTSKLTYVLYKKKTSNLYTSFEIPKKNGGIRHIKAPLKDLKEIQKRLALSLWTHQKYIWKENGINPNISHAFQKEKSIITNAQIHRNKRFVLNIDLENFFDSFHFGRVKGFFEKNKHFLLPQGVATIIAQLTCYEGNLPQGAPSSPIITNLICNILDMKLLKISKKYKLNYTRYADDLTFSTNSKQFLVQQSDFHEEISKIIEKAGFKINEKKTRLQFRDSKQEVTGLIVNKKINVDRNYYKATRSMAHSLYTTGTFQIDGETGTINQLEGRFTFINQLDQYNNKINKSIDKTTKLGFHHLNSREKQYQKFLLYKYFFVNNKPLIVTEGKTDIDYIKSALKNLYIHYPNLVTKNSDGTFEFKVSFLNRTKRLRYFLDIQQDGADTMKNIYNYFNNNGKDSYPNHFKKFQESGFTPANPIIFILDNELSNKEKPLKNLTNHIKLDKDTAKKDFFKTNFYINITSNLYLLTHQLVKELPECEIEDLFDDLTLNQTINGKRFERDTKIFNSALHCSKAKFADHISQNYEKIDFNNFKCMLDNLNTIVSSYGNN

SEQ ID NO: 1212 - protein, 568 aa, Bacillus sp.
  source 1..568: note = Related to NVFR01000056.1; note = Bacillus toyonensis
MDKFNNIKTLYDLSYFLKIPTRKITYILYKKGIDNLYTSFEIPKKNGGVRHINAPSKDLKDIQRKLVLSLWAHQKHIWEESGKNLNVSHAFQKEKSIITNAQIHRNKRFVLNIDLENFFESFHFGRVRGFFEKDKNFLLPKKVATIIAQLTCYEGHLPQGAPSSPIITNLICNILDMKLLKLSKKYKLNYTRYADDLTFSTNNKHFLDQQSDFYEEISKIIERAGFKINEKKTRLQFRDSKQEVTGLVVNKKVNVDRNYHKITRSMAHSLYTKDNFQIDGEFGEITQLEGRFSFINQLDRYNNLVKKDRDKNVKLNFRNLNSREKQYQMFLFYKYFYKNKRPLIVTEGKTDIEYLKSALKNLYKDYPNLITKKSDETFEFKVSFLRRTKRLSYFLDIKLDGADTMKNIYNYYIGKENNGYPNFVKKFKDLGSIPNNPVIFILDNELNNSNKPLKKIMNHMGLNKGVSKSSFFSEDYYIHITENLYLLTHQLVKDLHECEIEDLFDDSILNQKIHGKNFERDDKKFNINNHYGKANFADYISKNYRSINFSKFKCMLDHLNSIVTFKSN

SEQ ID NO: 1213 - protein, 571 aa, unidentified
  source 1..571: note = Related to NC_016894.1; note = Acetobacterium woodii
MNKFNEIKTRNDLADFLDIPRSRLTYILYGKKIENFYTSFEILKKNGGTRQIDAPNKELKIVQKKIANALWNHYKGLAKKTSSKTNFSHAFEKEKSIITNAKIHRNKRFVLNIDLEDFFHSFHFGRVRGFFEKNNNFTLPKEVATVMAQLVCYEKHLPQGAPSSPIITNLICNILDFRMLKLSRKYKFDYTRYADDLTFSSNNKYFLEKHQEIYDEISNEIERAGFRINERKTRLQYRDSKQQVTGLVVNKKINVDRVYYKKTRAMAFSLYSCGSFEIEGDQGSINQLEGRFAFINQLDRYNNKLSSEKNDFRTLNSREKQYQQFLYYKYFFANKKPLIVTEGKTDVRYLKAAMKSLCDEYPNLITKSSDTEFEFKVSFLRRTKRLNYFLNITQDGADTISSIYKFSQANNEKGYINYLEYFKKISNTNPKNPVILIFDNELNGDQSKGKNNKNKPLQKFINLINLDNESHEKFKNSLSYNILGNFHLLTNQLVNNKDQCEIEDLIESKVWNNRIGGKTFSIDKEFDLDKHFGKEIFSQYIEQNYETIDFENFKPILDNISQIIDEYNVKS

SEQ ID NO: 1214 - protein, 566 aa, unidentified
  source 1..566: note = Related to NZ_AP024845.1; note = Eubacterium sp.
MDTIDKVKSRNELADFLDIPRKKLSYILYIKGVDDLYTSFEIPKKSGGFRHIYAPQKDLKVIQRKLAEALYNCQKEIWNKCNVNPNISHAFQKEKSFITNAKIHRNKRFVINIDLENFFDSFHFGRVQGYFLKNRSFQLPSEVATVIAQLTCYQGKLPQGAPTSPIITNLICNIFDVRISKLAKKYRLDYTRYVDDLTFSTNNKEFLNIKNIFFEELEKEIINAGFSINKKKTRIQYRDSRQEVTGVVVNKKLHVSRDYYKRTRAMAYQLYKSGEYFIENEIKGTINQLEGRFSFINQLEWYNNKLNLEGKKLTYEYLNGRERAYSQFIFYKYFFANPKPLIVTEGKTDVTYLKAALKNLWKEYPNLVSRNSKGQFEYKVSFLQRSKRFAYFLNFKKDGADTMNNIYKFFSEEGGEKYPNYIEMFKNLGSTVPLNSVILLFDNELNNKNKPIYKFVSNKISDDRKKQLCTRTWINLLENLYLMITPLVGESEECDIEMLFDEATLSHEIGGKKFCKKDTYDTSKFYGKEIFSQYIMKNYSSIDFGGFKPLLNNIDVVIKDYKERIQ

SEQ ID NO: 1215 - protein, 565 aa, unidentified
  source 1..565: note = Clostridiales bacterium; note = Related to JAAYPT010000052.1
MNTIDKIKTRNELADFLEVPRKKLSYILYVKGVDNLYTSFDIPKKNGESRHIHAPQKDLKVVQKKLADALCTYQKEIWKRRNINPNISHAFQKGKSFITNAKIHRNKRFVVNIDLENFFDSFHFGRVRGFFLKNDDFQFSVEVATVIAQLSCYQGKLPQGAPCSPIITNLICNIFDIRLLKLAKKYCLDYTRYADDLTFSTNDVKFLEIEELFFEKLEKEINSAGFRINEKKTRIQFRDSRQEVTGVVVNRKLHVSRVYYKKTRAMAYNLYKTGEYFIEKDTQGTINQLEGRFSFINQLEWYNNKLYPGNKKLIFNNLNGREREYSQFVFYKYFFANPKPLIVTEGKTDVIYLKAALKSLWKEYPELVSRDKNGHFEYKIAFLRRSKRLAYFLNLKEDGADTMNNIYNFFSKNGGEKYPNYIEVFRKLGNRFPLNPTILLFDNELSNKEKPVCKFTKGKISEEQREELNSKTWIHMTENLYLLMTPLINERNESDIEMLFDNFTLSKEIDGKKFCKKDRYDTDKFYGKEIFSKYIMKNYSNIDFSGFKPLLSDIKIICENYKKKM

SEQ ID NO: 1216 - protein, 587 aa, unidentified
  source 1..587: note = Related to NZ_LT727777.1; note = Oceanobacillus iheyensis
MSSILVGYLSASHNELPHVLFYVLGDSMNNFKDVRTRIALANLLGVPENKLTYVLYIKKIENLYTSFSIPKKNGESRHINAPQKDLKDIQKKLADCLYEYQKENRINNNIKTNISHAFERDKSFITNAKVHRNKRFVYNVDLENFFGSFHFGRVKGFFEKNKDFQLPSNIATVISQIACYQGELPQGAPSSPIITNLICNIFDIRLIKLAKKYKLDYTRYADDLTFSTNNKKFLDTISDFHSELSKEIKQAGFEINNNKTRLQFQDSKQEVTGLTVNKKLNVDKSYFKTTRAMAHHLYTQGSFKINDKDGTINQLEGRFAFINQLDRYNNKLDNGSHNIRELNSRERQYQKFLFYKYFYANNKPIIVTEGKTDILYLKAAIKKFHSEYPALINKRSDGKFEFKISFLRRTKRLNYFLDLQKDGANTMKKLYNFFSNKESRHFPNYSAYFKKNSVVPPKNPVIFVYDNELKNKKKPIIDFLNYANIKPEKRLELAEILSIKIINNLFLLTNPLIVEPESEIEDLFDEKTLSIVLNGKTFSRNDDSNDKEHYGKEIFSKHISSNYSKINFDNFRPMLDRITAIMETYEK

SEQ ID NO: 1217 - protein, 554 aa, unidentified
  source 1..554: note = Related to JAJCRR010000003.1; note = Lachnospira pectinoschiza
MKKLKELQTREDLALYLAIPLQKLTYILYKSKPDSYYDTFEIPKKNGESRQIHAPSGDLKQLQRKLAQRLWDVYREFIEENEIQDNISHAFQKGKSIITNANIHRNKRYVLNLDLKDFFDHFHFGRVRGFFMKNKNFELPVEIATMIAQLTCYEGKLPQGAPTSPIITNLVCNILDMRLLKIAKKYRVVYTRYADDMTFSTNDKKFLENQENFMKSIKKEIESFGFEINDKKTRLLFCDSRQEVTGLVVNKKISVNREYCKRTRAMADAFYRRGIFEICGEEGSVNQLEGRISFINQIDCYNNKNDREQKHTFWTLNARERQYQKFLFFKYFYANTKPLIVTEGKTDIVYLRAALKKYYKEYPELIKKQDDNFEFQVTFLRRSSRLKYFLGIQKDGADTMKNIYNFYSGKNNAPKLYSWFAQNSCKKSQNPVIFIFDNEQVSDRPLKKFLNHLNNKGLLESSNYNHIQDNLYILTNPLVNGKKECEIEDLFDDVVLSHTIDGKIFSRKETDNEKYYGKAIFSQYVERQYDSIDFSNFKPMLEDIKSIVGSKKQG

SEQ ID NO: 1218 - protein, 552 aa, unidentified
  source 1..552: note = Lachnospiraceae bacterium; note = Related to JAFTZX010000234.1
MLKFNEISYRDELAEFLNIPLKKLTYILYVKKVDSYYTSFQIPKKNGDYRSIDAPYGDLKYIQKILAIKLWEYHNKYTSDNNINMKVSHAFEKKKSIITNAIIHKNKRFILNIDLSDFFASFHFGRVRGFFEKNKEFNLPIEVATIIAQLTCYKGHLPQGAPSSPIISNLICNILDMRLLGISQKYKLDYTRYAEDMTVSTNDFKFIYLVDDFMKEITKEIEKSGFSINNKKTRFVFNDSRQEVTGLVVNKKISVNRDYCKKTRAMADSLYRKGEYVINGSKGTIQQLEGRFAFINQIDRFNNNFNYVKHKIWDFNSREKQYQKFLFYKYFYANTKPLIVTEGKTDILYIKAALKKYYYKYPELIFKKDEDYIFNISFLKRSSFLEYFLNIYQDGADDIKNIYNFYVGNNHYPNLYEFFLEKSSLKPKNPVILIFDNEQNSDRPLKKFLNHIKIDSKNFKSGQCIYANIYLITNPLVKGKAECEIEDLFEETILENVIEDKKFSREKKYDINKFYGKDIFSKYINDNYKTINFDGFIPILDDINKVVTNMDF

SEQ ID NO: 1219 - protein, 561 aa, unidentified
  source 1..561: note = Related to NZ_FNYT01000006.1; note = Trichococcus ilyis
MKKLMEIKTRNEFADVLEIPRQKLSYILYVKHVDEMYTSFQIPKKNGDFRNINAPIEDLKNLQKKLSELLWECQKEIRMNNGIDSNMSHAFEKEKSIITNAIIHRNRRIVLNIDLEDFFGSIHFGRVKGFFEKNRDFKLSSEVATIIAQLACYRGVLPQGAPSSPIITNLICNMIDIRLLKIATKYKVNYTRYADDLTFSTNNKPFLDKQSEFLSEVTKEIERSGFKVNNKKTRILFRDSRQEVTGLIVNEKISVNRKYYKKSRAMSYQLYKSGSFEIDNEEGSVNQLEGRFAFINQLDWYNNKRDGLEHNFWSLNSREKQYQKFLFYKYFFNNNKPLVITEGKTDIDYIKAALKNLYIEYPDLVTKNSDGTFNFKVSFLRKSKRLRYFLNIHLDGADTMKNIYKFYSDKENNKFPNFCKYFKELSGNIPTKPVILIFDNELTNKEKPLYKFVNYAGLNGLSQCIKEKLNTKLTDNLYLMTNPLVSNKTECEIEDLFDRETLSHEINGKFFSRNKTSDNNKFYGKEVFAKYISSNYREIDFDNFKPILNMLNDIVSLRKQA

SEQ ID NO: 1220 - protein, 570 aa, unidentified
  source 1..570: note = Related to NZ_WIQQ01000012.1; note = Pectinatus frisingensis
MKFNEIKSRNELANFLGISIRKLTYILYSKKTESCYTSFDIPKKNGGVRNINAPTEDLKHIQVKLANALWEYKKSIIKEKNINVKISHAFEKRKSIITNAQIHRKKRFIFNIDLENFFNSIHFGRIRGYFEKNENFKFPIEIATIIAQLTCYNHCLPQGAPSSPIITNFICNILDMKLLKIARKYKMDYTRYADDMTFSTNDNNFLNEISTFYAEIEEKINQNGFTINGNKTRLAFQNSRQTVTGLVVNNKISIPREYYKLTRAMIYSLYKNGEFTANGVNSTIRQLEGRLAFINQIDLYNNRITDGPHSMRTLNSREKQYQKFLFYKYFFIPQKPLIVTEGKTDIVYLKAALKKYYYKYPDLITKIGDKFIFHISFLKRTKRLAYFLNINLDGADTIKNIYNFYTGIDSVPNICKWFDEKTNVRRINPVILIFDNEQENNKPLKKFINHMQKSRQNKEIKLENPRYKNIIDNLYLLTNPLMKGKNECEIEDLFNNQTLSHKINGKSFCRNGKFDSEQYYGKEKFSQYIASDYESIDFKNFQEMLNDINITINEYKSANENEEPIKKVCK

SEQ ID NO: 1221 - protein, 560 aa, unidentified
  source 1..560: note = Clostridia bacterium; note = Related to SAAV01000006.1
MDGFTNIASRNELADFLRIPRKKLTHILYIEEVNNLYTSFDIPKKSGEKRHINAPTDDLKSVQKRLAYALWEHQKNVWEEKDVNPNISHGFEKNKSIITNSRIHRNKRLVLNIDLENFFDSFHFGRIRGFFDKNIDFKVPIEVATVIAQLSCYKGCLPQGAPSSPILTNLIGNILDIRLLKLAKQYKLDYTRYADDLTFSTNNRDFLANYPTFIKELSIEIESSGFRINHQKTRLQYRDSKQVVTGLIVNQKINVDKCYYKVTRAMAHSLYSKGGLTINGKEGTINQLEGRFSFIDQIERYNNTIDEDSHDFRNLNGREEQYRKFLFFKYFFSNSKPLIATEGKTDVAYLKAALKNLFALYPDLISKTESDDFEFKVSFLRRTKRLRYFFGLSLDGADTLKNVYNFYTGKEGLPNYLKYFNVMSSDKPKNPVILLFDNELANKNKPLYKLVNNNGLNETQKKDLSDKLNVKISENLFLLTHPLAEGKDECEIENLFDIETLSHVIEGKTLSLDSKFDNNLYYGKEIFSKYISSNYKDIDFSGFRQLLDKLNEIITTFNST

SEQ ID NO: 1222 - protein, 594 aa, unidentified
  source 1..594: note = Related to KE136354.1; note = Enterococcus dispar
MASFTDIKTQDDLFKLLNIPKKNMTYLLYNKEEKGPENAYHTFSILKKNGDKREIDAPNDELKFVQKRLAILLWANQKKSWRLNNTKPNISHGFEESKSIITNAKIHRNKKIVLNLDLEDFFPSIHFGRVKGFFEKNKNFKVPKEVALVIARLVCYKGRLPQGAPTSPIISNLICRILDFRLLKLAKKYRLDYTRYADDLTFSTNSSSFVDEEQFFLDKLEKEIIRAGFKINAKKTRLQFSNSRQEVTGLTVNKKLNVSKEFYKNTRAMAHKLYTTGEFLIDGESGTINQLEGRFAFINQLDKYNNGLEYEISLNKNNIEYQKFLLSTIKVENNHQIMLLNLNSREKEYQKFLYYKYFYGNEIPTIVTEGKTDIRYLKAALKKMYKDYPILIEKNGNDYKFKVHFLKRVNKKGNKDISRLKYFFNLPIDGADAMKNLYNFFSDKNNKLYPNYLEYFNFLSTSKPSNPTFFIFDNELNNDKKPLRGFINYINEKKNMQSLKDNGSLRVTENLYVLTNQLIGEAEENEIEDLFDKKTLEHKIGGKSFSKKSISEKNNFYGKEIFSKYVLDNFENIDFENFRPMLNNLSRIISDYGK

SEQ ID NO: 1223 - protein, 582 aa, unidentified
  source 1..582: note = Related to NZ_MPSN01000002.1; note = Ligilactobacillus murinus
MNVFKDVENRDDLFERLGISKQLATYLLYGKGIDNCYSTFVIEKRNGDPRVINAPNKELKSVQKRLVNAILLQRSCNNQNGKSLKIAHAFEKNKSIITNAKVHRNKRFVLNVDLEDFFTSFHFGRVRGFFENDNTFKVPRKVATVIAQLTCYKGVLPQGAPSSPIITNLICRIMDLRILKLSKKFNLNYTRYADDLCFSTNDQKFLLDEQVFLSKLTREICKAGFKINSKKTRLQFRDSRQKVTGLVVNRKLNVPREFYKNTRAMANKLYANSEFTIDGKKGSIDQLEGRFAFINQIDRWNNSLELEQSITSNMLNYQKLLLRSKYQNKEIFGRLNAREREYQKFLYYKYFYGNDKPIVVTEGKTDILYIKAALKNLYQSYPDLVERIGNDYKFKVSFFKKSKNNKEIPRIKYFLNIPQDGADSMKNLYSFFSDKNSCYPNYLDYFQKKYSSKPLNPVIFIFDNEIENNKKPARNFVNHIKIRGALSELRDKQRLRIIGNLYMIVTPLVNSLKETDIESLFSSQTLGHKIDGKSFNRNGGKEYYGKGIFAQYVSKNYENIDFTNFKPLLDNLNKVIIDYKDG

SEQ ID NO: 1224 - protein, 594 aa, unidentified
  source 1..594: note = Related to NZ_NGLI01000001.1; note = Enterococcus sp.
MSNLSEIKSREDLFRLLNIPKKNMTYLLYNKDKKGTENSYTTFTIKKRNGEDRIICAPNNELKFVQRRLANLLWVTQKKIWRENNIKSTISHGFEKNKSIITNARIHRNKKFVLNIDLEDFFSSFHFGRVKGFFEKDRNFKVPQEVALVIAQLTCYKGVLPQGAPSSPIITNLICNIMDLRILKLARKYKLDYTRYADDLTFSTNDIVFLHFEKEFLIKLEKEIVRAGFKVNPKKTRIQFSNSRQEVTGLVVNKKISVPKEYYKKTRAMAYNLYKNKEYFIDNVPGTINQLEGRFAFINQIDKWNNVLEYETSLDNNNLEYQKHLLTIKRKEKNHYNMLKLLNRREREYQKFLYYKYFYSNEKSTIVTEGKTDIRYLMAALKSLYKDYPNLVEKVGENFNFKVYFLKRSKKKDKREVSRFKYFFNLPIDGADAMKNLYNFFSDKNTLCPNYLKYFSSFESSKPASPNFFIFDNEISNKDKPLKTFINYVYAKSQSAKAEEMKEKLYLKIEENLYIVTHQVLDGCKENEIEDLFDEKTRGHIIGGKTFSPKGDSNNHYGKEIFSKYILKNYKYINFENFRPMLDNINKIITEYKN

SEQ ID NO: 1225 - protein, 572 aa, unidentified
  source 1..572: note = Related to JAARYB010000009.1; note = Listeria booriae
MDYFSDIKTREDFFNILNIPLKNMTYLLYNKEKKGTENSYHSFEIKKRNGGVRVIHAPNKELKFVQQRLLKALWRNQTKVWHDKKINPSISHGFQKGRSIMTNAEIHRNKKFVLNVDLEDFFNSFHFGRVKGFFEKDRDFKVPQAVALIIAQLVCYKGALPQGAPTSPLITNLICRIMDLRLLKLAKRYKLDYTRYADDLTFSTNDSSFSRLSQEFLLKLESEIKRAGFNLNPEKTRLQYKNSRQSVTGLVVNKKLNVPNEYYKKTRAMAHTLYTNGSFLIDGVEGTLAQLEGRLSFINQLEKRNNLSINSGSKDYKNLGRREKEYQKFIYFKYFYANTRPTILTEGKTDSRYLKAALKKLYKNYPNLIEYKNGEFVFKILFLHRADKEKPNKTTRLKFFFNIGPHGADSLAELYYFSSNKKSKVPGYINYLEYFKKLNQNMLTKPTIIVFDNELSSNGKPLRTFINSLKDEQEMHISNIRRDLSTQVTDNLYILTNKLVGTRTEAEIEDLFDDKTRNKEIDGRTFSATDIGEQYYGKNIFSLYILKNYKEVDFSNFKPMLDKLNEIIINFK

SEQ ID NO: 1226 - protein, 598 aa, unidentified
  source 1..598: note = Related to CP022488.1; note = Enterococcus faecalis
MVSYSDIQSRDDFFKLLNISKQHMTYLLYNKDKKGTENSYYTFEIEKKNGGVRVIHSPNDELKFVQKRLASVLWNKQKEIWNKKGIHPNISHAYEKNKSIITNAKIHRNKKFILNVDLEDFFSSFHFGRVKGFFEKDNNFKVPSEVALIIAQLTCYKGVLPQGAPSSPIITNLICKIMDFRILKIARKYRLDYSRYADDLTFSTNRTSFLDDKEAFMKILEKEINRAGFKLNENKTRLQYNSSRQEVTGLIVNKKLSVPREYYKQTRAMAHTLYKTGEFFINNEKGTVNQLEGRFTFINQLDKWNNKLEYDTTLNNNNFEHQKFLLSLNRKGDGGVQEKLKLLNTREREYQKFLYYKYFYGNTKPTIVTEGKTDIRYLKAALKKMYQDYPNLIEKKNNKFIFKVYFLKRIGNKETSRFKYFFGLEKDGADTMKNLYNFFSDLGNEKLYPNYLKYFNTFDKHPLNPTIFIFDNEISNSKKPLGSFMNYAFNKKKKVKQSKIDCLKENLFLKIEENLYVVTNQLLPEKDETEIEDLFDEKTLHHSINDKTFSKKGDPNLNYGKEIFSKFILSNYEEINFENFRPILNNINQIVRNFSKNL

SEQ ID NO: 1227 - protein, 591 aa, unidentified
  source 1..591: note = Related to NZ_CP011102.1; note = Listeria weihenstephanensis
MPSFSDIKTRDDFFKLLNIPKQHMTYLLYNKEKKGTENSYYTFELEKKSGGVRIINTPNDELKFVQKQLTSLLWKAQKNIWNNSSLHPNISHAFQKEKSIITNAQIHRNKRFVLNIDLENFFNSFHFGRVKGFFEKDKNFKVPPDVALIIAQLTCYQGVLPQGAPSSPIITNLICRILDLRILKLAKKYKLDYSRYADDLTFSTNIRSFDAQEKEFLSVLETEIKRAGFKINTKKTRLQFNNSRQEVTGLIVNKKINVPKEYYRNTRAMANSLYKNEKFFINNEWGTINQLEGRFAFINQLDKFNNSLEYNSSLRKNSIEYQKSLLSTQLKENSNHNMLLLLNAREKEYQKFLFYKYFYANQKPTIVTEGKTDIRYLKAALKSLYKDYPEMIEKKGTKYIFKVSFFKRSKRFRYFFNFSLDGADSMKNLHNFFSDNNNKLYPNYWQYFDALNSSSSVNPIFFIFDNELSNKNKPLRNFVNHVCSVEKENADAQLKLLKEKLNLQLKDNLYLLTNQLLDGFTENEMEDLFDAKTLKHIIKGKTFSKNGDNKDHYGKEIFSKYILDNYTKINFENFRLILDNMNEIIHDYSPN

SEQ ID NO: 1228 - protein, 349 aa, unidentified
  source 1..349: note = Related to NZ_MAEJ01000004.1; note = Enterococcus sp.
MRLTEIEDKNIFFEEFDISKRSMTHLLYVKGTDSFYESFEIPKKNGGFRNIDAPKGKLKYVQKRLAEILWETQIDVWKKYANTYEYNLYQKNLKDGIRYRVPMISHAFEVNKSIMTNAKIHRNKKFIINVDLKDFFKSFHFGRVKGFFEKNKDFKVPTEVAVIIAQLSCYKGVLPQGAPSSPIITNLICQIMDYRIMQLAKRFKLNYTRYADDLTFSTNNVQIVNEYQTFLKKLEKKIVKAGFEINEDKTRLQFNNSRQTVTGLIVNKKLNVPREYYKDTRAMANTLYKTGSFDVNERTGSINQLNGRFAFINQLDKYNNKLENNASIMKNNIEYQKYLLSVEKKEKNI

SEQ ID NO: 1229 - protein, 573 aa, unidentified
  source 1..573: note = Related to NRQF01000015.1; note = Carnobacterium divergens
MIFINKFNAINSRNELFEFLKVKKEIMNYILYVKKTECSYNSFKIEKKSGGFREINAPDDELKVIQKKLALSLWLYQKEIWDEKGINPNISHAFEKDKSIISNARIHRNKKFVLNLDLENFFKSFHFGRVKGFFEKDRDFKVPPEVAVVIAQLTCYDGYLPQGAPSSPIITNLICRILDFRILKLAKKFKLDYTRYADDLTFSTNRKGFLADYIDFLEELSKEILRAGFKINDSKTRMQYSNSKQIVTGLIVNKKINIDSTYYRKTRAIAHTLYKGKEIEINGKKATIDNLEGRFAFINQLDRYNNAINAEITVGKKKKFAFNGREMQYRKFLFYKYFFANTKPLIVTEGKTDIKYIKSALKKLYKDYPNLVSKTSDGIFEYKISFLKKTNRLRYFLGIQKDGATALTEIYKYYAPSNGLNDPYINYMDEFKRISDSQAEKPVFLLFDNEMGKKSDKPLKKFVGCAKINEDKISELKDTLKLKLIDNLYVLTNPLVSNKEECEIEDLFDKKVLETVIKGKTFQRNEKKFNKEKHYGKEIFSTYIAENYESIDFSNFKKILDNIESISQKFKLG

SEQ ID NO: 1230 - protein, 576 aa, unidentified
  source 1..576: note = Related to NZ_NFIW01000013.1; note = Megamonas hypermegale
MCEINNIKTKKDLVKILDISIKKLTYILYVKKVDNMYFSFDIPKKNGGVRKINAPEKTLRFIQRNLAKALSNYKKNICENEKISNRVSHGFEKNKSFITNARIHRNKLYVINFDLKDFFDCFHFGRVKGYFEKNIYFKLPKEIAIIIAQLTCYHGYLPQGAPTSPVITNLICNIFDMRILKLAKKYKLDYTRYADDLTFSTNEKEFIKVYSNFYKDLVKEIDKSGFKINEKKSRIQYSNSRQEVTGVVVNKKLNINREYYKKTRAMADSLYKTGRFFIDGKEGTINQLEGRFSLINQVVWYNNKILKEKEKHNKYIKKNVEIYKKSCTRERDYERFLIYKYFVINKEPLLITEGKTDKLYIQAALKSLYKEYPKLIIKNKNGNFEYKIDFFNRTKRINYFLDVNKTGADTLKNICNYYFDKVKNGYENYIEDFFKIINIKPKNPVILLYDNEFDTSGKKNNKPVAKLFNNDRLSNKKDYIIKNRFLKIKENLYVMVIPLVNDKKNCEIEDLFKDELLKQKIDDRIFDRKSNDNETKIGKDTFSKYVKANYKDIDFSNFRLLLDTIKNILNDYKNNE

SEQ ID NO: 1231 - protein, 582 aa, unidentified
  source 1..582: note = Related to nan
MCVIDHIKTRKELANILNISEKKLTYILYVKKIDNMYRTFSIPKKNGETREINAPEKMLNFVQKNLAKFLLNYRNGIYKTENINNKVSHGFEKEKSFITNAELHKNKRYVLNFDLKDFFDCFHFGRVKGYFEKNRYFKLSKDIATILAQLTCYKKCLPQGAPTSPIIVNLIFNMVDIQIIKLAKTYKLNYTRYADDITFSTNDKFFLEKYSEFENKFLYIIEKYGFVVNKNKTRLQYKDYRQKVTGLVVNKKINVTREYYKETRAMAHQLYKTGSFFIEENKSGTINQLEGRFSFINQIEKYNNIIDIKKGGKKHRIVTLSNKEKEYSKFLFYKNFFNMGKPIIFTEGKTDVMYIKAALKNLYKKYPNLIEETKTGFDYKIIFFRKSKKIRYLLNIEANGADTMKNIANLYSGSESFPNYIEYLKSISKQKPNNPIILLFDNEIESKNKPIKNFLSCKAVKSFYKDDILEKQLKEKNYACLKDNLYVQVTPLIGNIKEGDIETLFKKETLAHKINGKSFIKKDKYNNEYYYGKEIFSKYVYDNYRNIDFSNFVYLLDNINDIIKDYQIRKAGNDMHPKYWTY

SEQ ID NO: 1232 - protein, 555 aa, unidentified
  source 1..555: note = Related to CP024698.1; note = Fusobacterium sp.
MSNYNNARESLSNFLNISLKYLTYILYVKKIENLYTTFKIPKKNGGCREINAPQNELKMIQKKLVFFLEEKMKDKFKTINISHGFVKERNIITNAKIHKNKKIVLNLDLKDFFDSFHFGRIKGFFEKNKDFKFSPELATLIAQLACYNGKLPQGAPSSPLITNLICNIFDIRVLNLARKYKLNYSRYADDLTFSTNYKGFIKNLEEFKEDILLEIKKNGFEANMKKYRLTFQNSRQEVTGLTVNKKINVSKIYYKNTRAMAYSLYKNGEFKIDGIKDGTINQLEGRFSFINQLDIYNNFEKNRTKKEKGKKDGIKSWNIYNSREKEYQKFLFYKYFFMNQKPLIVTEGKTDILYIKAALKNLYNDYPSLIIKEENKFIFKVSFLKRTKLLKYYLNLALDGADTIMNIYNHFVDAYSSFYNYNDYFKKLTKKQAFNPVVLIFDNEIETEKPLKKFLAHAFPKSREINEKKDIIKKNCKLNIIDNLYLLTINLVDDMKECEIEDLFIKDIHERFSFNKDNPDKNKFSKNILKNYKNIDFSNFKPFLNNLASILKEYN

SEQ ID NO: 1233 - protein, 559 aa, unidentified
  source 1..559: note = Related to NZ_CP068114.1; note = Fusobacterium canifelinum
MFNFKNAREILSKILNIHLNYLSYILYVKKIENLYTTFKIPKKNGGYREINAPQNELKMIQKKFVSFLEEKMKEKFKTINTSHGFVKERSIITNAKIHKNKKIVLNLDLKDFFDSFHFGRVKGFFEKNKDFKSFFPELTSELSTLIAQLVCFNGKLPQGAPSSPLLTNLICNIFDVRVLKLAKKYKLTYSRYADDLTFSTNYKGFIRNLEKFEEDILLEIKKNGFEANMEKYRLTFQSSRQEVTGLTVNKKINVSRKYYKYTRAMAYSLYKNGEFNIDGIDGTINQLEGRFSFINQLDKYNNSESEKRKKFIARNVLNSREKQYQNFLFYKYFFMNEKPLIVTEGKTDILYIKAALKNLYNEYPNLITKEENEFIFKISFLKRTKLLKYFFNLSPDGADSMKNIYNYFGDKNSKFYDFYNYFKKLTNLEALNPVILVFDNEATENSKKPLKKFLNHIFSDKNDNDKKNLISYVRTKFKLKIINNLYLLTINLVDGLEECEIEDLFFEDTYKKFSFDKINPNKDKFSKNILKNYKNIDFSKFKPFLNNLESILKEYNKKD

SEQ ID NO: 1234 - protein, 566 aa, unidentified
  source 1..566: note = Clostridia bacterium; note = Related to JAGAAC010000102.1
MKLSEIRCREDLACLLKIKTSSLTYVLYRAKVNSFYKTFDIPKKNGGVRQINAPTDILKIIQERLASAIYSYMKNLRTEKNINVNIAHAFEKKKSIITNAQIHKNKYIVLTFDLEHFFDSFHFGRVAGFFEKNRDFHLPHNMAIILAQLTCYNGHLPQGAPTSPIITNLIFQICDMRILKLAKKYKLDYTRYADDLTFSTNNHSFIDEKESFQRELEREIGKAGFSINQTKTRMSLRNSRQEVTGLVVNKKINVNAGFYRKTRAMAHQLYQNGSFTIDGKEGSIQQLEGRFAFIDQLDHYNNKIDGKIHSFRDRNGREKQYSKFLFYKFFYANEKPLIVTEGKTDIRYLKAALKSLYLDYPELISRNKNGSYTFKVQFLHRTKRLSYFLDIAVDGAKPLYNIYKYFIKGRDSAYPNYYKFFSKDGEKKPRNPVVILLDNEMKPNKPLKGFLDQIKSTESEKNDLQQKLSLRLLASGNLYLLTNPLVDNKDECEIELLFTEETRGIKLEGKSLCLEEESFEKSNSYGKNIFSNYILQHYNEIDFSRFIPLLNALSSIIKNYSAEMRN

SEQ ID NO: 1235 - protein, 568 aa, Bacillus sp.
  source 1..568: note = Related to NVHA01000086.1; note = Bacillus toyonensis
MKTFANIKTLDDLSIILKIPKKKLTYILYIKKPNNSYKSFKIPKKSGGERTINTPSTDLKDIQRSILKILWKQQKILWEEHKIKSNISHAFVKKKGILTNARVHKNKRYVFNMDLEDFFDSFHFGRVRGFFEKNRDFLFPQNIATILAQLTCYNGCLPQGAPTSPIITNLICNILDMRLLTVAKEFKLDYTRYADDLTFSTNDEKFVENLEDFKTKAKEIINHSGFKINEKKTRLQYKNSRQVVTGLVVNKKVNVNRDFYKETRAMANSLYKNGEIKINEKSATINQLEGRLSFINQIDRDNNKVNKKSNKKFHSHLSTLNGKEKQYQMFLFYKYFMANNNPCIITEGKTDIIYIKYALKKMHRDYPKLIKKNYDGTFQYKISFLNRTKRLKYFFNLELDGADTMNKIYEFYSNRNNDSFPNYNEKFEKFGVSPENPIIFILDNELSSKENKPLKKLISQVALDKTKIASFKENNFINITSNLYLTTHQLVKDLKECEIEDLFDNDTLNVKLNNKSFERDSKKFNDKIHYGKAIFADHVSKNYKNIDFSEFRPLLDNLNNIITNYSVN

SEQ ID NO: 1236 - protein, 567 aa, Bacillus sp.
  source 1..567: note = Related to NTTM01000084.1
MQTFENIKTLDDLSIILKIPNKKLTYILYIVKPDNSYKSFKIPKKSGGERTINTPSTDLKDIQRSIVKILWKQQKILWEEHKIKSNISHAFVKKKGILTNARVHKNKRYVFNMDLEGFFDSFHFGRVRGFFEKNRDFLFPKNIATILAQLTCYNGCLPQGAPTSPIITNLICNILDMRLLTVAKEFKLDYTRYADDLTFSTNDEKFVENLEDFKTKAKEIINHSGFKINEKKTRLQYKNSRQVVTGLVVNKKVNVNREFYKETRSMANTLYKKGKFEINGKTATINQLEGRFAFINQIERYNNGIYKNNNAPLKLCDLNGKERQYQMFLFYKYFFGNSKPCIITEGKTDIVYIQSALKNLYESYPKLVKKKADGTYQFKITFLRRSKRLRYFLDFQLDGADTMTKLHNFYCNTNNNSYPNYPEKFRKLGTTPKNPVIFVLDNELHNNEKPLRKLIKNVKLDKNLSEFDSSKEKYHINITSNLYLSTHQLVKGLQECEIEDLFDDNTLNTKIYDKTFERDSKKYSDKKNYGKAAFADYISKNYKDIDFENFKPLLNNINEIITTYSLS

SEQ ID NO: 1237 - protein, 568 aa, unidentified
  source 1..568: note = Related to NZ_CP071798.1; note = Sporosarcina sp.
MYTFKNISTITDLAKILKIPKKKLTYVLYIKKTDNSYKFFKLPKKSGGERTIYNPSDDLKDIQRSIVNLLWTQQLIIWKENNIKPNISHAFIKEKSIITNARVHKNKRYVYNMDLEDFFDSFHFGRVRGFFEKNKDFLFPQNIATVLAQLTCYNGCLPQGAPTSPIITNLICNILDMKLLQIAKKFKLDYTRYADDLTFSTNDGHFLENIEEFKIQTERIIKYSGFKINKKKTRLQYQNSRQVVTGLVVNKKVNVNRKFYKETRSMANKLYVNGEFKINGKKASINQLEGRFAFINQIDRYNNSIKINNNKIQSKTRNLNGKEKQYQMFLFYKYFFANNNPCIVTEGKTDILYIKSALKNLYEEYPNLIQRNSDGTFNYKISFLNRTKRLRYFFNFELDGADTMNQIYNFFSNKNNDKYPNYQEKFRKLGSSPNNPVIFILDNELSNRDKPLKKLIKPLELENNSLKFNHFKDNNFVNLTSNLYLLTHQLVKNLTECEIEDLFDESILNTTLHNKTFEKDSKKFDDKLNYGKAAFADYISKNYNKIDFTEFKLLLDNLNEIITSHSSK

SEQ ID NO: 1238 - protein, 568 aa, unidentified
  source 1..568: note = Related to JPUW01000004.1; note = Lysinibacillus sp.
MNTFENITTLDDLSRTLRIQKKKLTYILYVRRIENSYTYFTIPKKSGGERTINSPSTDLKEIQKSIDRLLRKQQIIFWEENNIKPNISHAFNKKKSIMTNAKVHKNKRYVFNIDLEDFFDSFHFGRVRGFFEKNKNFLFPQNIATILAQLTCYNGSLPQGAPTSPIITNLICNVLDMKLLKIAKKFKLDYTRYADDLTFSTNNTNFLENFEEFKDRVEAVIKYSGFKINEKKTRLQYKDSRQVVTGLVVNKKININRDFYKETRSMANTLYKHGEFKINGEQATLNQLEGRFAFINQIDRFNNDIYIKNNTVKPKLCDLNGKEKQYQMFLFYKYFFGNNKPCIITEGKTDSIYIKSALKKLYNLYPTLIKKNQDGSYNFKVSFLRRTKRLRYFFDFPLDGADSMKKLYNFYCNTNNDSFPFYAEKFKELNVVPKNPVIFILDNELENNSKPISKLIKATKLESDKQKLAFFKSKYYANISSNLYLSTHQLVKEKKECEIEDLFDVNTLETIINNKTFERNSTKYKDQNNYGKAVFANYVSKNYKKIDFNNFKPLLDAINEIVSNYTTT

SEQ ID NO: 1239 - protein, 571 aa, unidentified
  source 1..571: note = Related to VHRP01000005.1; note = Enterococcus faecalis
MKTFENISTLDELSQILKVPKKKLTYILYVKRIENLYTSFEIPKKTGGERTISSPSTDLKEIQKNIAELLRKQQNIFLEENNIKPNVAHAFNKKRSIMTNANLHKHKRYVLNIDLENFFDSFHFGRVRGYFEKNKNFLFPQNVATILAQLTCYNGKLPQGAPTSPIITNLICNVLDMKLLKIAKKFRLVYSRYADDLTFSTNDRNILENLEEFLAQLEFIVNKSGFTINKKKTRLQYKDSKQVVTGLVVNEKVNVNRLFYKETRSMADTLYKTGEFRIGDDKGNLNRLEGRFSFINQIDRFNNKIGKGKNIGNKESKKLNGRERQYQMFLFYKYFYCNTKPCLITEGKTDIIYIKSALKKMYLSYPNLIEKNSDGTFHFKFLFLRRSKRMRYFFELKLDGADTMSKIYNFYCDTNNHNYPNYVKKFTEKSVSPINPTILIYDNELKNKDKPLSKVTNTTKIRQDEEKYNFLKTNHYVNVTSNLYVLTHQLVKGLPECEIEDLFDSNTLSVTINDKTFERDLKKFDENKNYGKAIFAGYISKNYLNINFDEFKPLLDNLNTIVTSYNLKSQT

SEQ ID NO: 1240 - protein, 564 aa, unidentified
  source 1..564: note = Related to NZ_CP046022.1; note = Enterococcus faecalis
MKTFDNIKNLEQLSQVLKVPKRKLTYVLYVKRIENLYMDFEIPKKTGGTRKISSPSKDLKEIQKNIAKLLERQQEIFLKENNIKSNISHAFTKDRSIMTNALIHKRKKYVLNIDLENFFDSFHFGRVAGYFEKNENFLFPKKTAVILAQLTCYNGKLPQGSPSSPIITNLICNILDMKLLKISKKFKVDYSRYADDLTFSTNNNKFIEELDIFLSQLEKIINKSGFEINKKKTRIQYRDSKQMVTGLVVNNKVNINRKFYRETRAMAISQYHTGTFKIDNEEGNLKRLEGRFSFINQIDRFNKKITSKNTVVGKKTNILNGKEKQYQMFLFYKYFYCNSKPCIVTEGKTDIMYIKAALKNLYKFYPKLIEKKSDGTFHYRISFLKRSKRIRYFFDLSLDGADTMIKIYNCYCDVNNVNFPNYAKFFENKGVLYTNPTVLIYDNERSNTEKPLYKALKATKINENKEKLESLKSNYYTNITSNLYILTHQLVNGLAECEIEDLFDSKILEMKIDGKSFERNLKDFNDTEHYGKAIFADYILKNYHAINFDNFRPFLDCLNKIVES

SEQ ID NO: 1241 - protein, 575 aa, unidentified
  source 1..575: note = Related to CP076644.1; note = Listeria monocytogenes
MDTFEDINSLEELAKILKIPKKFLTYILYKKKVENSYTNLLIPKKSGGQRNISIPMKELKDVQRNIVKVMLTQQNIFQFENNIKSNISHAFTKDKSIITNAEIHKNKRFVLNIDLEDFFKSFHFGRVQGYFEKNKSFLFPKNIATVLAQLTCYNGSLPQGAPSSPIITNLICNILDMKLLKIAKKYKLDYSRYADDLTFSTNNKNFEEKSEEFFYQLEIIIKQSGFKINPKKTRLQYKTSRQIVTGLVVNKKVNVTREFYKNTRAMANSLYKTGAFTINDTKGTLRQLEGRFSFINHINKVNNKKRQINDKESTLNFRCLNGQEKEFQKFLFYKYFFNNEKPCILTEGPTDILYLKSALKSLYEDYPKLIKKVNGEFIFKIFFLERSKKKKTQKVSKMEYFFGLKENGADTMIQIYNYYVSNKQKKHCPNYSELFKKMNVTSKNPCILILDNELSVKEKPLKNLLNYMGIIDGCKIAELKEKCYLNSTSNLYVATNPLVNELKECEIEDLFEEAVLKTELNGKTFEKSEKAFNDTRNYGKRALSKYVWNNYDNINFENFRPLLDAIDQIVTKYNH

SEQ ID NO: 1242 - protein, 583 aa, Bacillus sp.
  source 1..583: note = Related to NZ_CP009684.1; note = Bacillus subtilis
MNTFEDITSIDNLSNILRTPKKKLTYILYIKKIQNSYTTFQISKKSGGQRIINVPSKDLKDIQRNIVNMLLNQQKKFYYENKIRLNIAHAFTKEKSIITNAKIHKNKRFVLNIDLENFFESFHFGRVQGYFEKNKNYLFPKNIATVLAQLTCYNGSLPQGAPSSPIITNLICNILDMKILKIAKKYKLDYTRYADDLTFSTNNKGFDEKSEEFISQLEMIIKQSGFKINRKKTRLQYKQSRQVVTGLVVNKKVNMPRNFYKNTRAMANSLYKNGSFTINGVEGSLKQLEGRFSFINHINKENNKEKKKIDKNSKLGFRNLNGQEKEYQKFLFYKYFFNNEKPCILTEGPTDIIYLKSALKNLYTDYPKLIKKVNDDFIFKISFLKRGEDPKASKAHKKIKGQKTSKLQYFFGLEKDGADTMKQIYNFYVSDKQKKDCPNYSEIFKNMNVNSKNPCIFILDNELNNKDKPIKTLTNYMDLKPDKLDELCDKNYLKIISNLYIVTNPLVNELNECEIEDLFELDTLKTELNGKTFERCEKKYNPSENYGKRAFSKYVWKNYEDINFENFRPLLDNINQIVTNYND

SEQ ID NO: 1243 - protein, 566 aa, unidentified
  source 1..566: note = Related to NZ_PYWN01000149.1; note = Metasolibacillus meyeri
MDTYKDITSLDDLSRILKTPKKKLTFVLYIKKAENSYTSFKIPKKSGGERVINAPSNDLKDIQRNIVKMLLKQQRVFLFENNIKSNIAHAFTEDKSIITNAKVHKNKRFVLNLDLENFFESFHFGRVKGYFEKNKNYLFPENIATVLAQLTCYNGSLPQGAPSSPIITNLICNILDMKLLKTAKKYKLDYTRYADDLTFSTNNKNFADQLEEFTKQLEVIIKQSGFKINEKKTRLQYKQSRQVVTGLVVNKKVNVKKDFYKDTRAMVNSLYKNGSFTINDSEGSLNQLEGRFSFINHINKESNKERKKIDKNLKLNFRNLNGKEKEYQKFLFYKYFLSNKNPCILTEGPTDITYLKSALKNLYTDYPNLIEKVDENFHFKISFLKRTKKMKYFFDLEEEGADTMKKIYNFYTVNKEKNDCPNYSEIFKNINVLPKNPLIFILDNELANDNKPLKNLVNYMALKKEKIHELQTKNYINVTSNLYIVTNQLADNVKECEIEDLFDAETLDAKLNGKTFERDKTKYTDAANYGKKAFASYIWKNYKDINFENFRPLLDCINLIAKDYID

SEQ ID NO: 1244 - protein, 565 aa, unidentified
  source 1..565: note = Related to JAARXI010000004.1; note = Listeria booriae
MGSFENIKTRGDLAGLLNIPSSKLSYILYIKKIENLYSSFKLPKKSGGHRVINSPEEDLKDIQKSLAKFLSRQQKIIWDARGINQNISHAFIEGKNIISNAENHMNKRFILNVDLEDFFDSFHFGRVRGFFAQNRDFRFPIDIATIIAQISCYNRTLPQGAPSSPIITNLICNILDIRLLKISKKYRVNYTRYADDLTFSTNDRSFSDKYMKFLVEISLEIKHAGFMINNKKTRLQLKDSRQEVTGLIVNKKVNVKKEYYKKTRAMADNLYRHKTFDIDGKPGTINKLEGRFSFINQLDRRNNEINRKRVELTQKSNSRHCLNTREKGYQYFLFYKYFFACPKPTIITEGKTDIRYLKAALKNLYLEFPKLIERKADGTFEFKVSFLRKTKRLKYFMELQLDGADTLKNIYNFYNEKGRQPNLSKYFEMKSKTKPDNPVIMVFDNEISNKNKPLYTFTNYASTQPESKQMLMKNLSINITNNLFLLTHQLVGQRTECEIEDLFNKKALDTKLDGKSFSKNPDTKQEYGKEYFSSYVLKNYQNIEFDNFRPMLQALNSIIESYSKG

SEQ ID NO: 1245 - protein, 563 aa, unidentified
  source 1..563: note = Related to NZ_KE386795.1; note = Veillonella magna
MNQRGSGIQDKRDLCRKLRIQYRLLTYILYKKGIDSFYEQFKISKKSGGIRIISAPKRPLKFVQKRLAQMLQTFYDGSTTKKNNIAHGFLKSRSIITNARNHRNKRYVINIDLENFFDSFHFGRVCGFFEKNKNFLFPKEVAVTLAQLTCYEGSLPQGAPCSPIITNLICQILDYRVLRIAKKFKLNYTRYADDLTFSTNDRKFVNEYDEFIKQVEAEIIRAGFRMNTKKTRFMYKDSRQVVTGLVVNKKLNIPHEYIRRTRAMAHSLYTKGEFNIDGVLGSIEQLEGRLSFINYIDKYASTYAEYKRYNRFTPKEMSGRERLFQQFLFYKYFYHNELPVIITEGKTDKRYIKAALKSLCHHYPALVTAVGNGRFKFHISFLRRSKRLERFLGIQHDGADSMKVISNYYGSPNSEGLPDYYSYFSKYSCEATNPVFLLYDNEISNKNKPIRKMLNFWKQKVEDIVNIVEKQQYCCLQGNLYILTFPTLNGMAENEIEDLILKDNPLIQIGGRNFSREERYDISKFFGKNEFSQYVLDNYDKLRFDSFRPLLDTLNSIIKEYKE

SEQ ID NO: 1246 - protein, 567 aa, unidentified
  source 1..567: note = Related to NFKI01000003.1; note = Pseudoflavonifractor sp.
MKKFCDIQSRNELADYLGISHKKLTHILYIKKPDNYYTTFEIPKRNGESRTICAPSGHLKALQVKLANMLWCYQKSIWEEKGVKPNISHAFEKEKSIITNAKIHRNKRFVLNLDLENFFDSFHFGRVQGYFEKNNNFKLPYDVSVILAQLTCYQGRLPQGAPSSPIITNLICQTMDIYLLRVAKKYKLDYTRYADDLTFSTNDRHFVENQEKFLAEAIAAIKRAGFSINEKKTRLQFRDSRQEVTGLIVNKKLNVNHAYVRKTRAMAHQLYSTGEYLIDGVPGTIKQLEGRFSFIDHLDHHNNILDPQEIKHDAFHLNGRERQYQAFIFYKYLYAHTVPVIVTEGKTDIRYIKAALKSLYTKYPRLIQKDAEGNFIYNFSFFKRTKRWKYFFGISLDGADAMKILYHYHAGNGKKIPAYHSYFRQLSGLEQHNPVILLYDNESKSERPLKKFLGEGVHATAEQKATLKSDLHIRLIPDSKLFLVTPPLVGSKEECEIEDLFSDELLSLNLDGKTFCRKDKFDDSKYFGKEIFSQYVYENYQTIDFSRFIPLLDVIDTIIAEAESPKK

SEQ ID NO: 1247 - protein, 566 aa, unidentified
  source 1..566: note = Oscillospiraceae bacterium; note = Related to JAGZJF010000013.1
MKKFCDIQSRNDLADCLGIPHRKLTHILYGKKPDSYYTTFEIPKRNGDPRTICAPSGDLKTLQVKLTNLLWSYQKSIWEEKGIKPNISHAFEKEKSIITNAKIHRNKRFVLNLDLENFFDSFHFGRVQGYFEKNCNFKLPHEVAVILAQLTCYQGRLPQGAPSSPIITNLICQAMDIYLLRVAKKYKLDYTRYADDLTFSTKDRHFVEKQEKFLAEAIAAIKRAGFSINEKKTRLQFRDSRQEVTGLIVNKKLNVNHAYVRKTRAMAHQLYSTGEYLIDGVPGTIRQLEGRFSFIDHLDHYNNILDPQEIKHDAFHLNGRERQYQAFIFYKYLFANDKPLIVTEGKTDIRYIKAALKSLYARYPRLVQIGADGNFTYNFSFFRRTKRWKYFFGISLDGADAMKFLYRYHVGKNHVPEYLKYFRQLSGCEQHNPVILLYDNELEHKKPLKQFLAEEVHATEEQKTELKSHLQLHLIPDSKLYVVTNPLVDSKDECEIEDLFAEEVQNINLDGKTFCRKDSFDNSKFFGKDIFSKYILENYKQIDFSRFIPLLNAIDSIIAQTQPTEK

SEQ ID NO: 1248 - protein, 566 aa, unidentified
  source 1..566: note = Related to NZ_JACOEA010000001.1; note = Intestinimonas sp.
MKKFCDIQSRNELADYLSVPRNKLTHILYVKKPDSYYTTFEIPKRNGETRTICAPSGDLKTLQEKLSNMLWLYQKSIWEEKGIKPNISHAFEKGKSIITNAKIHRNKRFVLNLDLENFFDRFHFGRVQGYFEKNNNFKLPHDVAVVLAQLTCYQGRLPQGAPSSPIITNLICQPLDTYLLKIAKKYKLDYTRYADDLTFSTNDRHFVENQENFLAEANAAIKRASFSINEKKTRLQFKDSRQEVTGLIVNKKLNVNHAYVRKTRAMAHQLYSTGEYLIDGEPGTIKQLEGRFSFIDQLDRYNNVLDPQEIKHDAFHLNGRERQYQAFIFYKYLFAHNAPVIVTEGKTDIRYIKAALKSLYAKYPRLIQKDAEGNFIYKFSFFRRTKRWKYLFGISLDGADAMKILYRYHVGNGKKIPAYLGYFRQLSGGEQHKPVILLYDNEPNSDRPLKKFLGEDVHPTADQKAALKENLHMRLIPDSKLFVVTPPLVGDKEECEIEDLFADELLKLSLEGKTFCRKDKFDNSKYFEKEIFSQYVYENYQKIDFSGFIPLLDVIDSIIAQTESAE

SEQ ID NO: 1249 - protein, 567 aa, unidentified
  source 1..567: note = Ruminococcaceae bacterium TF06-43; note = Related to QUKQ01000046.1
MKKFCDIQSRNELADYLGIPRSKLTHILYVKKPDSYYTTFEIPKRNGDTRAICAPSGDLKVLQKKLSNILCLFQRNIWDENGIKPNISHGFEKEKSIITNAKIHRNKRYVLNLDLASFFDSFHFGRIQGYFEKNNHFKLPHDVAVILAQLTCYQGRLPQGAPSSPIITNLICQSLDAHLLKAAKKYKLDYTRYADDLTFSTNDRHFVENQKKFLAEAIVAITKAGFSINEKKTRLQFRDSRQEVTGLIVNKKLNVNHSYVRKTRAMAHQLYSTGEYLIDGVPGSIKQLEGRFSFIDQLDHYNNILDPQEIKHDAFNLNGREKQYQAFIFYKYLFANDTPVIVTEGKTDIRYIKAALKNLYNKYPRLIQKDAEGKFVYTFSFFRRTKRWKYFFGISLDGADAMRILYRYHIGSNKRIPPYLSYFQKLSDHEQHNPVILLYDNESKSERPLKKFLGEDVHATVDQKAELKAKLHMRLITSSKLFVVTPPLIGDKEECEIEDLFSDELLSLNLEGKTFCRKDKFDSNKYFGKEIFSQYVYENYRTIDFSRFIPLLDVIDMIIAQAESHKQ

SEQ ID NO: 1250 - protein, 563 aa, unidentified
  source 1..563: note = Related to NZ_CP035283.1; note = Caproiciproducens sp.
MEKFCDIQTRNELADFLKIPRSKLTHLLYIEKPENDYKTFEIPKKSGGTREICAPSGSLKSIQSKLAEALWEYQKSIWADRKIHPNISHAFEKGKSIITNARIHRNKRFILNLDLENFFNTFHFGRVQGFFEKNYNFMLPHKAAVAIAQIACYKGVLPQGAPSSPIITNLICQILDTRLLKIAKKYKLDYTRYADDLTFSTNNRFFMDNHEKFLTEVALEIRKAGFTINHKKTRLIFRDSKQEVTGLIVNKKISVDRNYYKETKAMAHRLYTQGEFEINKQSATMQQLEGRFSFIDQLVHYNNKLDGGTHNPHTLNGREKEYQAFLYYKYFFANDRPLIVTEGKTDICYLKSALKNLHAKYPNLIEKDSKGKYVFKISFFKRSERWRYFFGIGLDGADTMKNLYHFFTSKNDAPDYLTRFRKLCKCSPRKPVILLFDNETESSRPLKKFLCENKINDEDKKQLEQNLHIRLIPESKLFLATTPLVSDKLECEIEDLFPDEVLKHKVDGRTFTRKDNYDKKKYYGKEIFSTYIAANYEKIDFSRFEELLNTLSMIVKSEEAPQD

SEQ ID NO: 1251 - protein, 571 aa, unidentified
  source 1..571: note = Acidaminococcaceae bacterium; note = Related to JAGAWV010000307.1
MKNINDLKTRSELADYLGISRRRLTYILFIKTPDSYYQTFDIPKASGGVRNICAPTGILKRLQTILAKRLWLKYVSDKVRNKIENTNISHAFEKRKSIITNARIHRNKRYVINLDLENFFDSFHFGRVLGYFEKNKNFMLPHEVAVALTQLVCYQKHLPQGAPTSPIITNLICQILDFRLLKIAKKYKLNFTRYADDLTFSTNDKKFLDLKEHFFKEITTDILRAGFSVNNRKTRIEFKDSRQEVTGLTVNKKVSIKREYVQNTRAMAHHLYTQGHFSIDGQDGDISQLEGRFSFINQLDVYNNRLLLQFLKIDKNNDLKLNKREKEYQKFLFYKYFYANEKPLIVTEGKTDVLYLKAALQNLYARYPELIEKNDKGHFSYKIAFFNRSDKWERLFKFVKDGADSIKNLYFCFSEKNNSSFPNYFKYFLKLSNEKQKNSVILLFDNEIDSENKPLKKFLGVIKASNDAKDTLRTSYTLQLIPDGKLFLVTNPLAVDKKESEIEDLFPVEVLNIKIEGKVFCRDDKFDKTKYYGKHIFSKYVYKNYKMINFTGFIPLLDVIRSITVNLSDQK

SEQ ID NO: 1252 - protein, 584 aa, unidentified
  source 1..584: note = Firmicutes bacterium; note = Related to JAHAER010000020.1
MKEFSDVNSREELALALRVPLSKLTYILYVATVDSCYRTFEIPKKNGGTRVINAPQRDLMDIQKNLAKLLYEHRSNIKNFNNVKCNIAHAFEKEKGIITNGSVHRNKRIVLNYDLENFFDSFHFGRVRGYFWKNRYFRMNLDVATIIAQLTCYQGKLPQGAPTSPIITNMICEIFDFKLLRLAKKYKLDYTRYADDLTFSTNNAEFENRIDEFTEELSKEIDNAGFKINRDKTRLQLRKSRQTVTGLVVNEKVSVDHRYYKATRAMAHNLYREGGFDICGEEGSLEQLEGRFSFVNQIDKYNNKLEMSGRIGRSGRASGRAGAGAGGNEKKKHDFRHLNGREREYRKFLFYKYFVAGERPMIVTEGKTDILYIKAALKSFYKEYPELIEKRKDGTFDFKIDFLRRSEKLKYFFGLTADGADSMKNLYNYFSDMNNNSFPNYAEYFGEKMKCAPLHPTILIFDNELEGKDKPLKKFTDHIKMQDRKESLKRDLAMHISGSLFIATLKLPEGKKEAEAEDMFAPSVLEHEIRGKRFSRSDEYDKSKFYGKNDFAQYVFFNYKEIDFSGFRPMLDSILMIKRKYRYM

SEQ ID NO: 1253 - protein, 569 aa, unidentified
  source 1..569: note = Clostridiales bacterium; note = Related to JAAYIN010000072.1
MGNFKDIATRNELADFLGFPRRKLSYILYVKSTDAYYQSFTIPKKSGGERCINAPTGDLKDIQKKLAMALWKHQLDIRTSRNIRTNISHAFEKGKGIISNAQIHRNKRYVLNLDLKNFFSSFHFGRVKGYFEKNRDFELPNQVATVIAQLTCFQGCLPQGAPTSPIITNMICQILDMKLLRIAKRYKLDYSRYADDLTFSTNNRAFLGMQSEFYEDVAKEVTSAGFTINEKKTRLQYKDSKQVVTGLIVNKKLNVDRIYARKTKAMAHTLYTNGEYTIDGKIGTLKQLEGRFAFINQLDKYNNKRDGKGEHKGWNLNSREKQYQKFLFYKYFFSNSKPIIVTEGKTDVVYMKAALRKLHAEYPCLIERKPDGTFEYHVSFLKRSKRLSYFLHISQDGADTMKNLFNFFSPTSDNKRVYPDYLTYFMKAGNCSAQNPVILVFDNELSSKNKPIKKFSDHVKLDDVRRETLKRILHLKLIDKGNLYLLTNPLVDGKDECEIEDLFDENTLSQVIDGRTFSRDIKKGDTQHYGKETFSMFVSRNHMNIDFSRFREMLNILNEIIGLYHKPEV

SEQ ID NO: 1254 - protein, 572 aa, unidentified
  source 1..572: note = bacterium 210917-DFI.7.65; note = Related to JAJCJJ010000005.1
MSFFQHIETRNELADFLGIPRKKLTHLLYVQRIENCYHMFEVPKRAGGTRVICAPTGDLKSLQRSLARRLQEHCLRCREERGLSVNIAHAFQPRRGIITNAYIHRNKRYVFNTDLEDFFGSIHFGRIRGYFQKNEYFQMPAEVATILAQLCCYQGKLPQGAPTSPVLSNLICEILDFRILKIAKHYKLDYTRYADDLTFSTNDKTFCSRYDAFYQQLQKEIRRAGFAVNEKKTRLEYRDARQTVTGLVVNRKLSVDRCYCRETRAMAHTLYKTGEYRIQGAAGTMAQLEGRFAFINQLDRYENKHSLSKPRDFKTLNGRERQYQKFLFYRYFYANTHPLIVTEGKTDILYLKAALMNLHRRYPELVVRQPDGTFAFQVRFLHRSKRLRYFFDLSLDGADAMKNLYELYTGKGAHWKTAYYPYFLALSGKKPQWPVILVYDNEINDKTRPISKLLHSIGMGEEGKERLKKSLKEQLVAGGNLYLVTHPLAEGKSVSEIEDLFAERTRAVVIDGRGLSLRDDYDPQVSYGKDAFSKYVLSHYQTIDFVRFIPLLDRIRDAVAETQAAEQEPEGV

SEQ ID NO: 1255 - protein, 620 aa, unidentified
  source 1..620: note = Clostridiales bacterium; note = Related to SVGI01000005.1
MTAFKNIKSRSDLADYLNIPPSKITYILFKRGVDSYYTEFEIPKKSGDPRRICAPTGDLKGVQRQLADALWEHQKSIYEELWIKPNISHAFEEGKSIITNAKIHRNKRVVVNVDLKDFFDSIHIGRVCGFFEKNKYFNLPHEVAVTIAQLACYQGKLLQGAPTSPIITNLICQVLDMHLLSLAKRYKLYYTRYADDMTFSTNDRSILERWDSFYEELDKKVKKAGFSINEKKTRITYRDSKQIVTGLVVNKKISVDHSYCRKVRAMAHSLYTNGSYQADGVEGTARQLEGRFAFIDQIEKYNNTCDSTGKHDAFVLNGREKQYQQFLFYRYFFDVDKPLIVTEGKTDVRYIKAALRNLYTEYPELIEKDAKGKFIYKVNLFKRSKRFKYLFVLALDGADSLTYLYNHFVSTGKDNRINYLDYFLKITQRVPQHPVIFVYDNEITNSKKPLYKFANHAKLDNNQRALLGTELFLRLTPRGNLFLLTNPLVEGKNESEIEHMFTEETRGVELGGKKLSLESKFDNAKFFGKDHFSNYVLENYAKIDFSGFRPFLNTIRTVLQEYERSIAKEQTTPMRTKILIGVCFSCQPLPHSKQRKDSAENCDEKTKNAEIAGFLRRNLL

SEQ ID NO: 1256 - protein, 565 aa, unidentified
  source 1..565: note = Related to BK026599.1; note = Siphoviridae sp.
MTFEYVCTRNDLADLLEIPHGKLTHVLYVAKVDSFYKIFEIPKKSGGTRKICAPTGDLKQIQEKLYSILLHHQQFLRKQNNIRTNISHAFEKGKSIITNGEVHRNKRIVVNIDLQDFFDSFHFGRVCGFFEKNRDFALPHELAIVMAQLTCYQGKLPQGAPTSPIITNYICQTFDMRIIRIAKKYHLDYTRYADDLSFSTNDKKFIEQWEPFYNELTHEVERAGFKVNTKKTSVQYRDSRQTVTGLVINKKLSVDHRYYKQVRAMADSLYKTGCFDNNGVEGTVSQLEGKFAFIDQLDKYNNIKDVSQQHSVFCLNGREKQYQKFLFYRYFFAHEKPVIVTEGKTDIKYIKAALKNLYTEYPELIEKTPEGHFEFKVSFLKRSKRFKYFFHMSQDGADAMKNLYNFFSDKNPKYTNYFKVFSGCSDKNLCNPVILIFDNELSNKCKPLHSFVSHIGLSSSDKDRLKEDLCMKIIDEGNLFLVTNQLVDGKAECEIEDLFDDTTRNHVIAGKTFSSNDKADKEKHYGKEIFANFIQSNYKSINFDNFRPMLNNIVKVIAEFAGTEG

SEQ ID NO: 1257 - protein, 520 aa, unidentified
  source 1..520: note = Proposed Anaeromassilibacillus sp.; note = Related to NZ_NFJU01000007.1
MLKKDGNIRTIKAPSSELKSIQKKLASKLESCQRNIWTGIGVNSNIAHGFKKGKSIVTNAQIHRNKKYILNIDLQDFFDSFHFGRVRGFFEKNRNFALPIEVATVVAQLTCFEGCLPQGAPTSPIITNLICQILDNRLLKLAKRYKLDYTRYADDLTFSTNDKAFVERKDEFLCAIQKEIERAGFKINEKKTRLVYKDSQQKVTGLVVNQKVNVAQDYYRKTKAMAHSLYKKGEFTIDGQAGTIEQLEGRFSFINQLNCYNNQHDGEKHEFGLLSGREREFKRFLFYKFFYGNDIPILVTEGKTDVRYLKAALKSLYNEYPNLITKSKDGKFRFKFSFMKRTKRLRYFLGVQADGADTIQNIYKYFVGGKGRESKNYPNYFAYFLRMGTQPKAPVILLFDNELESKRPLRKFLNEQKFSETQIDQLRNELCLKVFNSGKLYLLTNPLVLEKTECEIEDLFSEETLNLLIGGKNLCLKDKYDTEKYYGKEIFSQYVLNHFEQIDFSGFRPLLDKLSLIVRQ

SEQ ID NO: 1258 - protein, 561 aa, unidentified
  source 1..561: note = Oscillospiraceae bacterium; note = Related to BQOK01000001.1
MAQFCDIASRNELADFLGIPRQRMTYVLYVKKVESYYTSFEIPKKNGETRTIKAPTGELKFIQKKLVSKLVQYQREIWRSKGMKPNISHGFEKGKSIVTNAKIHKNKRYLLNIDLQDFFDSFHFGRVRGFFEKNRDFALPLEVATVLAQLTCFEGCLPQGAPTSPILTNLICRILDNRLLKIAKRYKLDYTRYADDLTFSTNDKTFAGLKDEFLCTIQKEIERAGFKINEKKTRLACKNSQQKVTGLIVNQKVNVAQDYYRKTKSMAHSLYTKGEFTIDGQTGTLEQLEGRFSFINQLDWYNNKLDNETHEFGVLAGREREFKRFLFYKYFYGNSTPIIVTEGKTDVRYLKSALKSLSKEYPNLITKSKDGKFEFRVTFLKRTKRLQYFLGIRLDGADTIQNIYRYFMGGKGRESKRYPNYFSYFLRMGAKPKKPVILLFDNELESKRPLRKFLTEQKLSEAQIEDLRSKLYLKILDNGKLYLLTNPLISGEKECEIEYLFSEETRNLKIEGKSLCLKDKFDTEKYYGKEIFSQYVSANFEQIDFSGFRPLLDKLDLIVQQ

SEQ ID NO: 1259 - protein, 561 aa, unidentified
  source 1..561: note = Candidatus Gemmiger stercorigallinarum; note = Related to DWWX01000035.1
MAKFCDITSRNDLADFLEIPRKVLTYVLYVKKTENFYASFEIPKKNGGTRTIIAPSGELKSIQKKLARELERYQQDIWASKGIKPNLSHGFQKKKSIVTNARIHRNKKYVLNIDLQDFFDSFHFGRVRGFFHKNKDFALPIEVATVLAQLTCFEGRLPQGAPTSPVVTNLLCQILDNRLLGIAKKYKLDYTRYADDLTFSTNDKMFVEHKDEFLRTIQKEIEHAGFKVNENKTRLAYKDSQQKVTGLVVNEKVNVAQEYYRRTKSMAHSLYKTGEFTIDGEVGTLQQLEGRFSFINQLTWHNNRQDGKEHSFGTLSGREREFKRFLFYKFFYGNDIPIIVTEGKTDVRYLKAALKALHKDYPDLIEKNKDGKFEFKIVFFKRTERLRYFLGIQLDGADAMQSVYKYFVGGKGRESKNYPNYFAYFQRMGAQPKKSTILLFDNETKSKRPLGKLLTEQKFTEEQIRKLKQELHLKVLDKGNLYLLTNPLVPGEEECEIEYLFSEETRSTLIDGKSLCLKDKYDTEKYYGKEIFSQHITDHFEQIDFSGFRPLLDALTSIVRQ

SEQ ID NO: 1260 - protein, 560 aa, unidentified
  source 1..560: note = Related to NZ_JHVL01000054.1; note = Clostridiisalibacter paucivorans
MNRFYNIKNRRELASFLGIPLKKLTYILYKKGVDYYYETFEVPKRNSGARIINAPSGDLKTLQKKLSKILYEHQIIHIQNHKIKNKISHGFEKEKGIITNAEIHRNKRFVMNVDIKDFFESFHFGRVKGFFNKSKAFNMSEEVAIIIAQITCFNGKLPQGAPTSPIITNLICNILDMRILSICKEYKLDYSRYADDLTFSTNDKHFIKNKNGFYDNLKREIQGFGLLINEKKTRIEYKDSRQVVTGLTVNKKISVKREYYKNTRAMADKLYRTGEFTIGEKAGTIRQLEGIFSFINQIDYFNNKKDNNKKHNVNNLNSREREYQKFLFYRYFLSNSKPLIVTEGKTDVMYIKAALKKHYKEYPNLIEKHRDEFEFKISFLNRTKRLRFLMGIQIDGADTFLNIYNFYTGKNNFNNYFKYFNDKYKITPSNPVILIFDNEQKEKNKPLYKFKKAVKMNTIDLSSEIIANLFLLTVPLCNNKEECEIEDLFDEKALNHKIGGKKFSRKNENNKKYYGKADFAKYIYKNYKDIDFSNFKLMLDELNLVVNNHNNNSSLSTVGV

SEQ ID NO: 1261 - protein, 562 aa, unidentified
  source 1..562: note = Related to JAFVVV010000369.1; note = Clostridia bacterium
MKNLSEVSTRNELADFLGIPIKKLTHILYVKKPDTFYKQFEIPKKSGEPRIINAPTGALKSIQKRLLFAIEKTICDGSSNKSNISHAFEKNKSIITNAKIHRNKKIVINFDLNDFFGSFHFGRVCGFFQKNRCFNLPYEVAVAITQLVCFNGTLPQGAPTSPIITNLISQIMDVNLLKLAKKYKLDFTRYADDLTFSTNDKKFLEKYDEFYDQLSRTISFLGFEINETKTRLQFCDSHQTVTGLTVNKKIQVPRNYYKKTRAMAHSLYKSGSYTIDGEEGTINQLEGRFSFIDQLTKHNNKIDGQKHRLGTFCARETDYQKFLFYKYFFAAEKPLLVTEGQTDITYLKAALKNLYLEYPSLISKKEDGTFEFKISFLNRTDRLSYFLGFSKDGADAMGCLYNFFIKSKSKEHPNYYEYFLKTSGSKAHYPAIFVFDNELESKGKPLKKFFDNYVKDEETKKEIKTQLYVHLIKSANIYLVTNPILESSSKEAEIEHLFSKEVLETKIDGKPLSLSGDYDKSKYYGKVAFSKYIMNNYKSIDFSNFRIILDNIDKILKEYNEH

SEQ ID NO: 1262 - protein, 566 aa, unidentified
  source 1..566: note = Related to JAFYAQ010000001.1; note = Oscillospiraceae bacterium
MISFSEIKSRNDFADALQIPRSVLTHVLYIAKPESFYESFTIPKKNGEDRIIMAPKGTLKSIQTKLSKQLVEYRASISQKGQEKSNISHGFEREKSIITNAQIHRNKRYVINYDLKDFFDSFHFGRVVGFFEKNKHFLLPYEVAVIIAQLTCYNGRLPQGAPTSPVITNLICEILDYRVLKIAKRYKLDYTRYADDLTFSTNYSRFLEVFDSFAKELLQEISNSGFTINQSKTRLLYRDSRQEVTGLVVNKKIGVNREYVKSTRAMAQALYSTGEFTINGIPGTIKQLEGRFGFIDQLDHYNNVIDDAKHDAYSLNGREKQFQEFLFFKTFFFNEYPLVITEGKTDIRYLKAALKSLHQKYPELICKEDDGTFRFKISFFRRSKRWKYFFGISKDGADAMKLLYRFFTGQKGVKNYYRLFAEKYKAVQRNPVIMLFDNEMESKRPLNKFISEEVKIPSSEQQLFKEQLYYHLIPGSKTYLMTHPLPPGKTEAEIEDLFPTEVLGVKLDGKSFSTKDKFDTSKFYGKDIFSSYVYEHWKSIDFSGFIPLLDKINMLVQNEKKPGLNT

SEQ ID NO: 1263 - protein, 564 aa, unidentified
  source 1..564: note = Related to ABABDZ010000001.1; note = Clostridium perfringens
MIKFTNIQDKNQLANVLNIKPKYLNYILYVKKVDNYYTEFEIPKKNGEMRKIHAPTGILKSIQKNLSILLSEYQSYPYSKNYKGNKISHAFEKNKSIITNAKIHRNKKYILNIDLECFFDSFHFGRVKGFFEKNNFFKLPSEIALILAQMCCYKGCLPQGAPTSPIITNLICKILDIRLLKISKSFKLDYTRYADDLTFSTNDNAFLENKTKFMKLLTKEIEHAGFKLNTTKTRLQYNTSRQEVTGLVVNKKINVKKSYYKTTRAMANTLYRTGQFTIDNNSGTINQLEGRFSFINQIDKYNNSLIKKKDFFNLNSREKEYQKFLFYKYFFSNEKPLIVTEGKTDIVYIKSALKNLYTEYPNLILKKDDGSFEFKISFLKRTKRLNYFFNFAQDGADSMKNLYNFFDKNKSNNSYPHYSNYFSKISNRKPNFPIIFIFDNELNTKNKPLHKFINYINLCESKSLKFQEYYKVNLVDNLYLLTNQLIQHKSECEIEDLFDNQTLTHIISGKTFNRNLKKLDGTNHYSKEIFSKYISENYKTINFDNFKPLLNNLNEILKDYISDI

SEQ ID NO: 1264 - protein, 572 aa, unidentified
  source 1..572: note = Related to AACDFA010000001.1; note = Campylobacter lari
MLFKKEDCILSAELQKFANFFNIKANIISYVLYVKRTENCYTAFEILKKYKKETRIIHAPNKTLKNIQRNIAKKLHELQQDIDSKNNIKTNISHGFEKNKNIATNAMIHKNKRYILNIDLENFFNSFHFGRVMGYFNKNRYFNFDKKMSIIIAQLCCLNGALPQGAPTSPIISNLICRIFDYRILKITKKYKLNYTRYADDLTFSTNDNFFLHHYDNFLKDISSEIQKSGFKINKNKTRLQYKNSKQVVTGLVVNKFINTEKMYYKTTRAMAYNLYKSGSFTINDKEGELNQLQGRFNFILNIKSYSPVIQKDTKNNILHSKEKEYQKFLFYIFFYINTKPLLITEGKTDILYIKAALKNMYKNYPRFIIKSDNKFDYKIAFFKRSSKNIEEYLNIKKDGGHELVKIIIYYFNKKYFDFFYNLNKNITPNNPVIILVDNEKAKDKPLETLKKNIPQAYRNDLNFKEKPWFRIGDTNLYILTYRSNPNLKDIEVEDLLEESFIKELKIQNRVFDKTANKDSELYFSKNTLANYVYKNYLKINFNNFKFIFDDIQDIINDHNNHYPINQTLHTL

SEQ ID NO: 1265 - protein, 548 aa, unidentified
  source 1..548: note = Related to NZ_FYBR01000008.1; note = Listeria sp.
MSLGKIKNRNELARLLEVPTKFLTYILYIKKTDNLYSRINILKKNGDERIIYAPEKELKSIQKKLASILYQERKAYFEGRGITPNISHGFEQKKSIISNARIHCNKHVIFNLDLEDFFGSFHFGRVKGYFEKNNQFKLDSQIAILIAQIACYKGFLPQGAPTSPIITNMICSILDYRLLKLAKQFKLDYTRYADDLTFSTNDKKFLDNKDVFYKKINREIEKAGFKINCKKTRLQFKDSHQEVTGLTVNKKVNVKRFYYRQTRAMAHRLYKTGEFEIDGKRGTVDQLEGRFSFMYEVASYGSTKKNYCYKEYKKFIFYKYLYMNDKPVVITEGKTDIIYLKAALKNLYEDYPSLISKQTDGTFKFKITFLNRKSERLKKLLNLQKDGADGIRTFINEHFLCKNPTAKYFKNIDGPLSKNAVICIFDNEIEDQDKPLRHVWNGFKKDSKRKEALKNNQNTHWVDNVYILTNPLVSGKKICEIEDLFDEQTLNQQIMGKKFDRSEENHKHFFSMFINKNYNDIDFTQFKPMLDNLDKIIYDYGNSMDKCQ

SEQ ID NO: 1266 - protein, 568 aa, unidentified
  source 1..568: note = Related to JACVVC010000001.1; note = Enterococcus sp.
MGKLNEINNRSDFANLINVPIQKLTFILYKKKVENLYSSFSIPKKSGGYRRIYSPHEDLLDIQKKIARLLATQKNVFQEENRIKLNISHGFEKNKSIITNAKIHRNKRFVFNVDLENFFESFHFGRVKGYFEKNKNFQLPTEVAVILAQLCCYQGVLPQGAPTSPIITNLICNILDLRLLKLAKKYRLDYTRYADDLTFSTNDRHFLDLKSAFYYELNGEIKKAGFKLNEKKSNFQYKDSRQMVTGLVVNKMINVDRNFYKETRAMAHRLYQTGSFTIDNEEADIKQLEGRFAFINQIQWYNNRIDNEKHNFRSLNTKEKQYQALLFYKYFFANNKPLIITEGKTDIKYLKSALKKYYNEYPELVTKDEKNNYDFKISFLRRSKRLRYFFDLSLDGADTLTDFYKRFMSNSYPEKGAINYLMHFKKMSENKPKNPVIWIFDNEIANKDKPICKFINGVKLTEYKKECLKSSQQTLLHDNLFLLTNPLSNGAEECEIEDLFSEDVLKKEINGKTFCRDKKVDPEKYYGKEIFSNFIVNEYERIDFENFKPMLDNLTLIVRNYRSDSVIP

SEQ ID NO: 1267 - protein, 560 aa, unidentified
  source 1..560: note = Related to QPVP01000009.1; note = Enterococcus faecium
MIKLKNVKNRKEFAEFIGVPLQKLTYVLYIAKIDNLYTSFQIPKRSGGVRTINAPQKDLLDMQKKLAKLLATHKSIVQEENHIKLNISHGFEKNRSIITNAKIHRNKRFVFNVDIENFFDSFHFGRVKGYFEKNNNFELPSEVATIIAQLCCYKGVLPQGAPTSPIITNLICNILDIRLLKLGKKHNLDYSRYADDLTFSTNDRLFLISESLFYDELTKEIESAGFKLNEQKSRLQFKDSRQTVTGLVVNEKINVDRRYYKETRAMANKLYKTGIFEINNQSATIKQLEGRLTFINNIQRYNNSIDGKKHDPWSLNSKEKQYRAFLFYKYFFANEKPLIVTEGKTDVKYLKAALKKYWELYPNLISKDSKGDFSFKVSFLNRTKRLSYFFGINRDGADALKNLYNFFTSSSQNNPPNYLYYFKKISNRNPANPVIMIFDNELVNKKKPLSKFANHCKLNEDSRNNLQTQLYIRLQDNLFLMTNPLVEGKEECEIEDLFGEDVLNTKISGKIFSREKKADPKEHYGKEIFSNFITNEYEKIDFENFKPMLDNLSRIVENYK

SEQ ID NO: 1268 - protein, 560 aa, unidentified
  source 1..560: note = Related to NZ_CP042833.1; note = Enterococcus faecium
MENLKKAKNRKDFAELINVPLHKLTYVLYKAKVENLYTSFQIPKRSGGVRTIHAPHQDLRDIQKKLADLLVKYKNIIQATNNMKLNISHGFEKNKSIITNARIHRNKRFVFNVDLENFFESFHFGRVKGFFEKNEHFMLPSEIAVIIAQICCYNRKLPQGAPTSPVITNLICNILDIRILKLAKKYKLDYSRYADDLSFSTNDKNFLNSKDDFYNELVKEIIKAGFRVNDKKSRLLFKDSRQVVTGLVVNEKINVNRMYYKETRAMVNSLYTTGSFEINSKIANIKQLEGRLSFINHIERYNNNIDKNNHDFRKLSSKEKQYRSFIFYKYFFANETPVVITEGKTDIKYLKAALKKHYKEYPALVLKESDGTFSYKVTFLRRTKRLQYLFGLFRDGAPALKNLYNFFSPISNKDFPNYLDYFKKISNSNPKNPVIMIFDNELANKTKPLANFANHCKLDEGTRSILKEKYQVKLQDNLFLMTNPLVENKAECEIEDLFHDAVLKTIIGGKIFSREKNADPNKYYGKEIFSNYIMRNYSNIDFSNFKPMLENLNEIVGRYK

SEQ ID NO: 1269 - protein, 562 aa, unidentified
  source 1..562: note = Related to NZ_MCRG01000029.1; note = Enterococcus mundtii
MVKINEVTNRDEIAYALGIPKKKLTYILYVKRTENLYYSFEIPKKNGGFRRINAPDKDLRDIQKSLADILVKYQKAIWDRKNIKPYISHGYEKDKGIMTNAEVHKNKRFVFNVDLKDFFDCFHFGRVRGFFEKNKDFCLPIEVATIIAQLTCYNGVLPQGAPTSPVITNLICNIFDMRVMKVAKKYKLNYTRYVDDLTFSTNDKNFFLNKELFFENLIIEVENAGFKINDKKTRLQFKDSRQTVTGLVVNKKINVDRRFYKDTRAMLDSLFRNGSFEIDGYLGDIKQLEGRLSFINQIEWHNNLKDNSKHNVYNLSSKEKQYQAFLFYKYFFSNKKPILVTEGKTDIKYIKAALKKYYLDYPDLIIKNEKQEFEFKITFLKRTKRLQYFFNLYKDGADAMLHIYNYFYDVNNDKFTNYVNFFTARCKRKPANPTIFIFDNEINVKGKPLKKFVDNVSLNALKVSKLLEDNYVDIAGSAYILVNPIIDRSKNESEIEDLFTPELLSHKINGKTFCRDKSFNSNKHYSKEIFANHVVKNYRSIDFTNFKPMLDNLDKIIKNYNK

SEQ ID NO: 1270 - protein, 560 aa, unidentified
  source 1..560: note = Related to JAKNTG010000011.1; note = Enterococcus hirae
MEINEIKNRTELAWKLGIPKKKLTYVLYIKGTDQLYTTFEIPKKSGGVRKIHAPEKDLKEIQKNLANILVDYQSEMWKKRKIKPNISHGFEKNKGIMTNAEVHKNKRFVFNIDLENFFESFHFGRVRGFFEKNKYFELPLEVATIIAQLTCYKGTLPQGSPCSPIITNLICNIFDMRIMKLAKRYRLNYSRYVDDLTFSTNDKRFIDDKEYFFEELSGEVEKAGFKINENKTNLRYKDSKQIVTGLVVNKKINVDRCYYKKTRAMLNSLYKTDTFEIEGSTGTVKQIEGRLSFINQIDWHNNQIDSNKHGFRNLSAREKQYQAFLFYKYFFINDKPIVITEGKTDIKYIQAALKKYYLNYPDLIVKNDEHKFEYKIMFLKRTKRLNYFFGLNQDGADAMQNLYHYFYDYNNNITANYMKYFKDISKKLPRNPTIFLFDNELAGGEKPVRKFVKHISLDKAQYTKLEKEEYARLHESAYLLVNPLVDSKKECEIEDLFLPETLEHKINNKTFCRDKSFKSDVHYGKEIFSNYIMKNYKTINFKNFQPMLNNLSGIISSYKK

SEQ ID NO: 1271 - protein, 418 aa, unidentified
  source 1..418: note = Related to NZ_CP063383.1; note = Listeria monocytogenes
MKTLKNIEDRKDLADYLNIPIKRLTYILYIKRTENLYYSFEIPKKSGGVRNIDAPKSELKALQKKLAASLTKYQEILQKSKRKAPNISHGFEKGKSIISNAKIHRNKKIVYNLDLENFFESFHFGRVRGFFEKNKDFELSTEVATIIAQLSCFNGALPQGAPSSPIITNFICRIMDMRILKLAKNYKLDYTRYADDLTFSTNDKKFIDQIDYFLHKLTKEIEKAGFKLNKNKTNLNFKDSRQLVTGLVVNKKINVDRRYYKETRAMAHRLYKTGEFQIDDKNGTLNQLEGRFSFINQVQRYNNVIDSSKHDFNNLNAFEKQYQAFLFYKYFYANNKPHIVTEGKTDINYIKAALKKHHLEFPNLIVKKEDGEFDFRVAFLKRTNRLAYFLNIKKDGADTMKNICKYFLILKIMRSPII

SEQ ID NO: 1272 - protein, 566 aa, unidentified
  source 1..566: note = Related to RKEI01000021.1; note = Clostridiales bacterium
MRKFCDAETRNEFADFLKISRSQLSYVLFVKHPHSYYKTFEIPKKSGGTRVINAPYGELKFIQEQLNKRLAEYQKYIWEVKGVRPAISHGFEKGKSIITNAKIHRNKRYVVNLDIENFFGTFHFGRIVGFFEKNRYFRLPHEVAITIAQITCYNGTLPQGAPSSPIITNYICQVLDRRLLLLAREYRLDYTRYADDITFSTNDIHFTDKYRAFLDAVDTEIQRAGFRINSKKTRLLFESSRQEVTGLTVNKKINSNKQFRKETRAMAHHMYANGEFSIAGDSGTLEQLEGRFSFIDQIEHYNNSLSGNKKNYHNLSGCEREYQKFLFYKYFFANQRPLILTEGKTDVRYLKAALRNLYNEYPTLIKKNEDGSFQFEVSFFKRSRRWEYFFGLSSDGADTLGNICQCYFSKRNTGLPQVFDYMKNISGRQPQHPVIFLLDNEMKSDKPLKKFLQKQRITDEKRRQLVARLYIQIMDGTNLFLVTNPLANGDEESAIEILFPEEVLLHEIDGKKFSLENDYDTATYYGKELFSKYIEANYESLDFSGFRPLLNALAAAVETYRLSCNT

SEQ ID NO: 1273 - protein, 380 aa, unidentified
  source 1..380: note = Related to JAFXUW010000045.1; note = Oscillospiraceae bacterium
MNPFSFVRSRADVADAIGIQLKSLTYILFVKRIENCYSTFLIPKKSGGNRTICSPCDELKLIQKKLADALWEQQQDIWKKANIHPNLSHGFEKGKSIFSNAKNHVNRRFVLNIDLENFFDTFHFGRVCGFFEKNRYFMLPHEAAVTIAQIACYNGKLPQGSPCSPIITNMICQALDIRLLQVAKKYKLDYTRYADDLTFSTNNRHFLDCYERFYKSLLREIQHMGFSVNETKTRLLYRNSRQTVTGLTVNQKININCDYYKATRAMAHSLYQKNEFQINGSPATINQLEGRFAFIDQIDHFNNRKDTFPHNARNLNRREREYQAFLYYKYFFTNDRVLIFTEGKTDVLYLKAALMALYTEYPNLVQRDEAGKFLFNVSFF

SEQ ID NO: 1274 - protein, 548 aa, unidentified
  source 1..548: note = Related to NZ_LIWN01000009.1; note = Campylobacter mucosalis
MENFNDLKTIKEFAKFIDTPLQKITYIIHRQKIENLYNSFEIPKKNGGIRTIDAPHDDLKQIQIKIKNMLWKHQKKIWEKYNQNKIPNISHGFESGKTFITNATVHKNKRFVLNIDLLDFFYFFHFGRVKGFFEKNKYFKVPSEIAITIARLACYQQRLPQGSPCSPIITNLICNILDIRLLKLGKKYKLDYTRYADDLTFSTNNKIFPKHYDEFLFEITSVIEKAGFKINDKKTRLLYKNSKQEVTGLVVNKKLNVSNDYYKTTRAMANTLYKDGSFTINGADGTINQLEGRFAFIDRLSKHNNKLDTNKHDFWHLSGREKEYQKFLFFKYFLQNTKPLIITEGKTDIVYIKSALKNLYKNYPRLIIKEGNNFKFHISFLNKTKRLSYFLNINIDGGSVMSNIYKNMYNNENSLAKLFKDKYKTEAKNNVILLVDNEQKNENKPLRQLLNSAKINLNQNISSHITHNLYLLTHQLVDNKKECEIENLFTNETLGTKLNNKSLNLKEKDFNKEIHYGKEIFSQYVRKNYKHIDFSNFKPLLDELNNLL

SEQ ID NO: 1275 - protein, 568 aa, unidentified
  source 1..568: note = Related to RBJN01000156.1; note = Campylobacter sp.
MLSLKDVKTRKDFAVFLGIELKLLTYILYHIKVENLYTTFEIPKKNGGTRIINAPDKKILKKIQNRLMNKLYNYQNKIKKDENIKINISHGFEKGKSIITNARIHRNKRFVLNIDLKDFFASFHFGRVVGFFEKNINFRIPKDIAIIIAQLCCYKGSLPQGAPTSPIISNIICNIFDMRILKLAKKYKLDYTRYADDLTFSTNNKDFLNIYNEFLLCISKEVEKAGFCINQKKTRLFYKDSRQEVTGLVVNKKISINHSYCKYTRAMANSLYKNKSFNIDGKDATMNQLEGRFAFINQIDRYNNIININDNKHNDGKKSNDKKLNCREKEYQKFIFYKYFFANQKPLIITEGKTDILYLKSAIKSLYAYFPDLIKKNSNDEFEFKVSFLRRTKRLEYFLNFVKDGADSIQNIYRFFVGREVVNYSEYFKKITKDIAANPVILIFDNEIPNNKKPVRKFINFTNKKEFENILEKKLYANIVDNLFIITNQLVRDKKECEIEDLFNDKTLNHKIDGKVFCRDSAIFDKQKHYSKEIFSKYISKNYKDKDIDFINFKPMLKNIVEIITNYK

SEQ ID NO: 1276 - protein, 502 aa, unidentified
  source 1..502: note = Related to NZ_CP060707.1; note = Campylobacter concisus
MQKSIVFKILDHIRETEKDKYIKTNISHAFEKGKSIITNAKIHRNKKFILNIDLKDFFDSFHFGRVAGYFEKNRELKFSRETSILLAKIFCCDGKLPQGAPSSPIISNLICNIFDMRILKLAKKFKLDYTRYADDLSFSTNDKNFIKFYDDFMTKLNNEVKRAGFNINDKKTRLLYKDSRQEVTGLIVNKKISIKREYVKSTRAMANTLYNNGSFHINEKEANLNQLEGRFNFIDQIDRYNNKIQKTNKNHRMLNSREKEYQKFLFYKYFYANNKPLILTEGKTDILYIKAALKNLYSEYPKLIEKVNNKFNFKISFLERSSRLEYFFGITKDGADSLINIYNYYSGEDVKLNLLNFFEKKETKSCKPAILLYDNELHKINGIEKPLSKFIRKSVKENQDNFKKIIQKNLYNKLLGNLYLATIPIVDTNKQEAEIEDLLNKEVLEHKINNRSFSKDPKNGNEYGKNELSKYVFKNYSNINFQNFKKLLDTLQNIIEEYEIKI

SEQ ID NO: 1277 - protein, 556 aa, unidentified
  source 1..556: note = Related to JAFRHU010000008.1; note = Clostridia bacterium
MISIDQVETRDELADLLHIRHNLLTYVLYIAKPDSYYQTFYIPKKNGESREIQAPRRELKRIQKRLALELSVYQQSMYKTFDINTNIAHAFRKGRSIITNAKIHKNKRYIVNIDLKDFFHSIHFGRVKGFFEKNTFYQLPSTIATIIAQLTCYNGRLPQGAPSSPVITNLICQVLDYHVLRIAKKYRLDYTRYADDMTFSTNMTEFWNERETFLSDLTREIDRNGFRINDAKTRFIKRESKQTVTGLTVNKKINADRIYYKETRAMADRLYKTGSFNINGKPGTISMLEGRFSFIDQITKFNNKKDGKTHDIRTLCARERDYQKFLFYKYFYANERPLIITEGKTDIIYIKSALKKLYDVYPQLIKKNSDGSFCYKISFFHRTPRMKYFFNISMDGADTITKIHLFYSGNNKMPNYYQELSTNQKMKNAVIFLFDNETKSDRPLKKFIGYCKLDDAQKEELQEQCFTRLIDGSELYLATVPLVEGDDESEIEDLFPKAVKDIRIEGKMFYRKNDFNPKIHYGKEVFSKYIYNNYDAIDFSGFIPLLDAIVKAIKTK

SEQ ID NO: 1278 - protein, 554 aa, unidentified
  source 1..554: note = Clostridia bacterium; note = Related to JAFWMS010000015.1
MKLINDISTRYELADLLHIRLRPLAYVLYISKPNSYYRTFYIPKKNGDLREIQAPCGKLKYIQQRLMAELNNYQDYLSKTQGIKTNIAHAFIKKKSIISNASIHKNKRIVINVDLKDFFHTIHFGRIKGFFEKNHFYQLPSDIATMIAQITCYNGHLPQGAPSSPVITNLICQVLDYNILRIAKKHRLDYTRYADDLTFSTNKGDFMDNYQSFMTELSKEIERNGFIINENKTRLVRRESKQTVTGLTVNKKINVDRSFYKLTRAMADCLYKTGSFDIDGEPGTINMLEGRFSFIDQIVHYNNINDGKKHDYRSLCAREREYQKFLFYKYFYANERPLIITEGKTDVLHLKAALRKLYLQYPDLIQKKQDGSFEYKISFFRRTKRMKYFFNISPDGADTMKSIYQFYTGRNNVPNYFQTLSARNMENAVIFLFDNETCSERPLKKFMDWAKLQTAQRTELKSKLYAQLIDDSKLYLATTPLLAEKKETEIEDLYPESVQNIKLSGKEFCRASVFDSERYYGKDIFSKYVYNHYDSIDFSGFVPLLDAIRNAIQS

SEQ ID NO: 1279 - protein, 553 aa, unidentified
  source 1..553: note = Related to JAFZIH010000156.1; note = Clostridia bacterium
MIDIVETRDDLADLLNIRHSLLTYILYVAKPDSYYETFSIPKKNGDLREIEAPQRELKRLQKRLANELTAYQHYMYKQFEIKTNIAHAFIKGRSIITNARIHKNKKYIINIDLKDFFHTIHFGRVKGFFEKNEYYKLPSDVATIIAQLTCYQGRLPQGAPTSPVISNLICQIFDYRVLGIAKKYRLDYTRYADDLTFSTNRSEFWNEYQAFLSELAKEIKKNGFAINDAKTRIVKQESKQTVTGLTVNKKINVDRTFYRNTKAMTNCLYKIGSFTIDGQPGTLNMLEGRYSFIDQITRYNNKIEGKKPESRKLNAREKDYQKFLFYKYFFANERPLIVTEGKTDILYIKAALKKLYRKYPQLVIRNANGNFEYRVSFFRRTSRIRYFFQISQDGADAITTIYQLYAGKDDERNYYKKIANQTMRNAVIFLFDNETQNKKPLKKFIDVAKLNDTQKDNLRTKLYTRLLDNSKLFLATTPLPAGNRKSEIEDLFTEATRNTIIGGKRFSANDQHDTAQFYGKKIFSEFIYDHYDAIDFSGFIPLIDAINNAIQSK

SEQ ID NO: 1280 - protein, 422 aa, unidentified
  source 1..422: note = Related to JAGFBC010000073.1; note = Schleiferilactobacillus harbinensis
MEIQGLQSRRQIAELLGVPLKELTYILYVQKPETFYRLFEIPKKNGGFRKIDAPEGPLIYIQRMLARRLTAWILEKKLNTSVSHAFKKGRSIITNARAHRNRRFVLSVDFRDFFNNIHFGRIEGFFRKNKYFGFSREAAIVIAQLTCYHGSLPQDAPTSRVLSNLICQIMDRRILELASKYRVHYSRYADDLTFSTNWANFGNESKNFLSELTVVIGQSGFQINESKTRLQYKDSRQEVTELIVNDKVGVPKRFVKNTRAMANTLYKTGQFEINGKQGSINQLEGRFTFINQIDWYNHRVIDGVEPTHSSTRARLMKLNSRERQYRQFLVYKYFISNSQPLIVTEGKTDIPYIKSALRSLNQQFPDLVTFNDEGEYSLKISFFEQGIRLDHGRSGNKKNQRLPYFLGLKMDGADELQHIYDY

SEQ ID NO: 1281 - protein, 584 aa, unidentified
  source 1..584: note = Related to JAHADJ010000026.1; note = Dialister sp.
MEKFSDIITRKQLAQFLEVKLSQLTYILYKQGIDSNYHSFSILKRDGGFRRIDAPKNVLLKIQMSLVNRLWEVQESIWENKGYRSKTAHAFIKGRGIITNAKIHRKKRFVINLDLENFFGSIHFGRVKGFFQKNKYFNMLPEIATIIAQLTCYKGCLPQGAPSSPIISNLICQILDLRLRKIAKKYRLDYTRYADDLTFSTNADFISVEKDFFSEIKVEIERAGFHMNDRKTRIQDYHHRQNVTGLVVNEKLNVNSDYCRQTRAMAHNLYTKGTFTIGSIEGTMDQIEGRFSFINQLDWYNNQANNKANKKKNNFLGRVDAFNKREKEYMKFLFYKYFWQNKKPLIITEGKTDVRYLKSALKSLSLEYPELVNVEDDGGVKFLVSFLNKTRRLEYFLGINRDGGDTLTNLYSNYFDIKRNEREAGTNGRNNKSKFGYIEYFKKYSSTERKAPIILFFDNELSIRNKPLNKFSVKLNSEEKNRLKTNGYIQLNSDMKLFVMTMKLAENQTSCEIEDLFDERTLCHEDAKGRSFSREDRPDLNEFYGKDYFSKYVCSNYKQINFEKFKEVFNTIRSIMDECNYQEE

SEQ ID NO: 1282 - protein, 1009 aa, unidentified
  source 1..1009: note = Related to SCPI01000001.1; note = Dialister invisus
MNKFCEIGTRKEFAEFIGVSLKKLTYLLYVKHVDNYYHSFEIPKRSGGSRQIDAPIGDLKKIQYSLADKLWEHQKIVWRENNIYPKVSHAFIKGKSIITNAKVHRNRRFVINLDLEDFFGGFHFGRVRGFFQKNRYFSLPIEIATIISQLTCYKGHLPQGAPTSPIITNFLCQTLDYRLIKLSKKYGLNYTRYADDLTFSTNRNFVDIQGNVLLEIEQEVGKFGFHLNRKKTRIQFNDSRQVVTGLVVNKKINVDRNYYRETRAMADKLYKTGCFSINDSYGDIKQLEGRFSYINQLNWYNNQLDDEKHNLYSLKGREKQYQKFLFYKYFWGNEKPLIITEGKTDIIYLKSALKKLYKQYPNLVNKKDDVFQFNLSFLNRTKRLKYFFGIEKDGADTMAGVYNKFWSSDKNKNTIDYINYFRTYAKQKTNKPIILLFDNEFKKGKPLYKFAESTGLKNRIQGMLKDKKRRLLYIKLREDYNLFLLTMKLPEGKEECEIEDLFDEKTLGHEDKNGKNFSRGSKFDNSKYYGKACFSQYILQNYQNINFDKFQNMLESIQQIVSGYRVAIRDLGVHGEGIGSVDGFTIFVPGALPGETVTAEITLLKKSYALGELLSIEWESPFRVVPKCPVYENCGGCQLSHLTYEGQLDMKYRRVKDVIERIAGESGDLVRPVLPAAHPFAYRNKMAVPAGLVKGKAALGCYRQGSHDIIPVSSCAIQKEENNRLLQFARRFIEKYRISVYNEKTRKGNLRHVMGRVGDDGKVMAVLVTASETLPEEKRWIEEIKKELPEVVSLWHNIQPKPGNTILGAKIRHLWGRETLTASLCGLRFEVSPYSFFQVHKEQAEVLYEKALEYADLKGGETVIDAYCGTGTISLCLAKKAKRVIGIEIVKPAIEDAKKNAKKNHMENTEFYAADAGKLMPQLYRKGLVPDVIVMDPVRAGCSGEVLKAAAGMKPKRIVYVSCNPATFARDAKILKSEGYEIKKVQPVDMFPQTMHVETVALMIRGKSK

SEQ ID NO: 1283 - protein, 566 aa, unidentified
  source 1..566: note = Related to CP016202.1; note = Eubacterium minutum
MEYTKIKNRRDLSLALGVPPSELTYVLYKKGVDQYYSSFLIPKKSGGNREIDASKGALKYIQRRLVGLLWERQNTVWSEETILPNIAHAFQKKKSIMTNANVHKNKRYVVNLDLENFFGSIHFGRVKGFFAKNRYFCVGEEVATVIAQLVCYKGRLLQGAPSSPIITNLICGILDIRLLKLAKKYRLDYTRYADDMTFSTNSVTAEDYLNDFIADLAIEVEHAGFKINERKTRVIYRNSRQEVTGLVVNKRISVKRDYYKLTRAMAANLYKENEFTIGGTRGTITQLEGRFAFINQIDKWNRKMGVLSKELTSREEQYKKFLVYKYFFATERPVIITEGKTDVQYLKAALKANAEKYPDLVSKTDNDKFKFKISFFNRTKRIKHFFGSAEDGADAIKPFVLMYGSSKDAMIEWFKQFTGNNPCKPVILIFDNEDSKEKPLSKMIGTLLNDKVLRNKRKANDMRCELNEHGKMHVKDNLFFATTPKNANKDCEIENLFNKNELDGIRINGRTYHEGFEKSAGWDPAKHFSKNVLSLYVLKDYKNINFEGFIPLLDAINSIVKNDDHY

SEQ ID NO: 1284 - protein, 559 aa, Staphylococcus sp.
  source 1..559: note = Related to CP009676.1; note = Staphylococcus schleiferi
MNLNKINDLKDLASYIGVKPSYLAYHIYHNPRIKLNQHYTEFEISKSSGGSRIIATPNKNLKIIQKKLAFKLNQHLKSLGFYRNNKILHAFIKENKPYQRGFISNSKIHRKKNYILNVDLENFFESIHFGRVRGYFQKDDKFNFNKDVATIIAQICTYKGSLPQGAPTSPIISNLIGNLLDSKILKLSKKYKLHYTRYADDMTFSTNDYKFVRNINQFNKELENIISSAGFKINTSKTRLQYRTSRQQVTGIVVNEKLNIPREYYKKTRAMAHNLYKNDEFEINGEKSTLNQLEGRFSFINQLEWYNNKNNKNKKKPYLKLSSKETEYQRFIFYKYFIKNDLATIITEGKTDVLYIKAALKKTWKEYPKLITKDNNGNFLFKIKFLNKTKRLNYFLGIGIDGGDSLINVYNHYKGKDNVNDLRKYFNKFNCNYSNPIIMLLDNEIDVKGKPLNKMINIIKFEKDELERNLYVNLVENLYLSTIPKTKEKNESEIEDLFNEETLNKGIEGRPFTKKDNYNKKEYCGKDEFSKYVYNNYTNIDFKKFHPLLKALSEIVNKK

SEQ ID NO: 1285 - protein, 558 aa, Staphylococcus sp.
  source 1..558: note = Related to CP022056.2; note = Staphylococcus saprophyticus
MNFNQINDRKDLAKFLGVKPSFLTYHIYHNPQIKLNQHYTEFEIPKRSGGIRVIAAPNKKLKIIQKKLAFQLNEHLISLGFYRKNKSIHAFIKENKSNKRGIISNSKIHRNKKYVFNIDLENFFESIHFGRVKGYFQNDDKFNLSKDIAIILAQICTYKGSLPQGAPTSPIISNLIGNILDSKILKLTKKYKLHYTRYADDMTFSTNDYKFLENMAGFNRELENIIELSGFKINTSKTRLQYRTSRQQVTGLVVNDKVNIPRDYYKKTRAMANNLYKNGKFEIEGKEATLNQLEGRFSFINQLEWYNNKKFKNKKKPHMKLSGKEIEYQRFIFYKYFIKNEFLVIITEGKTDPLYIKAALKKYWKSYPQFIMKDSDGHFLFKIKFLNKTKRLNYFFGINKDGADSLINLYNHYKGSNGVNNLSDYFKKFNCKYSNPLIMLFDNELNIKGKPLKKFHNHIQFNEPELQNNLYVNLVENLYIVTTPLIDKKKESEIEDLLPQKILDEGIEGRSFTNQENYNKNKHCGKDEFSKYIYNNYNEINFENFIPLLDALCKICND

SEQ ID NO: 1286 - protein, 558 aa, unidentified
  source 1..558: note = Related to NZ_JACSMB010000004.1; note = Exiguobacterium sp.
MTNFKDIKTRNELAEFIGIPIRHLTNVLYKINVDNMYSSFKIPKKSGGERVIQSPNKDLKNIQVKIAQSLDVHITKQQKYDNNISHAFKKNKGIITNSKVHRNKRIVVNMDLENFFESIHFGRVRGYFNKNDMFKLPIEVATILAQLTCYKGSLPQGGSTSPIISNLICEVLDYRILSLAKKYKLKYTRYADDLTFSTNNNEFVNLYSQFSDEISKVILKSGFRINQKKTRLQFWNSRQTVTGLVVNKKINVPREYYKNTRAMANQLYKTGEYVIDGDLGTIGRLEGRFTFIDQLTKYNNSLDDDIKHNRFHLSGREVEYQKFLFYKYFFSNSKPLLITEGKTDVRYLKAALKKHSLEYPELVEKDTNDNFNFKITFLKKTKRMKYFFGIVPDGASALNNVYNFYKGVNLDPNHYEHFMKISENRPTNPVVLLFDNEITKEKPLNKFINHAKINNKKSIIKQNLTLNVIGNLHLLTTPLMDNRLEGDIEDLFKTSELAIVIKGRKFDKTEKLDKSLYYGKDQFSKYVLLNYEEIDFDNFKPLLDKLSDLIRNHSVASK

SEQ ID NO: 1287 - protein, 557 aa, unidentified
  source 1..557: note = Clostridia bacterium; note = Related to JAFPWD010000023.1
MKKFNEIQSRNDFADLLKIPLSSLTYLLYVLKPDNCYNVFSIPKRSGGEREISAPNKRLKSVQTAVAMELWRYIKNIPDFNRSAVSHAFTKKKGIITNAAIHRNKRIVVSFDLNDFFPSIHFGRVVGFFEKNRHFKLPHAVSLIIAQIACHNGSLPQGSPCSPIISNLICQILDYRILRLAKKYKLDYTRYADDLTFSTNWKGFVDAETCFYSDLSVLISKAGFTINEAKTRTVFRNSRQTVTGIVVNKKLNINREYYKETKAMAHNLYSKGSFVINGKEGTINQLEGRFAFIDQIELYNNRIDGNRHNYRNLCGRELEYRKFLFYKYFYAADKPTLITEGKSDELYIKAALRKMFLMYPSLINKKADGRFEYKVRFLKRSKRLQYFFGFSPTGADAMTELRKCFIDESNSTSLFSFFNRICASGQIHPVIFIFDNETERDKPLKKFLNQKPATSEVDKEFLQNNLYLNIIKGSKLFIITNKLVSGKSEAEIEDLFSENTLSTEIGGKSFCRKDNFDESKFYGKAFFSKYIYKNYESIDFSNFIPMLDALNNIITTY

SEQ ID NO: 1288 - protein, 560 aa, unidentified
  source 1..560: note = Related to JAFVFJ010000126.1; note = Eubacterium sp.
MEQGFNTISNRNELADYLGISRSSLTYVLYVKGIDSFYVSFDVPKKSGGTRTIHAPQGTLKGIQKILLIKLYNYRYTINENENIKLNISHAFENKKSIITNARIHKNKRFIINFDLKDFFESFHFGRVKGYFEKNKYFCMPEDVARIIAQLTCYSGTLPQGAPTSPIITNLICQSLDYKILSLAKKHHLDYTRYADDLTFSTNDKKILENYDTFYKSLVNIIHGSGFEINEKKTRFVYKHSKQIVTGLVVNKKVNVDSTYYRNVRSMAHHLYTEGTFWDNGNECTINQLEGKLSFINQIDKYNNKLCEEKKNLANLNRREREYQRFLFYKNFYGNPQPVIITEGKTDILYIKAALRKYYLDYPELIEKSNSGQFHYKLTFFRRSSIKQFFFGMSYDGADAIKKIYNFFTDNDSGRFPNYYEKFNQISAIKTSSPIILLFDNELNNKNKPIKNFCNYVGLKPETVDCIKNGGFIPIVDNKLFLLTHQLVNDLAECEIEDLFDEITLNHTINGKTFSRQSDFDIDKHYGKEIFSKYIISHYESIDFSNFKPLLNSINQLIAH

SEQ ID NO: 1289 - protein, 480 aa, unidentified
  source 1..480: note = Related to CP033618.1; note = Lactiplantibacillus plantarum
MKKSPFYQISTRQELADALNMRLKSLSYVLYKLDPQSLYTIFSISKKSGGKREITAPKKPLANIQSKIANVLMLQPENSALRSKASHGFIKNKSILTNATVHRNKNYVLNTDIQDFFPSFSFGRVLGFFKKNNAFMMDHKVAVALTNLCCYKKKLPQGAPSSPPITNLIFHIVDFKIIKLARKYNLDYTRYVDDLTFSTNEKSFPKVSQNFLNELNALITHEGFKLNEDKTHLEYKNSRQEVTGVIVNKKLNVHKEFYKNTRAMADNLYKNTEFTIDGKLGTINQLDGRFNYINQLVRYNKKSIKRKVAYKTKYNVEKKDFKHQSRFILFSGKEQQYRKFLFYEYFIYGNSSIILTEGKTDVSYIKLALRVYKQEYPQLITSHGKKTEYSVSFLKHTQNTSTKGQKKGKKNNQMSHRIPYFIGISEDGGTSIDNFLNYYSEISTTNLNMYPNYPKYFISDLGKLPDKKVIILLDKADCKI

SEQ ID NO: 1290 - protein, 372 aa, Streptococcus sp.
  source 1..372: note = Related to WTXU01000099.1; note = Streptococcus thermophilus
MEKSPFYQISTRRELASVLNMQLKALSYVLYKLNPQNLYTSFSIPKKSGGVRNIVAPQKPLANIQNKIANVLMLQPENKASGSKASHGFIKNKSILTNAKVHRNKKYVLNTDIQDFFPSFSFGRVLGFFEKNNAFMMDHKIAVALTNLCCYKQKLPQGAPSSPPITNLIFHIVDFKIIKLARKYKLTYTRYVDDLTFSTNNHSFLKTYHDFLTELNALITHEGFNLNNNKTHLEFKNSRQEVTGIIVNKKLNVHKEFYRKTRAMADNLYKNNKFVVDNAEGRIQQLDGRFNYINQLVRYNKKVKKRGAPYKTKYTHSSESFSKLDRFLSFTGKEQQYRKFLFYKYFVYGDSSIILTEGKTDVSYIKLALKKY

SEQ ID NO: 1291 - protein, 667 aa, unidentified
  source 1..667: note = Related to VHJC01000059.1; note = Lactiplantibacillus plantarum
MEMMMQMNKSAFFKISTRKELANALDIRLKTLTYILYKKKPQTLYTNFSIPKKSGGTRDIVAPEKQLANIQIKIAQILMSQPENDSSHSKASHGFIKNRSILTNAQIHRNKKYVLNTDIKDFFPSFSFGRVLGFFEKNNAFKMEHKVAVALTNLCCYNQSLPQGAPSSPPITNLIFHIIDFRIIKLAKKYHLDYTRYVDDLTFSTNENSFPVTYKKFLIDLNNLIDHAGFSLNQDKTHLAFKNSRQEVTGIIVNEKLNVHNEFYKSTRAMADKLYKTNSFSIDGTLGNIRQLDGRFTYINQLVRYNKQRKLIRYRTKYSTPHNEKETKNTISNKDRYRFFTGKEQQYRKFSFYEYFVYGNNSIILTEGKTDITYIKVALKKYAKNYPDLIKLQGNKYDFLISFLNHQKNKEKRSKNFKRKKTKILANQMSHRIPFFLGISEDGGTTYSDFLYYYAEMTIEKESISYNMQRSYPNYPKYFISDLNKLYKKKVIILLDNEGSNHPLDHFIKTCAKLKIKKKEDIENDFKNKGYSHLKYNLFLLTIPKKNTSNSQNCAIESLLNKDEIEKLNLKGKSFSSKNNETSKNSFGKQALVTKIKSAPTNFDLSGFRSLLDLISKINSLQPIGNEQYKYKKKKVETNKEVYIRNSLGFRIPIEYQSITQYKDFVK

SEQ ID NO: 1292 - protein, 624 aa, unidentified
  source 1..624: note = Related to JXDF01000031.1; note = Apilactobacillus kunkeei
MSDLILFLYSGGIFLFKDVKSVESLSRYIGVSVKLINFVVYFKGVDSFYEEFSLPKKSGGSRFISCPKGPLKKLQKKLQKKLSEEYDNKYGSFNVSQAFIKKRNIMSNAKVHRNKKFILNLDIEDFFDEFNFGRVYGYLQKSNDFKMNKQLSVILSKIFTYKNKLPQGSPSSPVLTNFIFRIVDFKILKLSKKYKLDYTRYADDMTFSTNDSNFKYRYINFVEELKFLLYRQGFKINKKKTRLQFSSSKQEVTGLVVNKKINVSRKYYRDLRAQAFNLYSDGKYFIDGKKFDKLNKLEGRFAFVNQVKRYNFLIESRKYARKSKEYSNFIKSTTKYRYEPYLGGFDEQYRKFLFYKYFIHGSKPLIFVEGKTDIRYIKAAMMMYYNRYPELIRNNNGTFEFNIDFFKRGNEDLLKENYKRNEIDYSIKDYYLGLSDDGASVMSKIVEYWGIALDKKTKENKNYYDYFVNKLGNKSKKVILLFDNEYLDKKNKPLRSFLNHVYGNKATSQYRKLISEGKLVIADNLYLITLIKDKNYKKELENYIDDHINDKNFKGNNDLSIDIENLIDLSTITINQKTFNRNANKDSDKEFGKQTLSKYVYKHYNTVGLSGFIPLLDQLKEFCK

SEQ ID NO: 1293 - protein, 533 aa, unidentified
  source 1..533: note = Related to CP033058.2; note = Metamycoplasma phocicerebrale
MSSKYKGNSSRFFIMKKFEEIKKVEDLAKALNITINKLYYFSNNSNKPNKLYTQFTITKKLGGERTINAPKKELKKALNKLFIILKNRHLNYTKEKKIKDKISFGFKKNNGIIDNAKNHRNKKYVLNVDIKNFFDSFHFGRICGFFMKSKEFKINSKNNDTVKKISILISNLLCYKQCLPQGSPCSPILSNLIFRTIDYEILKLSKKYKLKYTRYADDMTFSTNDNNFLNSYENFISELNECINKNGFKINDKKTQIEFYKSRQRVTGLVVNQKLSVRREFYKNTKSMALNFYRNGYFKINDKIGKLNQLEGRFSFINQIDKFNNIESNKYENKNKDFYYVLNSREKQYKLFLFYKFFYNPSKPIIITEGKTDILYIKAALKKFYEKYPNIIQKNLNGTFSYKVKFLAKENKQFSNYKERLDKNFQQIEIILKDVIENIDDKKLEDIIQYVIDSIEKIKEIFKSKIVANKTSFEKIKLKLNYFWEEIVNKKTSKELNEIWNEIINIYKNIKITNLKKVNKFLYFFKYWFFRGF

SEQ ID NO: 1294 - protein, 594 aa, Streptococcus sp.
  source 1..594: note = Related to JAJEOY010000010.1; note = Streptococcus sanguinis
MDWNEIKSCRDFARYLNIPYKHLTYLLYNRKIDKLYESFEIPKKNGGIRIIQAPKKELKEVQQQILKILEKRALSLEKENKISFRLSHGFIKYKSIITNAEKHRNKKIILNIDIENFFPSFHFGRIVGFFEKNKNFKLPKEVAIFLAQLTTVDGSLPQGSPCSPIITNLICQILDFRISKLAKEYKLNYSRYVDDMTFSTNKENFLDCYPEFFSKLSNVLIKAGFSINDKKTRIHFNRNKQIVTGLVVNKKINVQKNFYKNTRAMAHNLYKQGTFFIDEKEGTINQLLGRFNFIDQLERYNNKNKKQLSLQKNYIEQQKYLTKGQQEIKGDFGYLGKLSSREKEYRKFLYYFHFFSSSKPVIVTEGKTDSRYLKAAMKKCFKDFPNLIQKNEDGTFLFKVKFLKRTSLLKYYFKFYEDGADSMKNLSNFWITGEENKLFPNYNKFFQELTGRVASNPIIFLFDNELSNKKKPIRNFINHILKSTPNEAGSLRNEISNVKYINIVDNLYMLTHASLSGNEDEEIEDLFTNDVLNHRINGKSFSRENDYDFTKFYGKNDFSKYVLKNYRSIDFKNFIPLLNNLNKIILEYNSKLTF

SEQ ID NO: 1295 - protein, 592 aa, Streptococcus sp.
  source 1..592: note = Related to NZ_CZFC01000010.1; note = Streptococcus suis
MQWDEIKTREDFATFIGVPYKYLTYLLYNQRIENLYIAFEIPKKSGGVRIINSPEDRLKKILKKIMRKLEERMVFLEQEGKISSKVAHGFIKSKNIITNASSHRNRKIVLNVDIENFFPSFHFGRVKGFFEKNKYFKVPKEVAVFIAQLTCYNGSLPQGSPCSPIITNLICQILDFRIIELAQKYNLKYTRYADDMTFSTNDMQFVDTYIRFVEELGDLLTRSGFSLNDEKTHIQFQREKQTVTGLTVNKKVNVSRHFYKNTRAMVNTLYKKGEFMIDGERGTINQLFGRFNFIDQLVKYNNRIEREAIIRNDYVNQQKNLIKSVPDAENKFDYLKKLSAREREYRKFLYYYYFFSSTVPVIVTEGKTDSRYIKAALKNLYRRYPKLIERDEKGKFVFKIKFLRRTALLKYYFRFFEDGADAMKNLSNCWFGKTDEKLFPNYSELFKEITNRKALKPVIFLFDNELKNNKKPIRNFINHVSNNTIHDNKTIENEIRENNIFNVIDNLYLLTHPSETEDEEIEDLFDDPTLDYRIAGKVFTKESKFDVDKYYGKNDFSNYILQNYSQINFKNFTPLLDNLNKIVDVYEAKYKS

SEQ ID NO: 1296 - protein, 655 aa, Streptococcus sp.
  source 1..655: note = Related to NZ_AP024276.1; note = Streptococcus parasuis
MNRLKQVTNKDDFAKLLGFKNSRYINYVLYCIGTDKLYKEFEIPKKNGGVRIICAPKPELKLLQKKLAYVLWDCFVDDLSSKSKEKNYKIPMLSHAFEKNKSIITNAQAHRNKKYILNVDLKDYFETFNFGRVRGFFIKDKDFQVSPEVATVIAQIACYQGKLPQGAPSSPIITNLITRILDYRIVKIAKKYRFTYTRYADDLTFSTNRKLYSNKLKATKELDKFLEELEKLIVSSGFEINSKKTRLSDAMQRQEVTGLIVNKKLNVKREYIKNTRAMAFKLYKDEKFEIDGKQGTIEQLTGRFAFIFQIDQYNNYLLYKKSLVENSLNSQKNLLGRNLSKKSDSKYYWKYIFYNRDLRKELFYNKQHKTYNLPKEFYAISKEDKKNYMAFFDSKEKEYKKFLFYKYFYGNSNPIIVPEGKTDPRYIKAALKNLYLKYPELIKKSGNKFIFEIDFLKHSNTIEYLFNVPEGGPGFQYWYNYFSDKKDFPMSDKEKLLYPNYIEYFYNQTSAHPKKPTIFLFDNEPSGNPLYAFVNYAKDLEISSSNLNQIRGSSFSKIVKKNSLYIMATPLIKNWNQGTSSDIEDLIVSNDKNIEPIQNFMKINKIDSLNVLDVKKHKEIFSKFVLRNFNKFDFTAFIPLLDGIRDNILDYKMKK

SEQ ID NO: 1297 - protein, 652 aa, Streptococcus sp.
  source 1..652: note = Related to NZ_KB904582.1; note = Streptococcus ovis
MNKLKQLDNKDDFARLLGFKNSSYINYILYNIGTDNLYRVFSIPKKNGEVRPIHAPKPELKFLQKKLVNVLWDCYIDDLTVKSKEKNFKIPMLSHAFEKNKSIITNAQLHRNKQYILNIDLKDYFESFNFGRVRGFFIKDKDFQVAPEVATVITQIACYQGKLPQGAPSSPIITNLITRILDYRIVKIAKKYRFTYTRYADDLTFSTNRNLRSNKLKATKELDKFLEELEELIVSSGFEINSKKTRLSDDMQRQEVTGLIVNKKLNVKREYIKNTRAMAFKLYKDETFEIDGKQGTIEQLTGRFAFIFQIGQYNNYLLYKKSLVENNLEAQKNLLGKKSSKKSDSKYYWKYIFYNRDLRKELFYNKQHKTHNLPEEFYSIGKEEKKMYMALFDSKEKEYKKFLFYKYFYGNSKPIIVTEGKTDPRYIKAALKNLYPQYPELIERDGDKFIFKIDFLKHSNTIEYLFNVPEGGEGFNYWYNYFSNKEDFKMSAKEKLLYPNYIEYFQKLTSRQPKHPTIFLFDNEPTGHPFYQFASYSKDLDISPNNLDTIRNPMVNYRINQKSSLYIMSTPLVKNVNSGSSSDIEDLLIAKQKMPTLYLDGQNKTFKKNGGFNYYGKEILSNYVLKYYQNFDFSEFIPLLNGIRDNILDYRK

SEQ ID NO: 1298 - protein, 645 aa, Streptococcus sp.
  source 1..645: note = Related to NZ_AQYA01000033.1; note = Streptococcus henryi
MNKLKQLESKDDFARLLGFQNSKYINYLLYSVGTDNLYKTFSIPKKGGGERIINAPKKELKFLQRKLANVLWDSYIDSLKLKSKDKKFKIPMLSHAFEKNKSIITNAQVHRNKRYIINIDLKNYFDSFNFGRVRGFFLKDRDFCVTPDIATIIAQIACYQGKLPQGAPSSPIITNLITRILDYRIVKIAKKYRFTYTRYADDMTFSTNRDLYSNKLQATKELEKFLRELNELVISSGFEINSQKTRLSNEMQRQEVTGLVVNKKLSIKREYIKNTRAMAFRLYKDGYFEIDGKLGTIDQLTGRFAFIFQINQVNNYLLYKKSLVKNNLEFQKNLLAQQTLKKSESKYYWKYIFYARDLRKELFYNEKHKTYNLPTEFYDISKNEKRMYMSLFDSKEKEYKKFLFYKYFFGNDKPIIVTEGITDPRYIKAALKSLHQQYPELIEKVDDKFIYKVEFLNHSNTIEYLFNVPEGGEGFKYWYNYFSNKENFPMDSNEKILYPNYIDYFQKLTIRKPKNPTMFLFDNEPTGSPLYNFARYAKDLDINSNNLNQIRQPMLNYRINRKSSLYLMLTPLIMGSNSSDIEDLLLSKNTPPILKGKSFSKGGGSNNYGKDVFSKYVLKKYSQFDFSDFCPLLDKIRDNILDYRK

SEQ ID NO: 1299 - protein, 652 aa, Streptococcus sp.
  source 1..652: note = Related to RQZA01000003.1; note = Streptococcus minor
MNKLKKLDNKDDFARLLGFKNSTYINYILYNIGTDNLYRTFSIPKKNGGTRLVHAPKPELKFLQKKLVNVLWDCYVDDLTAKSKEKNFKIPMLSHAFEKNKSIITNAQVHRNKQYILNIDLKDYFESFNFGRVRGFFIKDKDFQVVPEVATVIAQIACYQGKLPQGAPSSPIITNLITRILDYRIVKIAKKYRFTYTRYADDLTFSTNRNLHSNKLKATKELDKFLEELEELIVSSGFEINSKKTRLSDDMQRQEVTGLIVNKKLNVKREYIKNTRAMAFKLYKDEAFEIDGKQGTIEQLTGRFAFIFQIGQYNNYLLYKKSLVENNLEAQKNLLGRNLSKKSDSKYYWKYIFYNRDLRKELFYNKQHKTHNLPEEFYSIGKEEKKMYMALFDSKEKEYKKFLFYKYFYGNSKPIIVTEGKTDPRYIKAALKNLYPQYPELIERDGDKFIFKIDFLKHSNTIEYLFNVPEGGEGFNYWYNYFSNKEDFKMSAKEKLLYPNYIEYFQKLTSRQPKHPTIFLFDNEPTGYPLYQFASYSKDLDISPNNLDTIRNPMVNYRINQKSSLYIMSTPLVKNVNSGSSSDIEDLLIAKQKMPTLYLDGQNKTFKKNGGFNYYGKEILSIYVLKYYQNFDFSEFIPLLNGIRDNILDYRK

SEQ ID NO: 1300 - protein, 658 aa, Streptococcus sp.
  source 1..658: note = Related to NZ_CP075172.1; note = Streptococcus equinus
MNKLKQLTTKDEFARLLGFKDTKYINYLLYKIRTENLYETFSIPKKNGGERVIHAPKRDLKILQKKLAEVLWDCYVFDLEKKSKNKNVKVPKLSHAFEKNKSIITNAQVHRNKKYVLNLDLKNYFDSFNFGRVRGFFIKDKNFQVVPEIATMIAQIACYDGKLPQGAPSSPIITNLITRILDYRIVKLAKKYRFSYTRYADDLTFSTNRDLSSNKLRSAKILEKFLCELENLIVSSGFEINSQKTRLSDNMQRQEVTGLVVNKKISVKREYIKNTRAMAFKLYKDEEFEIDGKQGTIDQLTGRFAFIFQISQYNNYLLYKKSLIENNFESQKNLLGRNSLKKSESKYYWKYIFYNKDIRKELFYNKQHKTYNLPQEFYSINKIEKEIYMSLFDSREKEYKKFLFYKYFYGNSKPIIVTEGKTDPRYIKAALKNLYRKYPELIEKKGDKFKFKINFLKHSNTIEYLFNVPEGGEGFKYWYNYFSSTMPSNIFKENFPPKSLGQDLYRKMYPNYIEYFQGLTTRKPNYLTIFLFDNEPAGSPLYKFVNHASELQIDTNNLDQIREKNFYRISTKNSLYVMATPLLNKGNSSDIEDLLLARNQLPVLNGKNFSKSGGSNYYGKDVLSKYVLKNFKKFDFTEFIPLLDGIRDNILDYRKNRI

SEQ ID NO: 1301 - protein, 659 aa, Streptococcus sp.
  source 1..659: note = Related to AP010655.1; note = Streptococcus mutans
MNKLKQLSTKDDFAELLGFKNSRFINYLLYSIGTDNLYETFTIPKKNGGERIIHAPKKELKFLQKRLANVLWDCYLYDLKSKSKEKKLKIPMLSHAFEKNKSIITNAQVHRNKKYLLNIDLKDYFDSFNFGRVRGFFVKDKDFQVTSEIATVIAQIACYQGKLPQGAPSSPIITNLITRILDYRIVKIAKKYRFTYTRYADDMTFSTNRELNSNKLRATKELENFLAELERLIISSGFEINPKKTRLSNNMQRQEVTGLVVNKKINVKREYIKNTRAMAFKLYKDGTFEIDGKQGTLEQLTGRFAFIFQTDKYNNYLLYKKSLIENNLDEQKYLLGRNSSKKSESKYYWKYMFYNRDLRDELFYNQKHNTYNLPKGFYSISENEKEVYMTLFNSKEKDYKRFLFYKYFFGNDKPMIITEGKTDPLYIKAALKKMYLNYPELVEKVGNNFVFKIEFLNRSNTIEYLFNIPEGGSGLNYLYNYFSNQIPANFFKQRFPTNNDRKDIYKELYPNYIEFFSNLTLRNPKNSTIFLFDNEPSGNPLFKFVNYAKDLQVESNNLDQIRGTAFKRITKKGSLYIMATPLLPNMNGGNSSDIEDLILSKNTAPILKGKTFLKNGGSNHYGKEIFSKHILKNYKQYDFSDFIPLLDGMRDNILDYRKK

SEQ ID NO: 1302 - protein, 325 aa, Streptococcus sp.
  source 1..325: note = Related to CABHMZ010000033.1; note = Streptococcus constellatus
MNKLKQLETKDDFASLLGFKNSKYINYILYSVGTDNLYKTFSIPKKNGGERIIHAPKEKLKRLQRKLAGVLWDCYLESLKIKSKNKSFKIPAISHAFEKNKSIITNAQIHRNKKYILNIDLKDYFDSFNFGRVRGFFLKDADFKVPEEIATVIAQIACYKGKLPQGAPSSPIITNLISRILDYRIVKIAKKYRFTYTRYADDMTFSTNCELSSNKLQATNELEKFLKELEKVITLSGFKINPQKTRLSNNMQRQEVTGLVVNKKVGVKREYLKNTRAMTFKLYKDEKFEIDGKQGTMEQLTGRFAFILQISQYNNYLLYKINCKI

SEQ ID NO: 1303 - protein, 650 aa, Streptococcus sp.
  source 1..650: note = Related to NCUE01000019.1; note = Streptococcus oralis
MTKLNRLETKTKNDFARLLGFKNARYINYLLYIIKTDNLYNSFTIPKKNGGERVIHAPKKELKFLQKKLADVLWECHLESVESKSKDKNFKTPVLSHAFEKGKSIITNSQMHRNKKYILNIDLKNFFDSFNFGRVRGFFIKDKDFAVSPEIATVIAQIACYQGKLPQGAPSSPIITNLITRILDYRIVKIAKKYRFTYSRYADDMTFSTNRELNSNKLRASKELDNFLTELEEVIVSSGFEINPQKTRLSNNMQRQEVTGLVVNKKINVKREYVKNTRAMAFQLYKDGAFEIDKKTGTLNQLTGRFAFIFQIDQYNNYLLYKKSLIQNNLDSQKYLLGRNSSKKSESKYYWKYIFYNKDLRKKLFDNTKHNTDNLPKEFYSIGKEQKKIYMSLFNSREKEYKKFLFYKYFFGNDKPVIITEGKTDPRYIKAALKKLYQKYPELIEKVRNNFVFKIEFLNRSNTIEYLFNIPEGASGLSFWYSYFSDIKYQTEEAKKLFYPNYMEYFSKFTSRKPKNPTMFLFDNEPSGHPLFEFANHAKDLKDSFKNLDSKRNTSSKKLAKKGSLYIMATPLSPDINYGYSSDIEDLLLSRNSAPTLKGKTFSKDGGANHYGKDIFSKYVLKNYKEFDFTEFIPLLDGIRDNILDYKSLF

SEQ ID NO: 1304 - protein, 685 aa, Streptococcus sp.
  source 1..685: note = Related to JYGT01000002.1; note = Streptococcus infantis
MTKLNRLETKDDFARLLGFKNARYINYLLYIIKTDNLYDSFTIPKKNGGERVIHAPKKELKFLQKKLADVLWECHLESIESKKTLQKRLAAILWECYLKCLNFNYIENNLANVLWECFLKVLEFRPKEKNPVLSHAFEKGKSIITNSQMHRNKKYILNIDLKDFFDSFNFGRVRGFFIKDRDFAVSPEIATVIAQIACYQGKLPQGSPSSPIITNLITRILDYRIVKIAKKYRFTYSRYADDMTFSTNRELNSNKLRASKELDNFLTELEEVIISSGFEINPNKTRLSNNMQRQEVTGLVVNKKINVKREYIKNTRAMAFQLYKDEAFEIDKKPGTINQLTGRFAFIFQIDQYNNYLLYKKSLIQNNLDSQKYLLGRNSSKKSESKYYWKYIFYNKDLRKELFYNKKHNTYNLPKEFYSIGKEEKKMYMSLFNSREKEYKKFLFYKYFFENDKPIIVTEGKTDPRYIKAALKKLYKKYPELIQKVGNNFVFKIEFLNHTNTIEYLFNVPEGGEGFKYWYNYFSDKEGVQMSDNEKVLYLNYIDYFEKLTKKSPKNPTIFLFDNEPSGNPLFKFFNYATDLNVSSNNLGQVRGTSFNRITKKNNLYIMATPLLSTRNNGNSSDIEYLLLSRNPSPILKGKTFSKGGGANHYGKDIFSKYVLKNYKKFDFTEFIPLLDGIRDNILNY

SEQ ID NO: 1305 - protein, 683 aa, Streptococcus sp.
  source 1..683: note = Related to NTGM02000001.1
MTKFNQLQTKDDFAKLLGLKSAKYINYLLYNIKTDNLYNSFPIPKKNGGERVIHAPKKELKFLQKKLSNVLWECYLESIESKSKDKNFKTPVLSHAFEKGKSIITNSQMHRNKKYILNIDLKNFFDSFNFGRVRGFFIKDRDFAVSPEIATVIAQIACYQGKLPQGAPSSPIITNLITRILDYRIVKIAKKYRFTYSRYADDLTFSTNRELNSNKLRASKELENFLTELEDLIISSGFEINPKKTRLSNNMQRQEVTGLVVNKKINVKREYVKNTRAMAFRLYKDGAFEIDKTPGTINQLTGRFAFIFQIEQYNNYLLYKKSLMQNNLDSQKYLLGRNSSRKSESKYYWKYIFYNKDLQKELLHNTKHHTYNLPTEFYSIGKEEKKTYMSLFNSREKEYKKFLFYKYFFGNDKPIIITEGKTDPRYIKAALKNLYQKYPELIEKEGNNFIFKIEFLNRSNTIEYLFNVPEGGEGFKFWYNYFSDKFYYNEKKEKKFFALNSEERILYTNYITYFKQLTNSLPNYPTIFLFDNESNNRNGNDKSALFLFASHAKDLMIPKNKDLEDSKNIKLEEKISDNLEKVRRDKPWRINKKDSLYIMATPLMPHMNDGKSSDIEDLLFSSSQNSLPILKGKEFHKDGGDNHYGKEIFSKYVLKNYKEFDFTEFIPLLDGIRDNILDYKSLF

SEQ ID NO: 1306 - protein, 659 aa, Streptococcus sp.
  source 1..659: note = Related to NZ_CP066059.1; note = Streptococcus oralis
MTKLNQLKTKDDFAKLLGFKNARYINHLLYNITTDNLYEPPIVIPKKNGGERVIHAPQKELKFLQKKLSNVLWECYLESIESKSKDKNFKTPVLSHAFEKGKSIITNSQMHRNKKYILNIDLKNFFDSFNFGRVRGFFIKDRDFAVSPEIATVIAQIACYQGKLPQGAPSSPIITNLITRILDYRIVKIAKKYRFTYSRYADDMTFSTNCELNSNKLRASKELDNFLTELEEVIISSGFEINPKKTRLSNNMQRQEVTGLVVNKKINVKREYVKNTRAMAFQLYKDGAFEIDKKPGTINQLTGRFAFIFQIDQYNNYLLYEKSLIQNNLDSQKYLLGRNSSKKSESKYFWKYIFYNKNLRKELFYNKKHNTYNLPKEFYSISENEKEVYMCLFNSKEKEYKKFLFYRYFFGNDRPMIVTEGKTDPLYIKAALKKLYKNYPKLIEKDGDDFIFKIEFLNRSNTVEYLFNIPEGGEGLKYWYNYFSNQIPANFFNQKFPAKNDGKKIYKELYPNYMEFFSHLTSREPKNPTIFLFDNEPSGNPLFKFFNHATDLNVSSNNLGQVRGTSFYKITKKDSLYVMATPLMPHMNNGNSSDIEDLLLSCNPSPILKGKTFSKGGGANHYGKDIFSKYVLKNYKEFDFTEFIPLLDGIRDNILDYTS

SEQ ID NO: 1307 - protein, 698 aa, Streptococcus sp.
  source 1..698: note = Related to NZ_LR134002.1; note = Streptococcus sanguinis
MNKLNQLKTKDDLARLLGFKNARYINYLLYDKQTDNLYESFTISKKNGGERIINAPKKELKFLQKKLANVLWECYLESLESKNFLQKRLAGILWKCYLKSLEINYIKNNLSDFLWECFMKVLGFKPKEIKTPVLSHAFEKGKSIITNSQIHRNKKYILNIDLKDFFGSFNFGRVRGFFIKDRDFGISPEIATVIAQIACYQGKLPQGAPSSPIITNLITRILDYRIVKIAKKYRFTYSRYADDMTFSTNRELNSNKLRASKELENFLAELEELIISSGFEINPKKTRLSNNMQRQEVTGLVVNKKISVKREYVKNTRAMAFQLYKDGAFEIDTKPGTLNQLTGRFAFIFQIDQYNNYLLYKKSLIQNNLDSQKYLLGRNSSRKSESKYYWKYIFYNKDLQKELFDNKKHNTYNLPKEFYSIPENEKEVYMSLFNSKEKEYKKYLFYKYFFGNDKPIIITEGKTDPRYIKAALKHLYQKYPELIEKDGDRFTFKIEFLNHTNTLEYLFNVPEGGEGFKYWYNYFSNQIPSNFFKQRFPTKNDGKDIYKELYPNYIEYFSNLTTRKPKNPTIFLFDNEPSDNPLFKFCNHAVDLKVSSNDLDQVRGTSFNRITKKDNLYIMATPLLSNRNNGNSSDIEDLLLSRNLPPILNGKTFSKSGGDNHYGKEIFSKHVLKNFTEFDFAEFIPLLDGIRDNILNYW

SEQ ID NO: 1308 - protein, 656 aa, Streptococcus sp.
  source 1..656: note = Related to CDMW01000001.1; note = Streptococcus sanguinis
MNKLNQLKTKDDLAKLLGFKNARYINYLLYNIQTDNLYNSFTIPKKNGGERIIHAPKKELKFLQKKLANVLWECYLESIESKSKGKNFKTPVLSHAFEKGKSIITNSQMHRNKKYILNIDLKDFFDSFNFGRVRGFFIKDRDFAVSPEIATVIAQIVCYQGKLPQGAPSSPIITNLITRILDYRIVKIAKKYRFTYSRYADDMTFSTNRELNSNKLRASKELENFLAELEELIASSGFKINPKKTRLSNNMQRQEVTGLVVNKKINVRREYVKNTRAMAFQLYKDGAFEIDTKPGKLNQLTGRFAFIFQIDQYNNYLLYKKSLIQNNLDSQKYLLGRNSSKKSESKYYWKYIFYNKDLRKELFDNTEHNTYNLPKEFYSIGKEQKKMYMSLFNSREKEYKKFLFYKYFFGNDKPIIVTEGKTDPRYIKAALKKLYLSYPELVEKVGNNFIFKIEFLNRSNTVEYLFNIPGGGEGLKHWYNYFSNKEKFQMDSKEKLLYPNYIEYFQKLTTRKPQYPTIFLFDNEPNNRKKDDKAPLFLFASHARDLEIDSDNLEQARRGSSSRITKKGSLYIMATPLLPNMNNGNSSDIEDLLLSQKKPPILKGKAFSKKDDPNHYGKEIFSKYVLKNYTQFDFTEFIPLLDAIRNNILDYQNIND

SEQ ID NO: 1309 - protein, 653 aa, Streptococcus sp.
  source 1..653: note = Related to NZ_OU540596.1; note = Streptococcus salivarius
MNKLTNVESKDDFARLLGFSNSRFMNYVLYVLRTEELYETFTIPKKSGGERTINAPKKELKILQKKLANLLWDCYIEDLESESKVKNKKIPNLSHAYEKNKSIITNAKLHRNKKYVLNIDLEDFFDSFNFGRVRGFFIKDRNFCVSSDVATVIAQIACYKGKLPQGAPSSPIITNLIARILDYRIVKIAKKYRFTYSRYADDMTFSTNRELASNKLRTTKELDKFLAELEKVIVASGFKINNKKTRLSNNMQRQEVTGLVVNKKINVKREYIKNTRAMAHKLYLSQRFEIDGREGTINQLIGRFAFVQQIDQFNNYLSYKKSLIKNNFDAQKYLIGKDSGKKSESKYYWKYIFSNRDLRKHLYYNSRHDTYNLPKGFYTIGKEEKKMYMSLFNSREKEYKKFLFYRYFYGNDKPIIVTEGKTDSRYIKAALKKLYYKYPELIEKNGSDFVFKIEFLKHSNTIEYLFNVPEGGSGFEYWYRYFSDKKRFQMGEVEKVVYPNYIEYFKKLTNRPPDNPTIFLFDNELQGPLYNFANFAKDLAISTNNFNQIRYSSFDRIVKKDSLYVMATPLIPKINNGVFSDIEDLLLVRNSTPILRGKQFSKHGGSNHYGKDIFSKHVLKNYSKYDFTEFIPLLDGVKNNIKDYYQKSNNRKN

SEQ ID NO: 1310 - protein, 651 aa, Streptococcus sp.
  source 1..651: note = Related to NZ_RCVM01000028.1; note = Streptococcus hillyeri
MSDYVNLKTKDDLAKNLGYRDSRYLNYLLYKVGVDNLYRTFSIPKKNGDERIINAPLKELKIVQRKLANLLWNRYLEILETKSRDRGIKIPSISHGFEKNKNIITNAQQHRNKKYIINVDLESYFDCFNFGRVRGFFIKDRDFKVSSDVATVMAQIACYQGKLPQGAPSSPIITNLIARILDYRIVKLAKKYRFTYTRYADDLTFSTNRNLLSNKLRAEKEFNEFLVELEKIITTSGFNINPSKTRISNSYQRQEVTGIVVNKKINVKRDYFKNTKAMAYKLYKDGEFEIDGKSGTLEQLSGRFSFIFQATQYNNYLFYKKSLIDNNLEYQKNLLGQGTNKKSESKFYWKYIIYNRDLRRELFYNEKHKTYNLPDEFYAISKEEKKNYMALFDSKEKEYKKFLFYKNFYGNDKPIIVTEGKTDPRYIKAALKKLYLYYPELIEKVDNRFVFKIDFLKHSNIIEYLFNVPEGGSGFMFWYNYFSNKEKFHLSNEEQLLYPNYIDFFRKFTSEKANNPTIFLFDNEPFGNPLYQFVNYAKDLQIDTNNLNTVRGPSFNRISKKESLYLMATPLVSNLNNGNSSDVEDLLISTNKLAIQTFFNIKKINYKRLEDVKNHKEIFSKYVLKNYEQFDFTEYIPLLDGIRNNILDYRK

SEQ ID NO: 1311 - protein, 661 aa, Streptococcus agalactiae
  source 1..661: note = Related to LR134265.1
MGKLQELETKDEFARLLGFNDARYINYLLYHNENNQDKKFINTENLYYSFTIPKKSGGVREINAPKDELKFVQRKLAEILWDDYVEMLKVNSKNKDFKIPSISHGFEKEKSIITNAKQHRNKRFVLNLDLDNFFDSFNFGRVRGFFIKDKDFGTTPEIATVIAQITCYQGKLPQGAPSSPIITNLIARILDYRIVKIAKKYRFTYTRYADDLTFSTNRELYSNKLKSRKELENFLEEIKIKVEASGFSINEKKTRLSDQSQRQEVTGIVVNKKLNVKREYFKNTKAMAFKLYKDEKFEIDGKEGTIDQLNGRFSFINQIDQYNNYLLYKKSLIQNTLSHQKNLIGQELSKKSESKYYWKYIFQSKDLLKETYYNKTHHTYNLPVEFYDIAKNEKKLYMSYFNAHEKEYKKFLFYRYFFGNDKPIIVTEGKTDPRYLKAALKNLYLNYPELIEKVEGKFLFKIDFLSHSDTIEYLFNVPEGGEGLKWWYNYFSDKNYQNKMSEEEKLLYPNYISYFRKRTGRDPRKATIFLFDNEPKGSPLFNFANYAKDLQIDSNNLEQVRRDNFYKISKKESLYLVAPPLLTNMNFGNSSDIEDLLLSRQKMPTLYMDKQMKTFNKNGGLKHYGKEILSKYVLKHHQKFDFTEFVPLLNAIRDNILDYNV

SEQ ID NO: 1312 - protein, 642 aa, Streptococcus sp.
  source 1..642: note = Related to NZ_BCLE01000009.1; note = Streptococcus orisasini
MNKLQTIQSKEDFAHLLGYKKYSSITYLLYKIGIDNLYTSFEIPKKTGGTRTIYAPQKALKKLQKRFASLLWEAYVENFQPTSNKKHKKLPNVSHAFEKNKSIITNAKRHRNKKFVLNLDLEDFFGSFHFGRVRGFFLKNRDFQVPEEVATLIAQLTCYKGSLPQGAPSSPIITNLICQILDHRIVKLAKKYRLTYTRYADDLTFSTNAELPAESFEAFFTQLQDIIHRSGFSINHRKTRISDNGQRQEVTGLIVNKKVNIKREYFKNTKAMAFHLYKDGQFEIDGKPGTIDQLNGRFAYIQQIENYNNYLLYKKSLSTNGIEYQKYLLPKYENKKGRDNFYHHYIFNEQDLVEPTNFWNSKHKKYELPQTFYKAEKNSNYNYMENFSSREKEYQKFLFFKNFFMNNRPLIVTEGKTDIVYLKAALKNLASKYPSLIEKEDNQFNFKINFFSHTATIDYLFNIPKGGGEVFKHLYNYFSDNTGIKQQKYLYPNYLKYFRELTSREPKNPTFFLFDNEPKGNPLYNFANHARDLKLDSQTLDILRINAVDIFVKNNLFLLLIPLLSGKSSSDIEDLLLAEQSMPILNNKSFSKNNNDEGRNSYSKEILSKYILRHYQSFNFNKFIPLFDALEKRILEYKESTK

SEQ ID NO: 1313 - protein, 560 aa, unidentified
  source 1..560: note = Related to QSGD01000014.1; note = Holdemanella biformis
MKKKNILYNVISKRALATVLNVQYKTLTYVLYRRGVDSFYNGFEIQKKTGGTRIINAPQGELKTIQKNLAKILEKSINNSSNISHGFIKNKSIYTNAAIHRNKCFVLNMDLQNFFDSFHFGRVRGFFIKNRNFNCTNEIATMIAQIVCYKGKLPQGAPSSPVITNLVCGSLDYRISKLSKKYKLDYTRYADDITFSTNNRHFICEYENFLNEITEIIEKSGFKINDKKTRLTFSHKRQTVTGVVVNKKLSVPREYYKQTRAMAFNFYKNRIAYLDESNKTLNQIEGRFSYINSFDKLNNILESDKNNKKKNLKDLNNREKDYARFIFYKYFYMNSKPLIITEGKTDILYIKAALKNLVGSYKDLYNGEFKINFLRRSKRFAFLLKISTDGADTIKNFYKNYYTKPVIKDLSFDYFLDFGYYPDCPIIILLDNEPDGKHPLGKFVSSDKSSELLEQLRLNGFIRLNKVHNVYLSVVPKNPDKKLDRYEIEDLFDEELLHMELNGKKFNREGLKGYYTKDDLSKYVYSHYEEINFNNFNAMFENFRNIIVDYQKWYLANINN

SEQ ID NO: 1314 - protein, 657 aa, Streptococcus sp.
  source 1..657: note = Related to RJOU01000001.1; note = Streptococcus gordonii
MSCHALFIIMKYTEIKTIIDFIKAIKVNNYSYINYLLYGIKPNKQYSLFEIPKKNGDSRQIVSPNPKLKKIQKRIYSLLWQRYEEVMLSKTGKYQKTPSLSHGFLKNRSIITNAQKHRNRKIILNIDLKDFFDSFHFGRVRGFFLKNKYFKLPEEVATILAQLTCYNGKLPQGAPTSPLITNLICEILDYRIVTLSKKYRVTYTRYADDLTFSTNNNSFLQSVSEFIIELTNIIQKSGFEINDSKTHLSLYNQRQEVTGLIVNKKINVRREFYKKTRAMAHNLYKNGEFYIDENNNKGSINQLHGRFSFIYNIEKYNNFLSYKKSLSKNSVEYQKNLLSRNIGIKGNNDLYTKFLLQEHDINNTTYYSPEHNKLFLPKDFYSYFLKYESDYIKYLSAKEKEYQKFLFYLNFYGNSYPTIVCEGKTDPLYIKAALKNLYKDYPELVTYDDQKFTFKINFFKRTSDTNKLLFGVPEGGGSSLKFLYNYFSDIKPKNNTQEDIYTNYLEYFENLTLHSAISPTIFLFDNEGSGQPLSNFICHVAKDIRIPNNDLDDRRKEMYCQKVKKNLFVLSTPKAAHDTKSDIESLLINKPVINGRTFSSQESYKREFEYGKNELANYVLKNYKNINFEKFKPLLNTIREINISYKKEYNKLNSKRE

SEQ ID NO: 1315 - protein, 575 aa, unidentified
  source 1..575: note = Related to NZ_SCWC02000010.1; note = Macrococcus equipercicus
MENLSLINTKRTLAFHLSIPYKSFVYLLYHLDHPYSTFEILKKNGESRVINSPHPKLKRLQYKIKDLLETQYNLMMKDRVSHNVSHGFIKERSIFTNAKIHRNKKIVFNIDIKDFFKSIHFGRVRGFLIKNKYFLLNDEVATTISKLICYEGSLPQGAPTSPIMSNLILNIFDMKVLDICQKYSVDYTRYADDLTFSSNSRKFYQSFGDFYYEIEQLINKNGFKLNGSKYRVQLNNSRQEVTGLVVNNRLNIKRDYYKATRSLVHKFLLDQSPIINEQVLNANQIEGRLSFIHSIEIYNKKIEYNKERQEKSYRKDFTTYLHDSVLNAKEREYQKFLFYNLFYKPNNIVVFPEGKTDIYYIKAALKKYYKEYPELVEFKDNKYHYKINFIKRNKRLYYFFDLAIDGADTMSKILNYYSSKPGGKHNKNPINYFQYFNERLDIQPSKPVVLLFDNEGKDKPLHKFINTAKKQLDIDSDMLKSKLNTCDPSPVNLIGNLYILTINKLEADKEYEIEDMIKEYTDNLVINGRKYLNKGEGNSISKIVLAQNVLENYETINLENIKPLLNKLKILKNLY

SEQ ID NO: 1316 - protein, 559 aa, unidentified
  source 1..559: note = Related to JAHAAI010000002.1; note = Veillonella sp.
MNDYKAARAEVSRLFGIKLKMITYVLYKKGVENLYTSYDIPKKNGGTRVIYAPDSKLNKIQKKISEKLYEIHINYMNQEKIKSTISHGFEKNKGIITNAYRHKNKRYLVNVDISDFFSSFNFGRVQGYFHKSQEFGFSKEVSTIIAQLVCHNGKLPQGAPTSPIISNLIFNIVDRRILTLAKKYKLYYTRYADDMSFSTNNKEFQKEYKGFIQELTDLLEKSGFMINHNKTRFVYYSSRQEVTGLTVNNKINASRNFINQTRAMANQLYKKDNFQINGKDGTLAQLEGRFSFINQLDWFNNRLEYKRTNKKKNKKYISDLNAREKQYQYFLFYKYFFKPIKPTIVTEGKTDILHIKAALMKYCDRYPKLITKSADGKYEFKLYFLNKTKRLEYFLGIYREGADTMKNIWNFYKGAHGFTNIFSYLSKKCLGDSLNRVNPVILLFDNEQVTDKPLRKFLNHIGIKAKINPDLMNLTANLYLQTISLINDFDECEIEDLYSEDILNIIIKGKKFEKTVEKDKEDTFSKDIFSKYILEHYYEIDFSNFIPLLDSINDVCKTD

SEQ ID NO: 1317 - protein, 573 aa, unidentified
  source 1..573: note = Related to JAHAFZ010000010.1; note = Veillonella parvula
MKNYKDARKKVAGWIKVNQKELVYVLYGKKVDYFYKSFPIPKKNGESRVIYAPKDELKIIQKRLSQKLYETHREYIRQYRIKSTISHGYEQKRNIITNARRHKNKRYLLNIDISDFFPSFNFGRVQGFFYKSREFSFSKEEATIIAQLVCYNGKLPQGAPTSPIISNLIFNIVDLRILSLAKKYKLYYTRYVDDLTFSTNHKRFKETCSDFIKELTDLLKKNGFEINQGKTRLEYYSSRQEVTGLTVNKKINASRNFINITRAMANQLYRTDEFQIDGEKGSLEKLEGRFSFINQLDWFNNKLEHKIKKGNFSKRYNSGFNGREKQYQYFLFYKYFFKPKKPTIVTEGKTDILHIKAALMKYSDRYPNLIVKEDNGTYKFKIYFLNKTKRLEYFLGISVDGADTMKNIWNFYHGMENCFNIFKYLSVKNNNATLDKANPVILLFDNEQEKNRPLKKFLNYTKINLEEANICQKLNFNLYLQTIPLIGKLDKCEIEDLYQEETLNLTINGKKFSRDAKFDQKIYFGKAIFSRYIIDHYNEIDFSNFIKLLDSINRICIKDQNAYLDINNKVLSN

SEQ ID NO: 1318 - protein, 556 aa, unidentified
  source 1..556: note = Related to AWXD01000007.1; note = Peptoniphilus sp.
MNDYKIARKELARLISVDLKEITYVLYKTGIENSYVSFEIPKKNGESRVIDTPKDKLKWIQRKLSEKLYQMHSDYMTQNGIKTNVSHGFEKNKSIITNAYRHKNKKYLLNVDISDFFSSFNFGRVQGYFYKSREFMFSKEIATIIAQLVCYKGKLPQGAPTSPIISNLIFNIVDIQILALAKEYRLNYTRYADDMSFSTNNKVFEKEYLNFIQELSDLLGKNGFEINQNKTRLEYCSSKQEVTGLTVNNKINASQKFIKNTRAMANQLYKTNSFLIDGKDGTINQLEGRFSFINQLDWLNNKLEYRTTKKKTNKKFISGLNAREKQYQYFLFYKYFFRPNKPTIVTEGKTDILHIKSALMKYCDRYPNFITKVADGEYDFKVYFLNKTKRLNYFLGISGDGADTMKNIWNFYSGKNNYENIYEYMKKKNQAESSNKVNPVILLFDNEQKSDRPLKKFLTYSDVKMDDGQIFKQLKANLFLQTIPLANGLEECEIEDLYQKEVLNVIINGKKFCRNEEDDSEKYFGKHIFSVYIMEHYNEVDFSNFLPILDSIDSLI

SEQ ID NO: 1319 - protein, 549 aa, unidentified
  source 1..549: note = Related to NZ_ADFU01000011.1; note = Veillonella parvula
MVAKLINVELRAITYVLYKKGIEKSYTSFEIPKKAGGTRVIDSPNKQLKRIQRRLGKKIYDIHKNYLDQNRIASNISHGFEVGKGIITNARIHKNKKYLLNIDIANFFSSVNFGRVQGYFNKSQEFLFSKEVSTIISQLVCYDKKLPQGAPTSPIISNLIFNIVDLRILSLAKKYKLSYTRYADDMSFSTNNRAFQTDYINFIQELRNLLENSGFEINENKTRLEYYSSRQEVTGLTVNKKINVSRKFIKQTRAMVDQLFKANSFYIDDTFGTEEQLEGRLAFINQLDWYNNELEPESKKQKANKKYMSGLNAREKQYQYFLFYKYFFKPSKPTIVTEGKTDILHIKAALMKHSDRYPNLITKNDEGKYVFNLYFLNKTKRLKYFFGIVQNGADTMKNIWNFYNGKNNCDNIFKYINDKSQYGVIRNVNPVILLFDNEKEPDKPLRKFLNHIGMQSGIDKPFLKLKANLYLQKIPRINNSDCEIEDLYSKEVLNISIDGKKFEKNVKDSVEDTFSKDIFSKYILEHYQEIDFKNFLPLLDSINNICKIE

SEQ ID NO: 1320 - protein, 558 aa, unidentified
  source 1..558: note = Related to LTGD01000005.1; note = Anaerosphaera sp.
MSLYKNAREEVARMLNIHHKELTYVLYKVGIDKSYKTFKIPKKNGKYRIINAPTEKLKRIQKKLADELYNMHIEYLHNNNIKSIISHGFEKNKSIITNATVHKRNRYLLNMDILDFFPSFNFGRVQGYFEKSREFMFSKEVSTVIAQLVCFNGELPQGAPTSPLIANLIFNIVDMQILPITKKYKLNYTRYADDMSFSTNDYKFKQNYVYFIEELTNILEKNGFGVNTEKTRLQYYSKRQEVTGLTVNDKINANRKFINETRAMANQLYKTGGFKINGEAGSLLQLEGRFSFINQLDKSNNKMNGVSGNNRYINKLNAREKQYQYFLFYKYFYKPQKPTIVTEGKTDIIHIKAALMKYCDMFPKLVSKNDGHYDFKISFLNKTSRLKYFLGISEYGADAMLNIWNFYTGNNNRTNIYKNICDKSIRDKNENINPVFLLFDNEKESDKPLKKFLGSTKTELEDRETLKLLIYNLYLLTIPLEKGLKECEIEDLYSDELLNIIINGKKFSRSSLDDSKNHFGKHRFSIYVLNNYEHIDFEKFLPLLNTINSVIINNNNSN

SEQ ID NO: 1321 - protein, 507 aa, unidentified
  source 1..507: note = Related to NZ_ADFR01000009.1; note = Bulleidia extructa
MHAPKDNLKWIQRKLNNKLFEIHLDYLEDNNIKSIISHGFEKGKSIITNASVHKHKKYLLNIDIADFFPSFHFGRVRGYFHKSKEFNFSKEVSTIIAQLTCYKGKLPQGAPTSPIISNFIFNIVDLRILKLAKNYKLDYTRYADDMSFSTNNKAFKKDYLAFIQELKELLEKSGFEINQNKTRLEYYSSRQEVTGLTVNDKINASRTFINNTRAMANQLYKTNSFQINGKDGTINQLEGRLSFMNQLDFSNNKLGCRITKKKANRKFFSGLNVREKQYQYFLFYKYFFRPAKPTIVTEGKTDVLHIKSALMKYYDRYPKLITKTSDGKYEFKVYFLNKTRRLDYFLGVSSDGADTMKNIWNFYTGKNNCANIFEYINNKNQNESLDKANPVILLFDNEQKSDRPLKNFLKYLDIKLDDGQISKQLRANLFLQTIPLMKGLEECEVEDLYRDEVLSVTIHGKNFCRSAEDDSEKYFGKHIFSMYIKEHYNRIDFSNFLEILDSINNLC

SEQ ID NO: 1322 - protein, 583 aa, unidentified
  source 1..583: note = Related to JAEUGG010000004.1; note = Peptostreptococcus stomatis
MSSYTLFLFIMNNYREARQSVSKLIGIELRKLTYILYEKKTHSFYSTFIIPKKNGGNRKIYAPDDELKWVQKKLANKLHSIHAQYLEDNNIKSVISHGFEKDKNIISNAYIHKNKRFVLNVDISNFFDSFHFGRVKGFFIKNKAFNFSDEESTILAQLVCYNGKLPQGAPTSPLIANLIFNIADLQILKLARAYKLNYTRYADDLSFSTNISTFGSAYSLFLEELSSILIKNGFKLNEDKTRLQFFSSRQEVTGITVNQKLNVSKKFIKDTRAMADKLYKTDEFQINGTNGTLNQLEGRFSFINQLDWFNNKCEYKINKKSSEKKYIHSLNTREKQFQIFLFYKYFYNPDKVTLVTEGKTDIIHVKAALKKYYNKYPELIVKKGDEFEFKINFLKRTDRLAYFLGIVSDGADTMKNIWNFYTGHNNHYNINDYLENKSLNNIKQVNRKPSILLFDNEQIKDKPLDSFLKYTNLELKDNQISIKLISNLYLQTFPLISNMREAEIEDLYSTEVLNTEIRGKTFKKDKKINKNKKKNSDNDTESSNKHYGKHIFSQYIKENYASIDFTNFIPLLDSINTIVMNNK

SEQ ID NO: 1323 - protein, 484 aa, unidentified
  source 1..484: note = Related to JABZQL010000055.1; note = Mogibacterium diversum
MNRYKLARKNIANLIDVNPSTLTYVLYVEKIEQSYKIINIPKKSGGTRDICIPSPQLKSVQRKLANMLCTKHSEYVVYNNINQAVSHGFERKRSIITNASNHKNKKYLLNVDILDFFDSFHFGRVKGFFKKNRNFVFSEEEATIIAQLSCYKGKLPQGAPTSPIIANLIFNIVDLQILKLAKKYRVYYTRYADDLSFSTDMNKFKNMLPSFLKELKLLLEKHGFELNDEKTRLQTRECRQEVTGVTVNEKLNPCPIFVRKTRAMADRLYKTGDIYLEGCVDDEDISLKKKRLEGRFCFINQFDSFNNMIEYGHNNSKLYKKHQAKLNKRETQYQRFLFYKHFYNPDAPLLVTEGITDIIHIESALMKHYVRYPRLITKTEKGFEFNFKFLNRTDKLKFFFGISEDGADTMVNIYNYYSGTNCTNIDKILEKKLPPKQSMGTRNPVILIFDNEQQGNKKPLKKFLNYSRKKLNGNLYSRICSNLY

SEQ ID NO: 1324 - protein, 543 aa, unidentified
  source 1..543: note = Related to MNSF01000070.1; note = Coprococcus sp.
MYINEVNDRERLAILLDVPLQKLTYILYVKKTDNCYKQFQIPKKDGTMRIICAPNDELKVIQRKLANELWKYHLYYMEKKNIESNISHGFVKGRSILTNANIHVNKKYIVNMDIEDFFPSIHFGRVRGYFNKSNEFNLSENVSTIIAQLTCYQGVLPQGAPTSPILANLLCNILDMRLLKVCAKYKVDYSRYADDMTFSTNDKYFIVNQSRFIDEIEKEVEEFGFKINKKKTRLDFYSSRQNVTGLIVNQKIGVDKKFRKDTRAMAYSLYKNGEFKIDGEIGSVYQLEGRFAFIDQIDKYNNKSDIQKNIWGLNSREREYLKFLFYKNFFATNKPVIITEGKTDIYYLKAALQKYYVQYPKLITKKDEKFIYNINFFERNSKTQFFFNIKKDGADTLKNIYNLYTGLNNFPNLYKYFLEVCKYIPKTPVILLFDNEQKTNRPLKNFLKYINYKDGKLIGKKCLIGNLYIMTNPLVKNLEECEIEDLFDDEVLNVELAGKTFSRDKNIDLSKKFGKSIFADYVLKNYKSINLENFKPILDSINE

SEQ ID NO: 1325 - protein, 561 aa, unidentified
  source 1..561: note = Related to FMEJ01000011.1; note = Clostridium sp.
MKNIKTRNDFAKFIGVKLQTLTYLLYIKKIDNCYNTLEIPKKNGDTRTICVPNKNLKKVQKKLYNKLSTYYDEIKTQNNFTSKISHGFEKNRSIVTNAEVHKNKRYVVNLDLLVFFPSINFGRVRSYFIKNNYFEINDDIATILAQLTCYKGTLPQGASTSPLIANMICNIMDIRILKIAKKYRLDYTRYADDLTFSTNNKYFLNDYDKFLEDIKNIIHRSGFELNSKKTRLLFSNSRQEVTGLVVNKKISVPKEYYKNTRAMAHSLYKNGYFLIDDEVGTIEQLEGRFSFINQINLYNIDNKKKNMWHLNSKEKQYQKFMIYKTFYANEKPLIITEGKTDVLYIKAALKKYYKYFPNLITKKDNGNFVFHVNFFKRKQKHSYYLNLVKDGADTIKNIYSNCYIKTKNNKNITTVHDFKKLCGERETNPVILIFDNEMVSNKDRPLKKFLNEIKVNASQKDKLKENLYINICDNLYLCTYQLNNKEACEIEIEDLFPADVLEHEINGRKFSKKDSTHDNGFYGKNEFSQYVYSNYESIDFSNFISLLSAINEIIELYPNNI

SEQ ID NO: 1326 - protein, 660 aa, Streptococcus sp.
  source 1..660: note = Related to FIHB01000001.1; note = Streptococcus suis
MFFKEIKDLNHLSSILGIDRNTLNNLLNQKYREKLYETYYIPKKDGSDRQICAPKEPLKSIQKKIAELLWQNQLWVNHKKEEKYIQDKKMLREEKYRIQTFSETLEDINSSYKLTLEIKKDYRFQNDIIQAFEKGKSILTNAEIHRNKKYIIKIDLEDFFDSFTFYRVKGYFEKNRDFQLSKEISMTLANLVCYKSKLPQGAPSSPILTNMIGRILDSRILKICKRYRLKYTRYADDMTFSTNDDTITKTLDDFLSELDNVIENSGFKINEKKTRVSYWNSRQLVTGLVVNKRVNIPREYYKATKGMAHQLYLGNDVHIKGKKIKKPINQLTGRFAFINQVERFNNERTNLEQTEFSSKEKSFQRFLFYKNFYGAEKPVLITEGKTDIRYIRAALKKLHDKHPSLITLEEGGKAKYKLTFFKKSDVIEQYLDLNKHGGSIFEKIWNLYCNNQIFKKKNFNNVYEYFKRIDSKYKSPVIMIFDNELDVKDSPIQQFINKFGSNVKIVWNTEYKENIHVKLQELKQAGKTRQQIDSEIKKFQKDFTENKKTQLITELRKKDYAHLKDNLYLMLIPLVKPNQSKSDIEALLLPEDIEKINQKLGKQFNPSEKEFIEKDNYSKDKLSKQVIYNYQNISFENFDSLFKNVEKIIQHNFLKRVFKK

SEQ ID NO: 1327 - protein, 311 aa, Streptococcus sp.
  source 1..311: note = Related to NZ_UHFV01000002.1; note = Streptococcus macacae
MIFKEIKDLNHLSSRLGIDRNILNNLLKQKYREKLYDVYNIPKKDGSDRQICAPKEPLKSVQKKIAELLWQEQLWINHEKEEKYIKDKKMLREENFRTQTFSEAIEDMNSGYKLTLETKKYYRFQNDIIQAFEKGKSILTNAQVHRNKKYIVSIDLKDFFDSFTFYRVKEYFEKNRDFQLSKEIAMTLANLVCYKSKLPQGAPSSPILTNMIGRILDSRILKICKKYRLKYTRYADDMTFSTNDDVIIKKLDDFLSDLNSIIDNASFKINEKKTRVSYWNSRQLVTGLVVNKRVNTPREYYKATNWTFCIH

SEQ ID NO: 1328 - protein, 350 aa, Streptococcus sp.
  source 1..350: note = Related to NZ_GL878548.1; note = Streptococcus sanguinis
MDLKDFFDSFTFYRVRGYFEHHKDFLLSREIAMTLANLVCYKSKLPQGAPSSPILTNMIGRILDSRIRKLCKKFRLKYTRYADDMTFSTNDDDCFARVKDFLHELNIIVEDAGFTVNDKKSRICYWYSRQTVTGLIVNKRISVSKKYYKATRGMAHQLYIGREVYVNKEKVDNPIKILSGRFAFINQVDQYSDNILGLERNIFSTREKTFQRFLFYKYFYGIDRPMLVTEGKTDIRYIRASLKKLNKKFPELINLENDGKAEYSITFLKKSTVLEKYLGLNKHGGSIFEKIWNLYLNNNLLNNKNFGDIYNYFKRIGSPYKSPVIMLFDNELDEPDRPIKQFLDKIQKNG

SEQ ID NO: 1329 - protein, 546 aa, unidentified
  source 1..546: note = Clostridiaceae bacterium; note = Related to JAGZSC010000015.1
MEFKDITDKRLLAKFLGIKYKELTYILYSKRTENLYQTFEIPKKNGKMRCINAPQEPLKYVQRNLAKQLISIQEKYYLETNNIIQGFTKKRDIISNGSYHRNKRYILNLDLENFFDSFHFGRVKGYFQKNQYFMLNSNVATCLANIACYKGKLPQGSPSSPVITNLICSILDRRLATIAQKYRMTYTRYADDLTFSTNRRDFLENKDELISELYAVIDKSGFKVNRNKTRVLFWNSRQEVTGLVVNKKISVKREFYKETRAMLDHLYKGLIVEHNGIEVSLQQIEGRLSFINQIDKYNNKHGGERKNVQKGMNGREKEYQQFLFYKYFFCPSKPVIVTEGKTDPVYIRSALQKFYIQYPKLIRKKEDGSFEYLITFLKRTSRLEFFLGIQQDGANAMKNIYNEYVGNNQYPNLYEPLRKYGLKSSNPVILLFDNETVTKRPLKDFLNHINNKSGMDYRLWLNIHENLYLATIPLVKGQKECEIEDLFSDEVLSHEIDGKYFDRKGKDGEKSYSKQIFASYIAQNISSIDFTNFVPLLDALNEIVKN

SEQ ID NO: 1330 - protein, 569 aa, unidentified
  source 1..569: note = Related to JAFUUI010000025.1; note = Ruminococcus sp.
MLRIKECDNVYQLAMCLNLNTAVITNILYNIKTDNCYRQFKIPKKNGKTRTICAPNAELKSVQKRLANALYYELKLIREENNINSKISHAFEKKKSIISNCEIHKRKRFILNVDLKDFFDHFHYGRVYGYFLKNKYFLCTDETARTIANIACFQGKLPQGAPTSPIITNLIFQAVDARILQLTKKHHLDYTRYADDLTFSTNEQDFIETYNDFLNKLTRLIEKSGFEINQNKIRISCHDSRQTVTGLIVNDKINVCNDYYKLVRAYAHSFYKTDSFDIKDNNGKVIKSGNANQLEGMLAFTHMIDKHNKTIKKNPAELQHSLNKREREYQRFLFYKYFYHNERPLIITEGKTDQIYLCCAMKKYYREFPELIEQRKSGFHFKVQFMKKSKRMLEMFSFVQDGASAMTTLYLNYYKKNSKFPDYYQYFSQITCKSASNPVLFIYDNELCSKDKPLYELMKKEKKSMVDKIEKDGWVSMSSKKNLYIVTNPLVDSKKECEIEELFTTETLQKEINGKTFSLEKNYDTNEHFGKDIFSKIIAKEYEQIDFSRFIPFLERIRDAIVDYNNTEA

SEQ ID NO: 1331 - protein, 564 aa, unidentified
  source 1..564: note = Related to NZ_WQRC01000021.1; note = Anaerostipes hadrus
MQMINEVTTRDELADLVGIPYRKLTYILYKKYVENMYTSFEIPKKNGGRRLINSPNEELKYIQKNLVKALYRYEQTLLDKDINIHSSVSHAFENEKSIFTNARIHRNKRFIINVDLENFFDSIHFGRVRGYFLKNNYFRLTDEVATVIAQLTCYKGSLPQGAPTSPIISNYICNIFDLRIMKLAKKYRMNYTRYADDLTFSTNDKHCIEYQDEFLLKLKKEIDRAGFSINQTKTRISYKNSRQEVTGVVVNQKISIKREYYKITRAMADRLYKTGEFFIDGEKGSIHQLEGRFDFINQAEWFDNKYFKKKRNFYSLNGREKEYKKFLFYKYFFANEKTLIITEGKTDVIYIKAALKNLYKEYPELVTRNEKGEYQYKFSFLKKSKRLDYFLNIKKDGADTLKNIYAYYSGKSEVNYPEYMTEFENSQGIRAQNAVIMLYDNELQQKTKPVAKFCKVNMSDDQIKKLKKEEYVLLNSNLYLMVTPLQKGKSISDIEDLFHSELLKTKLDGKIFTKNDKYDTKIYYGKDRFSKYVMKNYAKIDFEAFKPLLNNIKKIVYEYKKIEE

SEQ ID NO: 1332 - protein, 562 aa, unidentified
  source 1..562: note = Lachnospiraceae bacterium; note = Related to JAGZGD010000017.1
MKMINEVKSRNELADLLGISRKRLTYLLYIKHLENMYTSFEIPKKSGGQRLINAPNKELKLIQRRLANELYEYHTRLNKDKQINGVSQAFEKEKSIFTNAKIHRKKRFIINVDLENFFDNIHFGRVRGYLIKNKDFQLSEEVATVIAQLTCFKGSLPQGAPTSPIISNYICNIFDLRIIKLAKKYKLNYTRYADDLTFSTNDKYFMENWEAFLGNLEKEVERAGFHLNEKKTRISYEDSRQEVTGVIVNKKISIKREYYKNTRAMANNLYKTGEFYINGEKGSLNQLEGRFTFINQAECFGKKINFQQLNGREKEYQKFLFFKYFYANEKPLIVTEGKTDVIYLKAALKKMYRDYPELVTRDDKGGFHYNLSFLKKSMRLKNYLNIQSDGADTMKNIYLYYSKQSNKNYPQYIKKFENIRGSRPQNVVIMLFDNELKEKDRPISKFCKGTVKDEQKVELQDKLHILLETNLFLMVTPLKEGKEISDIEDLFPDEVLNIEIDGKKFTKKDKYDTKENYGKDRFAKYVMKNYGKINFDGFRPLLDKIKFIIMQYKEGDKGEKEN

SEQ ID NO: 1333 - protein, 557 aa, unidentified
  source 1..557: note = Related to NZ_AUJA01000011.1; note = Butyrivibrio fibrisolvens
MLLSEIHTRYEFAQLLGIELKELTYLLYIEKVENLYTTFSIPKKSGGERCINAPQKKLKYIQKLLKVLLESYEEEICCANHINTGVAHAFKKRRSIITNAQKHKNKKYIINIDLENFFDSFNFGRVRGFFIKNKYWNLDPNIATLIAQISCYNGVLPQGAPTSPIITNMICNIMDWHITKIAQKYKLIYTRYADDLTFTTNDKKIVDKYDDFLLELNREIEKSGFKINNSKTRFTNNLNRQVVTGLVVNSKVSINREYYKKTYAMAHSLYRSGEFTIDEKKGTINQLEGRFSFIDQIDKYNNRIDCNIKHDIWHLNHREKKYQEFLFYKYFCANNRPLVITEGKTDIIYLKTAYRILRQDDTKLFIPEDNEIDYGVSFLRKSDRLDYFFNLKKDGASPMTNILDSYLGNKTFKISYYEQLMAKYKITPNAPVILLYDNELNKKGAVRDVINSKKLDIESLKEKNYIRVIGNLYIQVVPLVKGKEDCEIEDLITENVDDLIIEGRHFDRKGKADKEKFYNKDVLSHYIEEHENEFHFDCFKELFKTWDLIIEDYNSLK

SEQ ID NO: 1334 - protein, 573 aa, unidentified
  source 1..573: note = Lachnospiraceae bacterium 10-1; note = Related to KE159810.1
MNLEDVCTRNDLADFLGIKRGKLTYILYIQKVDTMYSTFSIPKKSGGERTINAPNDDLKQIQRKLADALWNYQVKIWEKNKIQTNISHAFQKSKSIVTNSMRHVRKRYVLNIDLKNFFDSFHFGRVRGFFMKNLFWGMTEEAATVIAQLTCYKGALPQGAPTSPIITNMICNIMDMHLLSIAKRYKLNYTRYADDMTFSTNDKHFMEHYDAFYKDLSKEVLGAGFQINEEKTRLLYNDSRQEVTGLIVNNKISIKREYYKNTQAMAHSLYTNGFFTINGEDGTISQLEGRFSFIDQIEKYNNSHDGAKHSAISLNHREKKYQEFLFYKNFCINPKPLIVTEGKTDILYIKSALRKMYLQYPDLIEKKDNQWIYNLSFLHRSSKLSYFFDFNVDGADTMQNIYNMYTGSGRTHVNYYRHFREKYDLNMHQPVILLFDNEFENSEKPIKKFMNNIGSDKKGKNKAKGESKQRETSLQNELFLHLIGNLYVQAVPLAPSETSGEIEDLLGKNILNMEIDGRKFDRTGKKDKSRFYNKDILSKYILSHYEEIDFSLFIPLFDTFRKIKNDYSDQKNT

SEQ ID NO: 1335 - protein, 564 aa, unidentified
  source 1..564: note = Related to JRFX01000003.1; note = Lactococcus lactis
MSYNEARNNVAEKLGVPPKLLSYLFRRGIDKFYKEIEIPKKTGGLRKIMIPQNQLKSVQKEILKMLQKIYIENNVETTFSHGFEKNKSIISNARMHKNKYLVLNLDLEDFFGSFHFGRIRGYFEKSNNFQLSHEESAVLANLICYKGFLPQGASTSPIMTNMICHFLDLKLHYIAKKNKFTYTRYADDLTFSSNNIKTESECEQLLFNIEKQIKKAGFKINKSKTRLQFRNGSQKVTGLVVNKKVNVNNTYYKTTRAMANKLYREGSFNINGNKGTVNQLEGRFSFIDQLNFESNKNDKSMSTVKHGFSWGSDNRKDYLVNRREKSYQEFLFYKYFYANEKPIILTEGKTDITYLKAALKNMYQDYPSLIEKKDGKFNFKVEFMKRSKRFNYFFGYFEGGNGMKNIYRLFFHSPYKYYEKFYKKRQIENHNPVFLIFDNELVDNLKPLRSFINFTNLNTNDNIRFLEEQHYLNLDKNLYAITHQLMNDKSMMEIEDLFLEDVLNVRLNNKSFNRKDNADRESTFGKSRFSDYIAEHYKTINFENFKPMLDIIRNISDNEKNIRL

SEQ ID NO: 1336 - protein, 558 aa, unidentified
  source 1..558: note = Related to NZ_JADPDD010000032.1; note = Lactococcus lactis
MNYNDARNSIADKINVPPKLLSYIFLTGIDKFYTEIEIPKKNGGVRKISIPQNQLKSVHQEVLKFLQKIYKNSDLATVFSHGFEKNKSIITNAQVHKNKRIVLNMDLEDFFYSFHFGRIRGFFKNNKFFKMTHEEATVLSNLICYKGVLPQGAATSPIMTNMICHFMDLKLQHVAKKHKCSYTRYADDLTFSTNNKNTVENYKELIKDIKTQINKAGFKINDDKTRLQSKENSQRVTGLVVNKKVNVSHYYYKKTRAMAESLYKTGKFYINDQEGDIKQLEGRFSFIDQLNFANNIQGKKDGTGYHGFFTTGNDGKIAVNNREKSYQKFLFYKYFYANDKPTILTEGKTDIKYLKAALKKMYLLFPNLIKKKETGFEFKVNFLERSRRFDFFFGYVEGAEGMKKIFELYFRKPFYYYNEFQLKRTFPNQKPVFLIFDNELKNNKKPIRKFINFTNGNVELKVSKVESENFLHIDKNLYLITHQLMNDKDEMEIEDLFSTDVLSAKVDGKIFDRNDNADRSKTFGKAVFAEYITRNYRNIDFSNFIPMLHRISEIISNT

SEQ ID NO: 1337 - protein, 636 aa, unidentified
  source 1..636: note = Related to JAFREC010000076.1; note = Leuconostoc mesenteroides
MKNKNKANDIKKFVMDNIKIDTIRHSDDYLPYFYYLYPQWAPDHTKIINTLANISASYCNVSIPKKISGTRNLSVPNKFLKPLQEFVKLLITNQLKSNNFSFSPIAQGFIEGRGIYTNAHIHRNKKYILHLDLKDFFTSIHFGRVSGFFIKDKNFKLQPHIAYFFANLCCLDGVLPQGSPTSPIISNLIAQHLDKKVLLLSKKYHFTFSRYADDLVFSTNDTKIIVNELPNFLNSINSIVKNQGFEINWDKLSLMGPDVRHTVTGLSNNVRVSVTKNFYLETRAISENLYVSNSFFVDNKLFLGHSDKSITENLKIVEGRFAFIYDIEKRNRQFYSKKTFGKALQGKNNNNYQPNHKITFLESKNKKQGASDIGQNAFNGKIWAYSKFLFYKYFIYGDKLTIFCEGKTDPIYLKAAMGALGYNNAVTMYSIETWLNEKNVFVNLFGLPMGGSGLQKLIYYFLTPIKNSKSYYDFFEKKTLSMKPVVLLVDYELKKDKPLNNIINAICIAKKLSNNEKVKLKNEIESDLDKNGYYFLGNNVYIAVTIDFNSKKDTDRAIEEYFPTNTLLDIEGNQTRHFGDENCKVINKNKHLISNNSQPMEKIDFAIWSLNHRYNRNLFIGFINILNILITSEMTI

SEQ ID NO: 1338 - protein, 660 aa, unidentified
  source 1..660: note = Related to QFDJ01000030.1; note = Leuconostoc pseudomesenteroides
MNIKKISLKISDFSHRDSFISTLEKYKKHFGTFDVQSTIQNASALYSEKKIPKKISGFRVISIPSPELKIIQVFVKELIENQLEYFDYKFSVVNHAFQKEKSIYTNAQVHRNKKYILHVDLKDFFSSIHFGRISGYLSKNKNFKLPSYMAYFFADICCLNGILPQGSPASPVISNLIAENLDKKVLSLSKEYHFIYTRYVDDLVFSTNDTAIIMNYMQDFLYKLNAIVENQGFHINWEKLNLMGPDVRHTVTGLSNNKRVSVTKDFYLTTRSIANNFYCTNSFYSKGILYSGYESSDRQKNLNFIAGLFSFIYDIEVRNKNFHKEKTYGESLQGLNHNNYQPRHKVSMETNNSLSDQIFNGKIFLYSKFLFFKYFLFGDIITVFTEGITDPLYLNAAIKSLDYQNEVELISIQEMQNKEMVFPKLFNLSRGGSALRRLIDYYNDTVKNGKTYYDFFKNKMVPLKPVVLLFDYEIKKNKPLGQAINLLLNYGHNSQTVEDELRENGFYFVGDNLYIATTVNFNDKTDDDRAIEDYLPIQFLGDVNGDHTRHFADEKSKFFREKKIAISELSTPMYKEELAQTVLKKTSDIVIFKDFSMILSIFSEIRLGYMNKVIDCINEDRINTIYNILDSKSASEIIDKNTELKKKFDEKLSDLLKIHA

SEQ ID NO: 1339 - protein, 695 aa, unidentified
  source 1..695: note = Related to NZ_CP086132.1; note = Lacticaseibacillus paracasei
MKHFEYHRQKKISDFHSRDSFIHELHIVSWITDERKQLFSRLLNSPGNFYKEFSIPKKYGEGERIIDAPNEDLKSLQIIIKSLIENQLKVKEFVFGKYDQAYQKNKGIFTNAQIHRNKKYLVHIDLEGFFPSIHFGRVSGFFQKSRLFKLEPPMAFFFANLCCYKGHLPQGAPTSPLIANLIGEKLDREVLLLSKKFRFTYSRYADDLTFSTNNVKSITNDFRSFMDALNYMIEKMGFNINWDKVGIEGPDVRHTVTGLSNNKRVSSTVDFYKLTRAMANSLYVDNEFFDAKRSYNAYTQKSLEKAIQVIEGRYAFINDIEDKNKKLYERHSGGEEYQSITPTDFREHHYISSRLNGVSKENLPAIYSGKKLSYSRFLFYKKFLAGDAMTVFTEGKTDPMYISAAMKALTPNLKITFTIPQVEGENQTQFANLFDLNRGGASLRRILDIYFGISTGGHASISHPLYFEKKIISIKPCVLLLDFEFNDGQQKSEKANSKKKNSSSPHPLVVVLNYIFQNRRIAKKKASIIKDDLIKNGFYFVDENLYIATTTDRSGDKTNRAIEDYFPASFLNDPYGDGTKHFENAPMLKKDNGFKDSDSLRKYDFAKYVKTQTETVDLFKDFNVLFDIFNNIRKDYNRRLLKKIADVSTNYTILAKNTMYRILDSDILRKEIAHDSDLNQLFFDNYKKLFDVSSY

SEQ ID NO: 1340 - protein, 674 aa, unidentified
  source 1..674: note = Related to VBTH01000020.1; note = Pediococcus stilesii
MTKFKYNREKKISDFKTRLSFVRELYSIGLNSIDIFKLSKNINNYYTEFTIPKKYGTGVRTISAPLGDLKQIQQIIKKLIENELTYCNYTFGKYNQAFQKNKSIFTNAQIHRNKKYIIHLDLKDFFSSIHFGRISGYLQKNSKFRLTKDMASFIANLCCYNGMLPQGAPTSPIISNLLGESLDRKLLKISKTYHLTYSRYADDLVFSTNDEKIIAQKLSELIEVISTSVKKSGFQLNWDKLNFMGPDVRHLVTGLSNNKRVSSTIDFYKNTRSMALNFYVKNSFYAGKHFYNGYTIRNQQRSMQVLEGRYAFINNIESQNRRLYENHLSGAEYHAITPQDFKDRHNLIKAKKHDEPSFSGKELSYSRFIFFKKFLFGNNISVFTEGKTDPRYIQAAMRALNSDIQLEVTSFQTESDLNTQFSKMFNLTQGGTSLKRIIDLYKGTNYQYGKRALSAYYNYFDLDNSKIKFVPMKPCILLLDFELLGPTSPLQTIINRLMGARKNSYTIDSKENIQKNLKEKGFYYIFDNLYIVTTIGSNDTENQKNRAIEDYFPKEFLADIYKDGTTCFENAENKSDNSRKLISKNDFSILIESNFFNDPEIFKNFQILFDIFGKVQFDYLNKLLNRIDNNPSAQHVIFNILDSNFIRNIINENHSLREKFLMIFNKYFLRNYQK

SEQ ID NO: 1341 - protein, 669 aa, unidentified
  source 1..669: note = Related to SGAX01000001.1; note = Weissella paramesenteroides
MSYKISDLNTKNDIINYLMSTKSISSPKIFYKILNDVSAHYSDIYLKKKYSNDVRHINAPDEQLKSIQHKIKILIENQLSYKNYKFNNISQAYQNGKSIFTNAQIHRNKKYVLHLDICNFFDEITFKRINGFLQHNSKFMLNYTVSTIMTKLCCYDGHLTQGSPVSPIISNLLGEKIDLVLVKVAKKYHFVYTRYADDLVFSTNDTYTINEKLTEFINKVSEIINSQGFSINWDKLSIAGPDVRHTVTGLTNNKKVSVPLEFYKQTRAIANHFYIYDEFYNNQQIYRDCYVKNFNKTPMKIIEGRLNHIYNIENQNRTLYSDHLSGFEYQAITPIDYKRHVFSPTENKETHEVINEFSGKELEYSKFIFYKFFLYGDFITLFTEGKTDPLYIKKAKKILGIDDFDLKIYDADTEINKKSIFSRLFNLHTGGKSLIKIFEIYVGRATDQHFINYSKYFEEKTFSIKPTVLLYDFELYSRNSPLGNFISIICGKKYKHYGFKRNVIIKELKTKGFYRVYKNLYIAVTMDFNMIGLNTQEEDIKRSIEDYFPSQLLSNTNGLNTEHFEGVSAPNSHSVVIDKNQFSKRIQTYTDKKIFNNFNNLFDIFLDIQKDYLSVLLSRLDKSNLDNPVEKRMVINCLYRILNSNKTLQLIEQFKLTKLFMDVYNKNFL

SEQ ID NO: 1342 - protein, 665 aa, unidentified
  source 1..665: note = Related to SDQQ01000001.1; note = Weissella paramesenteroides
MAKKLSDITNKNQLIQVLIVAHAITNGKTFYNVLNNIDKHYTEFSIPKKYSNELRTINAPDSELKKIQKQIKRLIENQLLSKKYYFNISSQAYQKNKSIFTNAQIHRNKKYILHFDIENFFDNITFRRINGFFQKNKRFKLPYNISTILTRLCCCKGHLVQGSPISPIISNLIGDGLDYKLRKLSNKYHFIYTRYADDMIFSTNDSKIITNKLQEFMKDLQDIIEQEGFSLNQRKYTLMGPNVRHYVTGLTNNKKVATPIEFYKSTRAMANHLYKYGEINVNGKIFDSNSYPSPVNIVEGRLNHIYHIEQENRKLYQEHSAGFEYFPITPLDYQKHTNKLKINNDTGSIINELSGKELEYSKFIFYKNFFYGDYIKVFTEGKTDPRYIKKAYSMLRPNDNSIRLSSVESLLNHNNILTKVFNLHQGGDGLTDIFNMYTGNQSNENKYFNYTQYFNLKTLPIRPTIILMDFELNNKNKTSPLNNFINNIVNTLLGGKGRNKEKERNKIKQELKEKGYYRIYSNLYLAVTTDLIEITSHTENKTIDRDIENYFDIDLVKDMFQRNMIHIKDIRSVCKVSELINKNEFSKSIKKINDATKFTGFQNLITIFSNIHLDYLELVLNKLLLTRDNPLIYTQTIKKIKSSNYIIHMITGNQKLNNLYKQLNL

SEQ ID NO: 1343 - protein, 606 aa, unidentified
  source 1..606: note = Related to BJJW01000002.1; note = Leuconostoc citreum
MLNEAKTIDELAACIEMQPWQLKKVLYSGGGANTKYRQFEVIKKTGGIRKIDAPEQSLKHVQKRIAAKINDLLALEKGDAPFVPLSQAYQKGHGIYTNALVHRNKKLVLNIDISDFFPSLHFGRIAGFFMKNKNFLLSKEVAVSIAQLTCHNGVLAQGSALSPVISNLIFQAVDQHILKVTRKYKLTYTRYADDMTFSTNNFGFLNELEEFVKSIESQIKADGFSINWSKMRLSGPDVRQTVTGLSINKKVNVSKQYYKNTRSMALSLYTTGFFHVDGQRYDQNMLSKLEGRFSYINDIVRKNNLLYEQYSFEYLATRANNKSRLLNEKKSKPSLHPEAFSSSEKAYRNFLFYKYFYKNKKPLIVTEGHTDAIYLKTAIKNLKISNLNLDFLKRSKMTKYFFGFIKGGDSLKNIANLYLSSQKSNVNISNKMYNYGVIPDQPVILLLDHEMHKKEKKDSPLLPLANYLKGVSKFPEIEDFFCELHKHGFIHLTSNLYIAVVSKKGTTKDDIYEIENLFPNTLLNDVFGMGTFEKVYSGKGRKIDKNDFALIIRKHWNNDIFQGFKVMLDVIDKVCLDYEKRKQRMLEKRQNDEKKAVKVGNTNNKL

SEQ ID NO: 1344 - protein, 584 aa, unidentified
  source 1..584: note = Related to FN822744.1; note = Leuconostoc gelidum
MYLNEAKTIDDLAECLEIKTWQLKKVLYSHGGANNKYFQFEITKKSGGTRKINAPEKSLKLVQKKLATKINDLLHEEKGEAPFTPLSQAYQKKHGIYTNGLIHRNKNLVLNIDLLNFFPSLHFGRVVGFFMKNKKFSLTNEVSVAIAQLTCHDGMLAQGSSLSPVISNLICQSIDQHILKISKEYKLTYTRYADDMTFSTNDFNFINRLEQFVKLLETQIKRDGFDINWSKMRFSGPDVRQTVTGLSVNKKVNVPYQFYKNTRSMALSLYTTGHFTIDGQEYDRDKLYKLEGRFSHINDIDWKNNLLYERYSFEYQAMRPNNKSHLLNGKISTPYLYPEAFSSREKAYRNFLFYKYFFKNKKPLIVTEGHTDIVYLKSAIKNLQRNDLNVDFLKRSKSTKYFFGFIKGGDSLKNISNLYHNSSLMNISNKMYKYGIKPDQPVILLLDHEMYKKVQKDSPLMPLANYWKDVSKFPIIQNFYDELHQHGFIHLTSNLYIAVVSKKGTTKDNIFEIENLFSDYVLDKVFGLGTFEKKYKGSGRKITKNDFSLIIRKHQKDSIFEGFDKMLDIIHLVCVDYEKRSGQQ

SEQ ID NO: 1345 - protein, 610 aa, unidentified
  source 1..610: note = Related to NZ_CP060724.1; note = Weissella diestrammenae
MNLNEVNDVVDLARVLHYPSRKIKKILYRDRVDNQYFEFSLAKKSGGSRLINVPNEVLADLQNCILIELKRYMNNHDIKFSRVSQAYQKDREKGIYRNARIHRGRKYVINVDLEDFFPSIHFGRVVGFFEKNNKFKFTHRCAILLAQLVCYKGYLPQGASTSPLISNLICHTLDIHILKIAKKYHLRYSRFADDLTFSTNDDEISTEEQMHNFIKELTRQIGRDGFKVNWKKMRIAGPDVRHTVTGLVNNKIVKVKKEYYKNTRAMVNQLFYTHRFIIDGVKYNIENDESKKGGIKKLEGRLAFIDDINRRNNIEYLDDITKKAMTRVQNPKRYDKFSAFERMYRQFLFFKNFWQRNTPLIVTEGKTDVLHLKEAIKNSDILLPNISFFKPSSRFDFFLGIGFDGASKMDKFINLYIKENSFENLSIKFRKIDDIKKENDLFGLSGESKPVILLFDHEFADLESPINMFINNLSKDRTYRHIESKKIEELEKYESEKQNSNAIKKFLKKKLNENGFIHLVDNLYVLVIKKDVPSINEKYAIEGLYPIEVVNNVFGLGVLETYADNNFENVLSKNDFSKIIRHKPAEIFRGFRPTLSCIEEILKDSENRNN

SEQ ID NO: 1346 - protein, 564 aa, unidentified
  source 1..564: note = Related to LFQN01000005.1; note = Exiguobacterium acetylicum
MKFNELRNRNDLASILKIPKNQFSYLLYKLNVNKQYEKFEIPKKSGGTRTIHSPNDRLKYIQKRLNEEILNFIDDSDYPKSKISHGYEKGKSISTNASVHVKKRYVLNIDIEDFFGSINFGRVRGFFNKNKFFSLPLEVSTIIAQICCKDGVLPQGAPTSPIISNLIGHTLDYRISILAKKYKMNYSRYVDDLTFSTNEKNFELYLENFLSEFDAHLNNAGFKRNKKKTRLQYKRSRQSVTGVIVNEDLSIPNDFYKNTRAMLNEFIKNEKFFIDKKDNYGTLNQLEGRLSYINHFEKMKNMRNAKNKEVNKKNHTKFSTKEKEFKKFLFYKNFIINDKPLIITEGKTDVLYLKAALKNLHSEYPNLIEKKDNGNYDFKVKFFQRSKRNRYFFIISKDGADAMKNLVDLFIDKRSNNVNECVMTKIKTMRKTKALNPVILLFDNEMVTDRPLKNFLNFIKISPEDRLKFGLSLNTCISDNLFLLTNDIPLKKKDVGEAEIEDLLPENILNHVINGKMMNYTNGKDKQSISKDFLSKYVVSNYEKINFDKFRPLLNSLNSIIENY

SEQ ID NO: 1347 - protein, 558 aa, unidentified
  source 1..558: note = Related to DPHU01000079.1; note = Eubacterium sp.
MVISDIESREQLAFLLNIPLSKLTYLLYVKKIDNCYTSFDIKKKNNGVRVISAPNEDLKDIQRKLGYLLESHHKAFLKEKNIDNKISHGFEKNKSIITNAAVHRNNKYILNIDIKDFFDSIHFGRVRGFFNKNIEFNLPLDMATVMAQLVCYKGVLPQGAPTSPIVSNLICNILDIRILNLVKKYRMNYTRYADDMTFSTNDRCIVDNYDGILEEIANELDKFGLYINDKKTRLIYKDSRQEVTGLVVNKIINVNRDYCKKTRAMAENLYRKGSFYIGDEEGSIKQLEGRFAYINQLDFYNNKRKGEKKDCWHLNSREKNYQKFLYYRYFFNNEKPLIVTEGKTDILYLKSALKKMYDSYPNLISKTKNGFEFKVSFLKRSKRLEYFFNINQDGADTIKNVLNMYTGQKGFANYYKYFKDKSEKDGRNPVLLIFDNEQKTDRPLKKFKKDAKIQDVNIKNWINILGNLYLVTNPIVNGKDECEIEDLFSESTLNTLIGGKSFSRNSKSENDKYYGKAIFADYVMKNYQKIDFSNFVPFLDSINSVLDDYQKKNLIQSQ

SEQ ID NO: 1348 - protein, 608 aa, Streptococcus agalactiae
  source 1..608: note = Related to LBLH01000065.1
MMSYKEIDSKRKLALYIGVPVKQLTWLLYVRKIENCYNNSFSIKKKNGDDRIINAPNKSLKYVQRRLARLLLKRLNEVYVEGNIINNISHGFFKGKSIKTNAVPHRNKKYILNIDLKDFFDSIHFGRVQGFFKNNNHFKLPEVATIIAQLTCYEGKLPQGAPTSPVISNLICQILDYKILSLCKKYRLTYTRYADDLTFSTNDNNFKDNYSNFLSELDKVVVRSGFEINSNKIRFQEFNYRQTVTGLTVNKKVNVRQDYYKRTRSMAHSLYTTEKYEINGRNGTINQLEGRFSFINDLVKYNNRLVEQNSLRLNSIEYKKNLLYTQDSEFVNRTNKNPWKTNLNSLSIREKDYQKFLFYKYFIANPQITFIPEGKTDEKYIKAALKRYYKDYPNLVKKVGKKFVYNITFIDRSKRWKYFFGVLEGGGSDLYQLLNYFTNAENRTCRNYLSHFKSIIPNPPKKPVIFLLDNEFDKKKPLNQFIKKLLIANGLDSNKIESTVHEEYLYNIDLNAFIMTIPFDNIKNEDDKEIEDLLDIETINNELISNEFDGKIFDKNKQHDDPKYIGKEIFANTILKNHNSKLIDFTQFKPLLDLINQLSTNYSQFQNK

SEQ ID NO: 1349 - protein, 615 aa, Streptococcus sp.
  source 1..615: note = Related to NZ_JALDUR010000001.1; note = Streptococcus parasanguinis
MQYSDIKSIRTLAYALGVQTKQLTGLLYGIKIENCYTSFKISKKNGDERTINAPSKSLKYVQRRLTRLLVKRQEEFFLERNVKNNISHGFSKGKGIKTNAVPHRNKRYVLNVDLENFFETIHFGRVQGFFKNNEYFKLPEVATIIAQIACYEGSLPQGAPSSPIISNLICQILDYRIVHLCKKYRLTYTRYADDLTFSTNDKNFEDMKDEFEDELKKVISRSGFIVNSNKTRFQKNDSRQIVTGLSVNKKINVTRDFYKKTRSMADKLYRNGSFTINEKNGTIDQLEGRFSFINDLVKYNNRLDELNSLKSNLIEYKKNLLYTEERKYKNDNDNNQVLDWERNLGNLNIREKDFQKFLFYKYFIANPKVTVITEGKTDSRYIKAALREYYLEYPNLITKDEGGFKYNIHFLKPSKRLRYFFDYMSGGGGGFVLINLMEFFSGKDSRTKRNYIKYFNSILSEKTLPQKPTLFLVDNEWQGSNPLPGVIGKLVKDKNLERKDIEQKIKSDFLYHIDLNAFVITLPVESVDYKTNIEIENLFNLEEINNELIAPNYDGKIFDPKKKNGDNKKKIGKEIFSNYILSNYDSEVINYSKFKPLLDLINKLSEDYTKFKDNK

SEQ ID NO: 1350 - protein, 610 aa, Streptococcus sp.
  source 1..610: note = Related to UHFT01000001.1
MNYEDIHSRDMLAFALGIPIKQLTGLLYGVKIENCYTTFTISKKNGSERTISAPNKSLKYVQRKLARLLLERYEEFLTEKNTNNRISHAFFKGKSIKTNALPHRNKRYVLNVDLQDFFDSIHFGRVHGFFKNNDFFKLPDVATVIAQLTCYEGVLPQGAPTSPIISNLICQILDYKIIELCQEYHLTYTRYADDLTFSTNEKNFDNNYQDFLDKLDKLVTRSGFKINAEKTHFQEYNGRQTVTGLSVNKKLNVKKGFYKHTRSMAHSLYKTGKFMINGKEGTLNQLEGRFSFINDLVKYNNRLEELPSLKLNSIEYKKNLQFTDGKEFEVKKNEQKQILDWKKNLSTLSIREKDYQKFLFYKYFIANTNITVVTEGKTDSKYIKAALRKYYAEYPELVTKEKDGFKYKINFLPRTKRMRYFFGFLSGGGSDQIQLFNYFINRDNHISRNYIKYFKEISEDVPLPQKPTVFLLDNEWETKKPLHNIIKVLCSAQNLNNKDIIQKIHTDYLYHVDLNAFLMTLPVDNLSPKCEVEIENLFDLEKINTELIEPLHDGKKFDIKKEHDDDKSIGKEIFANTILTNYDSEIIDFSNFKPLLDKLSDISKDFTKYT

SEQ ID NO: 1351 - protein, 621 aa, unidentified
  source 1..621: note = Related to JAGEKB010000001.1; note = Lachnoanaerobaculum sp.
MCKYSSIDSKEALASTIGVSVRQITGLVYGIRIDNCYHSFYISKKSGKKRQISAPNKSLKYVQRRLCRLLIEKLNDFYLEYNIKNQITHGFFKGKSIKTNALPHRNKRYVLNIDLKDFFGSIHFGRVQGFFLKNNYFKLPKVATLIAQLTCYNGKLPQGAPTSPIISNLICQILDYKIIILCKKYRLTYTRYADDLTFSTNNKVFSENYTLFLEELKDIVTSSGFDINAEKTHFQKFNSRQTVTGLSVNKKLNVQNDFYKKTRSMANTLYKTGEFTIDGKEGTIKKLEGRFSFINELVKYNNRLVEDRSLTSNIIEYKKNLLRTQEKLFRLSDRKIKTLAWDENLRSLSMREKDYQKFLFYKYFIANKKTTLITEGKTDPRYIKAALKHYYSDFAGLVSSDGNNFKYNVSFLSRSNRMRYFFGFKEGGGGELQNLLRFFTEGNTVENLLEYFRKIIPLKPSKPVIFLVDNEFSKDDPLYCVAKFLKNKIHTTEYIEKKLHTDYFYHVGLNTFIITLPISNIDMDNKDKSKLKGTDIEIEDLYNLNEINEKLIKPNHGGKIFNKKKEDNSKYIGKEIFSKFMISNYSNSCIDYSKFRPLLDLINDLSENYHLKTDGERYNTK

SEQ ID NO: 1352 - protein, 384 aa, unidentified
  source 1..384: note = Related to JABZPB010000073.1; note = Lachnoanaerobaculum sp.
MYSYSSIDSKENLAANIGVTVKQITGILYGIGIDKYYHTFFIPKKNGQQRQINAPTGSLKYVQRRLNVLLLKRLDEFYLEHNIKNRISHGFFKGKSIKTNAFQHRNKRYVLNIDLKNFFDSIHFGRVQGFFLKNDYFKLPKVATIIAQLTCYNGKLAQGAPTSPIISNLICQILDYRILKLCKKYRLMYTRYADDLTFSTNNKAFSEAYTLFLDELSNIVNDSGFAINTEKTHFQEFNKRQTVTGLSVNKKINVQNEFYKKTRSMANTLYRTDKFTIDGKEGTINKLEGRFSFINDLVKYNNRLEEDNSLASNIIEYKKNILRAKEKHFNKSNNNQIKILDWNENLRCLSIREKDYQRFLFYKYFIANNKITLISEGKTDPRYI

SEQ ID NO: 1353 - protein, 615 aa, Streptococcus sp.
  source 1..615: note = Related to VKGS01000001.1; note = Streptococcus cristatus
MKYTDICSRDDLAIALGIGKRQLTGLLYGIGIDKCYSSFEIPKKNGGKRLINAPNKSLKYVQRKLNKLLLKRLDDYNRENGSKQNIAHAYFKGKGIKTNAFPHRNKRFILNIDLDDFFGTIHFGRVQGFFQKNAYFKLPEIATILAQLTCYEGKLPQGAPTSPVISNLICQILDYKILDLCKRYKLTYTRYADDLTFSTNDRKFFESRQQFVEELGRIIKKSGFNINNEKTYFQSSENRQVVTGLSVNKKINVTVDFYKKTRSMAQHLYKTGGFSVDGKEGNLNILEGRFSFINDLVRYNNQTKKNESLVSNSPEYQKYLSLPIEKLISLKGKRFTGKLTRNEKLYNLTIREKDYQKFLFYKYFVANPKTIIITEGKTDSRYIKASLKRYYTDYPNLIKKEGNKFSYNITFLPRSQRLKYFFGFLDGGGSDLINLVSFFIDTNNYSFRNYVSYFKSIITNNPPKPVIFLLDNEEKSGKPLGSFKSFISKNTSATSSQIDSAIKSDFFYHIDFNTFLMTLPVERTSNSDILDVEIENLFDLDKINNELIRGMHGGKTFSPKKAEGDDLHIGKEIFSKTILTNYESEIIDFSQFKPLLDNISNLSNNYSEYTKDKIQ

SEQ ID NO: 1354 - protein, 613 aa, unidentified
  source 1..613: note = Related to NZ_KV790849.1; note = Granulicatella sp.
MKYYQISSIDMLAFALRIPVKQITGLLYGVKIENCYSTKEIPKKDGSKRILNAPNKSLKYVQRQICKLLINRLDELTEKNGVKNNISHGFFKGKSIKTNALPHRNKKYVLNVDLEDFFDSIHFGRVQGFFKNNKYFKLPEIATVLAQLTCFNGKLPQGAPTSPLVSNLICQILDFKILKLCKKYKLTYTRYVDDLTFSTNDPYFFYLYNYFLDELNNLINKAGFKINLQKTHFQPFNNRQVVTGLSVNKILNVKKEFYKITRSMANSLYKTGTFEIDGKKETVEKIDKLHGRFTFINDLVKSNNRLHEINSLRLNGIEYKKFLLTTYEKEFEYKSANQKSELKWKNNLGHLNLREKDFQKFLFYKYFIANTSVTILTEGKTDSRYLKAALKKTYSQYPELINFEDSKFKVNINFINRTATQRYFFGILEGGGGDLTQLLKYFTDGKNDIERNYLSYFKRIIPEAPKKPVIFLVDNESDNKSPLENVASFLASRQGVKKQDIVKKLQNDFYYHVDFNVFIVTLPTNIFNNKTNIEIEDLLNLDEINNQIIRERYSGKSFSPKKSHNDINHIGKEIFSNFINRNYSNPLIDFSGFRQLLDLIDSLSQDYHSYTNN

SEQ ID NO: 1355 - protein, 584 aa, unidentified
  source 1..584: note = Related to CP014160.1; note = Aerococcus sanguinicola
MNLQINNFTTRTELANLLEIELQILTRLLYSPTQNVNTQYHTFELEKKRGGATRTIAAPNDSLKIVLRKLNDLLSQYYLKAFAFREAEKQISHGFVRKKNIFTNASQHRNKKYILNIDLEDYFDHFHFGRVRGFFEKDKRFNLSKEMATVLAQLTCYKKVLPQGAPTSPTIANMITAILDRRILSLCQKYKLKYTRYADDLTFSTNDNTFSDKYGEFLIELDRIVKACGHEINQDKTHFLTYNNRQTITGLSVNKIVNVPRTYSSKTRAMAHNLYTKGEYFIGDNVYNINENEKTLEILTGRFNFSNWIDNLKLQNNQFAQNNKSLRTYSKREKDFSKFLFYKTFYVNATPLLITEGKTDFSYIDSAYKSLLPRDIEVVNKFDYKLFKKNNSITTYFLNSKSDNKTGEGGDEISKLFFQYTSQITFGKGIVEDCEINIGLSKVSPHFYHYFRKYGHPFNHHPVVILLDNENSSNKPLKKFLKAIYTGGNYQPPYELLQSTNFLHLVGNLYLTTIPSPQKNPNAFEIEDLFTEEDKKRLSFSRDRKAPFSEAVEENRETINFDNFIKLFKILDDIKQHYLTFESY

SEQ ID NO: 1356 - protein, 586 aa, Staphylococcus aureus
  source 1..586: note = Related to NZ_UHCA01000002.1
MSDYNFSNIKTRKDLARFLKIPLKKLTFLLYIDQNLYTNFSIPKKSGGIRNIYAPNKNLKEVQRVIKHKLEQHINEYQKLNGIKNNVSHGFEREKNIITNSEIHKNKKIVFNTDIKDFFSTIHFGRVRGFFIKNKYFRMEENIATMLAQLVCYNGSLPQGSPTSPIIGNLICNTLDIKILKLCKKFKLNYTRYADDLTFSTNNKLFSDEFQLFYNNLEEQVNQSGFLINTNKNRFLCKDNRQTVTGLTVNKKVNVNRDFYLKTRAMAYCLYNSGEFYIDGEKANINQLEGRFSFINQLDKHQNIKKFNMLLPSEKKEKFFSNLFLNSREKEYQKFLFYKYFWRNSKPLILTEGKTDILYIKAALKKYYKAYPELIEKIGEDEFYYKISFFKRSDKMKFFFSFISDGADNLTNIFNYYIDNFDDKKNKSFNYCNYFKNKLSIPFKNPIIILYDNERQNKPLHKAIDNVITGLIRGKSEEKKKQRREKKESLKKSLNDSTPFAENILENIYFLTNPQLEDKNTEIEDLLTNITNHLELDGKSFNKDGGKNNFGKNILSQYVYKNYKKLDLNSLKPILDNIKDVKSKYF

SEQ ID NO: 1357 - protein, 575 aa, unidentified
  source 1..575: note = Related to JAIMFU010000001.1; note = Salinicoccus roseus
MNKLSEIKTRSDLAATLSVSEGDLVKILYYEKDLYQNFDIAKKNGTSRKINAPKENLKKILQTLNILLNKHVHDYYDENNSSLNVSHGFEKGRDIVSNAEVHINKKFVFNTDIKDFFPSIHFGRVRGLFHKHTIFQMDEYAATMLAQLTCYNGSLPQGAPTSPLISNLICRELDIRMLRICKKFRLHYTRYADDLTFSTNNKNFQLNYENFYKKLNNEINSAGFSLKHNKSRLQQKTERQEVTGLTVNNKVNVNRKFYLKTRAMAHSFYENGSFYINNNIGTMRQLEGRLAFINRLDKENNIRKYERLTNEKDKMGFFKHKPLNAREKEYQKFLFYKNFWVRTKPLIITEGKTDPLYIKAALKKYYKEYPELIELNNNNDFEFKIDFFNRTSKLRYFFELEKDGADTMNRLINYYVHKNYNSKRNDKFNYYHFFHSKMGVPPLYPIVFLFDNEYEKKPLHKFIDNVAPLTNKPVKTLKKELNKTNPTPQNLIGNTYILSVPKSTPNVNGEIEDLLLNITKDLTIKGKKYNKNGGDQYIGKDILSKYIYQEYESLNLDSLKPLLDRIVNLKIMYEK

SEQ ID NO: 1358 - protein, 596 aa, Staphylococcus sp.
  source 1..596: note = Related to NZ_VELK01000002.1; note = Staphylococcus hominis
MKYAFINNKYDFFNVLGVPATKMNYLLYNRERMGTNNMYHTFSIPKKSGGKRTIHAPNDELKNIQKKLAKVLENHYYESIQDNKNKDAFLQGFFKDRGIITNAKIHRNKKFILNIDLEDFFQTIHFGRVKGFFEKDNTFKVPSEVALIIANLVCYRGILPQGAPTSPIISNLIGRIMDVKLLKLCKRYKLKYTRYADDLTFSTNDNSFLELEDKLIYEIKNEIRKCGFEVNEKKTRVQDYRLRQSVTNITVNKKLNVSKTYIKNTRAMAHHLYKHQEYYIDNEVGTINQLEGRFAFINQLDKYNNNIVKIKSFEKNSIEEQKNLGSVFQTKKEISKTFFFKNLNSREKEYQKFLFYKYFYANPKPIIVTEGKTDVRYLKAALKNLYKEYPDLIEKNENGFDFKISFLNRFSNRHQKISKLHYFLNIVPDGADTIYNIYGYYDSKNSTYPNFIEFFKNISQSSPANPVIFLFDNELNNKNKPLAKFCKKLNMKEHQKEKLSSDNKIYLTENLYLITHQLLENCDENELEDLFSKSTLSKEINGKKFIKRDSFDNKKYYGKEIFSNYISSNYSVLDFNNFRPILNNIVDVLKKYKSIL

SEQ ID NO: 1359 - protein, 317 aa, Staphylococcus sp.
  source 1..317: note = Related to NZ_CP023497.1; note = Staphylococcus simulans
MEYAFITDKNDFFQALKIPTQKMNYLLYNKHQMGPENMYSTFSISKKSGGERIIHAPSDELKSVQKKLAKLLENHYYESIRNNKNKDTFLQGFLQNRGIITNAKVHRNKKHILNIDLEDFFHTIHFGRVKGFFEKDKTFKVPSEVALIIARLTCYKGALPQGAPTSPIISNLIGKIMDFRLIKLCKKYKLSYTRYADDLTFSTNDNSFLKLADRLIIEIKNEVRKSGFKVNEKKTRVQNYRLRQDVTNITVNKKLNVSKTYFKNTRAMAHHLYKHQEYFIDDEIGTLEQLEGRFAFINQIDKYNNKLSRAETYEKNH

SEQ ID NO: 1360 - protein, 585 aa, unidentified
  source 1..585: note = Related to JALGOX010000003.1; note = Mammaliicoccus sciuri
MKYTYINNKYDFFALLGVPSNKMNYLLYNRVNMGPENMYSTFTIPKKNGGERTINAPNKELKNIQKKLVVLLENHYNELVEKKKFRDSFLHAFIKDRSIITNARIHRNKNFILNIDLENFFETIHFGRVKGFFEKDFNFKVPSEVALIIAQLTCYKGSLPQGAPTSPIISNLIGKILDLRLIKLCKKYKLNYTRYADDLTFSTNDYSFVKNFNKILEDIKIEVNKSGFKVNDKKTRVQNYRLRQDVTNLTVNKKINVQKKYFKNTRAMANHLYRNNEFFIDGDLGTLNQLEGRFAFINQIDKYNNKNIIHKYNSSKKKSNKEYIHNLNSREKEYRKFIFYRLFYANPNPIIATEGKTDIRYIKAALKNLYDEYPELIEKNDNQFLFKISFLNRFRKKTDEMNKLQYFLNLAPHGADSLKNIFKYYKESESSYPNYMEYFKKLGNNMPNNPVIILFDNELHNKKKPLSKFCTNLKLTDDDKSILKLNLNICLKDNLYLLTNQLIGTSKENQLEDLFQEETLSKIINNKSFSTSDEYDKSIYYGKEIFSQYISSNYETENFDNFRPLLDNIVKIINDYKMNKCEDNN

SEQ ID NO: 1361 - protein, 595 aa, Staphylococcus sp.
  source 1..595: note = Related to CP068216.1; note = Staphylococcus pasteuri
MEYNLIADKYDFFNMLGISTRKMNYILYNREHMGTENMYETFSIPKKSGGERTIHAPKAELRIIQKRLASILENHYYESIEDKKYSDTFIHAFIKNKSIITNAKIHRNKKNIMNIDLEDFFHTIHFGRVKGFFEKDSIFKVPSEVALIIAQLTCFKGALPQGAPTSPIISNMIGKILDLRLLHLCKKYNLDYTRYADDLTFSTNDKAFEKNTDTILSEIKMEIVKSGFKVNDKKTRIQNYRIRQDVTSLTVNKKINTKKTYFKNTRAMANNLYKNHEFFIDNKLGTIEQLEGRFAFINQIDKYNNKISKIKSFERNTLVHQKYLESMYLIKKENSKTQYFKNLNKREREYQTFLFYRHFYGNSKPIIVTEGKTDIRYIKAALKNLYKYYPDLIEKDGNSFIFKINFLKRFKSKPSKMNKLHYFLNILPDGADAMKNIYNYYNENDSYYPNYIKKFKLLGKNVPYNPVILMFDNELQNTKKPLSNFCKHAKLSNDKKNKLKTDYYINLIENLYLLTHQLMPNSNENELEDLFDQQALSKKIGGKTFKRGDGFDTNQYYGKEIFSQYIISNYKRINFDNFRPLLDNLVEIIKDYSKK

SEQ ID NO: 1362 - protein, 595 aa, Staphylococcus sp.
  source 1..595: note = Related to PZEX01000047.1; note = Staphylococcus warneri
MKYSFITNKKDFFNLLGVSAKKMNYILYNKQFKGPENMYTTFLVPKKNGGERKISAPNGELKIIQKKLATILENHYYETYKSQNYCNNITHAFQKNKGIITNAKVHRNKKNILNIDLEEFFHSIHFGRVKGFFEKDSTFKVPKDVALIIAQLTCYQGYLPQGAPTSPIISNLIGNILDMRLLKLCKKYKLNYTRYADDLTFSSNDLSFSKVKDKIILDIEMEIERCGFKVNNSKTRIQNYKIRQEVTGLTVNKKINVKRSYYKNTRAMANNLYRNKEFFIDNKIGTINQLEGRFSFINQLDKYNNKILKYKSFEKNSVGHQKNLESLYKIKKESSNTQFFKHLNAREKEYQKFLFYKYFYNNPQPLLATEGKTDIRYLKAALKNLYIEYPDLIEQQDGKFVYKIGFLNRFNYNAKKMNRLHYFLNILPDGASALKNIYSYYNEQNSHYPNYVKLFKKLDDDKPLNPVILLYDNELANKKKPILNFCNHIDMSENEKASLQSGSYFHISENLYLLTHQLINSAKENELEDLFDKKTLSKIINNKTFCKKDKFDTSKYYGKDIFSKFVICNYNNINFENFKPLLDNIVRVVKDYENR

SEQ ID NO: 1363 - protein, 608 aa, unidentified
  source 1..608: note = Related to NZ_MJBI02000011.1; note = Macrococcus goetzii
MNYNFIVDKQSFCNELGISVGLLNYLLYSNKENGIESFYINFSVPKKNGEERRIHAPNEQLKFVQKKVQELLQIRNDELFAKLNVENKIVHGFVPGKNIITNARKHRNKKIVINIDIQDFFESLHFGRVKGFFEKDKFFGLPKEVALIIAQLTCYKGHLPQGAPTSPIISNLIAKILDIRMLKMCKKYNLDYTRYADDMTFSTNKYLTTKQLEKLLKDLEKVISNSGFSINNKKTRIQQNNLRQDVTGITVNEKLNVNKEYIKKTRAMAHNLYCNNEFYIENEKGTLDQLEGRFSFINQLDKFNNNISKTKSVEYNLIKNQKNFSYISTYQKKVNTKSDQFFKQLNSREQEYQKFIFFKLFYGNPKPLIITEGKTDIKYLKAALKSLHKEYPGLVEKQGDKYIYKVSFLDKSSRKNKKISKLQYFLNISEHGGDVMKNIFSYYDVQNNYYPSYYDYFDELRNFTGANKPVILFFDNEVDRRKKDSPVKSFIKHAKISSKVDEFKKNKKIHITKNLYLLTHSLEEGALEGEIEDLFDEDVLNHEINGKIFSRKDEEETNKYGKEIFSKYVYSNFQNINFHNFKQILDDIVYIIEIYEMSKKNRKKVVTE

SEQ ID NO: 1364 - protein, 570 aa, unidentified
  source 1..570: note = Related to NZ_JQBL01000009.1; note = Kandleria vitulina
MRLKDVKNRKDLAQLLDVKVKVLTYCLYVLPETMRYSSFVIPKKDGSERQILVPCAQLKRIQKKLAEVLNEDYLEINSNNVAQGFIKNKGIITNARYHRNKRVIINVDISDFFGTIHFGRVKGYFENNKFYKLNNKVATMIAQLTCYQGKLPQGAPTSPVIANMIGQIIDYHILKLCKQYKLYYTRYADDMTFSTNINYSLVEIEKFICDLSETLSRLGFEINTKKTRVCFNSSKQEVTGVIVNKKLNADKTFIKETRAMAQNLYSTGGFVIDNKIGTMDQLEGRFAFINQFDKYNNIVNNTSKGKHLEKLNVREKAYQQFLFYKLFLGNDRPVIYTEGKTDSRYIKAALKKLYIQYDDLIEKNENGKFEYKILFGSRNKKYEYFLDFMQYGADSFNIIALLYTGRNGYANLCSILKSKMRRKPNAPVILLMDNEQTNGKPLNKFLQSYRDEHYKNLTDHEKAFFNDYNYIRLVENLYLATFPLEPGVEEMEIEDLFSKEFLDGKINGKSFKRSPKKGETNVMSKDELSRYVLSHYRSINFSGFKGLLDVISAIKKDYEKYINMDDNKWY

SEQ ID NO: 1365 - protein, 596 aa, Acinetobacter sp.
  source 1..596: note = Related to CP077398.1; note = Acinetobacter nosocomialis
MKYLKELKSCQTQKDLANLLGYSEKNFTRILFSQNISLRYQSFEIPKKNGDKRKILAPTSELKVLQTRLSILLSNCYEELELKRLSTSSYIKCISSHGFRKKLIVNIPASKQNRKIIEYKEINFGIYSNAKQHTGKRLVLNIDLKDFFESITFSRVVGFFTKNKLFLLPLDIAVLIAQIVTYRTSTSQEGFLPQGSPCSPIISNLIGNILDVKMVKLAKEYKFTYTRYVDDLTLSTNLPQFSEDIIEFDGEKWVLGSALNHTINSSKFKINPKKTRLTDKYNKQEVTGLTINKKVNIDRTYYRYTRSMVQKFCAEGEFFKSKVHMDKQKISREALNGILSHIYQIKNQQDINFPNCARNFSELNSLEKLYAKFLFHHYFVHPQRMLIIGEGYTDPLHFKLACHKLYKESLSFLKFSSLEGTKRFSKITGYGGGTGLLKIFLQNYKQFYKARNICLKPCLIIVDGDSDGDAVISKASAEFKTTFKKISHSSMTTAGLLDWYHIFNNLYILQLPKNKVIEDFYDPLILTIPIGSKTFHSDDKKKNTKFDSKIHYGKKVLLEKIIYEQQDTIDFSKFDLIFNTIFHIQFYHYIYCNMES

SEQ ID NO: 1366 - protein, 592 aa, Acinetobacter sp.
  source 1..592: note = Related to CP059039.1; note = Acinetobacter baumannii
MKYLKQLKSCQTQKDLAILLGYSEKNFTRILFSENITTRYQDFEISKKSGGKRRIFAPTPELKILQTRLSILLSNCYRELELKRLSTSSYVNCISSHGFRKKLKINIPTSKQNRTSLEAKEINFGIYSNAQKHTGKRLVLNIDLKDFFESITFSRIVGFFSKNKLFSLPFDIAILIAQIVTYRESTSKEGFLPQGSPCSPIISNLIGNILDVKMVKLAKEYKFTYTRYVDDLTLSTNLPQFSEDIIEFDGEKWVLGSALNHTINSSKFKINPKKTRLTDKYNKQEVTGLTVNKKVNIDQNYYRYTRSMVQNFCAEGEFFKSKFHMDKHKTNREALNGILSHIYQIKNQQDIKFPNSTRNFNELNSLEKLYTKFLFHHYFIHPQRVLIIGEGYTDPLHLKLACHKLYPDSLKFIKFSSLSGTKRFSKIMGLTGGTGLIQKFLKNYNVIYKSQVISHLPCIILVDGDSDGEHVIKCANKEFNDFIKHISLTALNKSAILDYYHAHHNLYIIKLPKNTVIENFYDPSILLKTISGKTYNSSNSTFDLTKFYGKKDLFEKIIFQDQNTIDFSKFDLIFNTIFHIQFYHYIYCNMEE

SEQ ID NO: 1367 - protein, 591 aa, Acinetobacter sp.
  source 1..591: note = Related to KB850198.1; note = Acinetobacter colistiniresistens
MNFLHQLKTCQTQKDLAALLGYSEKNFSRILFSQNIITRYRSFEIPKKNGNKRQILAPTSELKILQTRLANLLSNCYEELEVKRLSSSSYVNCISSHGFRRNITINIPTSKQNRTPIKSKKVNFGIYSNAEKHIGKRLVLNIDLKDFFENITFSRIVGFFTKNKFFLLPLDVAILIAQITTYRTSISQEGFLPQGSPCSPIISNLIGNILDVKMVKLAKEYKFTYTRYVDDLTLSTNLPQFSDDIVKLNNEKWVIGSILNHTVNSSRFTINPTKTRLTNKYNKQEVTGLTVNKKVNIDQTYYRYTRSMVQKFCSEGEFFKSKVHMDKQKISREALNGILSHIYQIKNKQDIKFQNITRNFDELNSLDKLYAKFLFHHYIVHPQRMFIIGEGYTDPLHLKLACHKLYKNSLEFIKFSSLQETKKFSKIMGYSGGTGLLQKFLKNYKLIYKGSLLSLKPSVILIDGDKAGDDVIKTAKNEFKDSFQEIKNSSMNGSYILEFKHVFKNLYIIQLPKNDVIENLYDVSVINTKIGTRTYNPSNNKFDLTKYYGKKELIEKVIFPNQNTINFSKFDLIFNTIFHIQLYHYIYCNGN

SEQ ID NO: 1368 - protein, 596 aa, Acinetobacter sp.
  source 1..596: note = Related to JAKZGD010000010.1
MNFLNQLKTCQTQKDFAALLGYSEKNFSRILFSQNITTRYISFEIPKKNGNKRQILAPTSELKILQTRLANLLSNCYEELEVKRLSSSSYVNCTSSHGFRRNITINIPTSKQNRTPIGSKKINFGIYSNAEKHIGKRLVLNIDLKDFFENITFSRIVGFFTKNKFFLLPLDVAILIAQIATYRTSTSQEGFLPQGSPCSPIISNLIGNILDVKMVKLAKEYKFTYTRYVDDLTLSTNLPQFSDDIVKLNNEKWVVGSILNHTINSSRFTINPTKTRVTNKYNKQEVTGLIVNKKVNIDKTYYRYTRSMVQKFCSEGEFFKSKVHMDKQKISREALNGILSHIYQIKNKQDIKFQNSTRKFNELNSLEKLYAKFLFHHYFVYPQRMLIIGEGYTDPLHFKLACHKLYKNSLHFLKFSSLEGTKRFSKITGYGGGTGLLKIFLQNYKQFYKAKNIFLKPCLIIVDGDSDGQAVISTARSEFKSTFKQINHSSMTTTGLLDWYHIFNNLYILQLPKNEVIEDFYDPSVLMYSIGSKVFHSDDKKKNTKFDPNIHYGKKVLLEKIIYEKQDIIDFTKFDLIFNSIFHIQLYHYIYSNLHN

SEQ ID NO: 1369 - protein, 593 aa, Acinetobacter sp.
  source 1..593: note = Related to NZ_CP039031.1; note = Acinetobacter indicus
MNNLFLLRTCQTQKDFAKVLGYSEKEFTLILFSQSIQNKYQSFDIPKKNGNKRKILAPTPDLKILQTRCLSTLLTNCYEELEKKRLSKSSYVQSISSHGFRKKLLLDIPFTKKSRTPFEKKVIKLGIYSNASKHVGKNLILNIDLKDFFQSITFSRIIGFFSKNKYFQLNFDIAVLIAQIATYRPNQSQEGFLPQGSPCSPIISNLIGNILDIKMLKLGKKYKFTYSRYVDDLTLSTNLPKFNEEIVKLVDNTWVIGSELKNVVNSSKFKVNPQKTRLTNKYNRQEVTGLTVNRKVNVSKEYYRYTRSMVQSFCTEGNFVKSKVHMDKQKISREALNGILSHIFQIKNKQQIEFNNQTRNFDELNSIEKLYAKFLFHHYFIHPQRMIVIGEGYTDPTHFKLASHNLYPDILKFLKFSSLQETKRFSKIMGYSGGTGLLNKFLKNYKLIYKANVISCKPCLIIVDGDKAGNDVIKTARSEFSKTFKAINNVSLNLSAKLEFFHIFENLYILQLPKDQVIEDFYDTTVTGSLIGTRTYNSSNNKFDLTKYYGKKELLEKIIFPNQDTINFSKFNLIFNTIFHIQIYHYIYCNLKN

SEQ ID NO: 1370 - protein, 592 aa, Acinetobacter sp.
  source 1..592: note = Related to NZ_CP054822.1; note = Acinetobacter lwoffii
MDNLFLLKTCQTQKDFASLLGYSEKEFTRILFSQPIQNKYKSFKIPKKNGSRRNILAPVPDLKILQTRLSILLTHCYDELEHKRLSKSSYVQCISSHGFRKKILVEIPISKKSRTSFESKVINFGIYSNAKKHVGKNLVLNIDLKDFFQSITFSRIIGFFTKNKYFQLNFDIALLVAQIATYRPNQVQEGFLPQGSPCSPIISNLIGNILDIKMVKLARKYKFTYTRYVDDLTLSTNLPQFSEEIIKLDGKSWVIGSTLKYAINSSKFEVNPQKTRLTNKYNRQEVTGLTVNRKVNISKEYYRYTRSMVQSFCAEGHFFKSKVHMDTDKTTREALNGILSHIFQIRNKQQIEFNNQTRNFDELQSTEKLYTKFLFHHYFVHPQRMILVGEGYTDPLHLKLACHKLYPNSLNFLKFSSLQQTKRFSKIMGYQGGTGLLNKFLKNYKLIYQAKNISLKPCLIIVDGDTAGNDVIKLAKSEFKETIKLINKSLLTTSSILKFFHVFENLYLIQLPENKVIEDFYDSSITGSCIGTRTYNPSNKKFDLDKYYGKKELFEKIIFTNQNTINFSEFDLIFNTIFHIQLYHYIYNNLKT

SEQ ID NO: 1371 - protein, 592 aa, Acinetobacter sp.
  source 1..592: note = Related to NEGA01000008.1
MNNLFLLKSCQTQRDLAILLGYSEKDFTRILFSKPISTKYQSFDILKKNGNKRNILAPTSELKTLQTRLSKLLTNYYEELEQKRLSTSSYVKCISSHGFRNKISVQIPISKKNRTSFESKIINLGIYSNAHKHVGKKLVLNVDLKDFFQSITFSRIIGFFTKNKHFQLPFDIALLIAQIATYRLNQSKEGFLPQGSPCSPIISNLIGNILDIKMLRLAKEYKFTYTRYVDDLTLSTNLPQFDNEIIKLEGDTWILGSTLKYTIQSSKFNINSQKTRITNRDNRQEVTGLTVNTKVNINQNYYRYTRSMVNKFCTEGEFFKSKVHMDKDKTSREALNGILSHIFLIKNQQQIEFPHTTKNFNELNGIEKLYIKFLFHHYFVHPQRMLIIGEGYTDPIHLKLACHKLFPNSLNFLKFSSLQETKRFSKIMGYSGGTGLLNKFLKNYKTIYKAKTISLKPCLIIVDGDNAGDGVIKTARGEFKETFRPINNPPLSSSGKFEFFHIFENLYIVQLPKNQVIEDLYDTTVTTSLIGKRTYNSSNNKFDLTKYYGKKELFEKIIFPNQDTIDFSKFDLIFNTIFHIQVYHYFYSNLNN

SEQ ID NO: 1372 - protein, 591 aa, Acinetobacter sp.
  source 1..591: note = Related to SGSS01000016.1
MKYLEQLKSCKTQKELAILLGYSEKNFTRILFSQKISTRYQSFEIPKKTGSKRIIFAPNSELKILQTRLSIILSNCYEELEIKRLSTSSYSQCISSHGFRKKLTLDIPISKSNRESLGSQIINLGIYSNAQKHVGKRLVLNIDLKDFFQSITFSRIVGFFNKNQRFLLELDVSILIAQIATYRETTEEGFLPQGSPCSPIISNLIGNILDVKMVKLAKEYKFTYTRYVDDLTFSTNLPQFSEKIVKLNDNNWVIGSTLKHVINSSKFEVNSQKTRLTNNYNRQEVTGLTVNSKVNINKEYYRYTRSMVQMFCAEGKFFKSKVHMDQDKNTRGALNGVLSHIFQIKNKQQIEFDPKTKNYDELQSIEKLYTKFLFHNYFVHPHRMVVIGEGYTDPIHLKLACHKLYPNSLNFLKFSSLQQTKRFSQIMGYNGGTGLLNKFLENYQLIYQAKSISLKPCLIIVDGDKAGDGVIRTARSKFKDTFQSIRYTPLNSSSILNFFHVFKNLYIIQLPKTKVIEDLYDTCVTSTLIGTRSYNPSNKDFDLSKFYGKKELFEKIIFPNQNTINFSEFDLIFNTIFHIQLYHYIFSNSKN

SEQ ID NO: 1373 - protein, 593 aa, Acinetobacter sp.
  source 1..593: note = Related to JAGJSX010000002.1; note = Acinetobacter nosocomialis
MNILKFPISKLALASDKKDLSNLLNYDYKDFCWILYSQPIHMRYKLIEIPKKNGKIRIIHAPDSHLKQLQKNLAIQLNKIFEEKNLYEPAFSFAFRRNNNKQKFGIYFNAKRHRNRKLVINIDLKDFFHTIEFKRIVGYFKRNKYFNFPIDVAIGIAQIACYKDPNTGKTFLPQGSPVSPIISNLITEILDAKFTKLAKKYKFYYSRYADDLTLSFDTNNIPSEIVKCNENNYSLGREVIKAIKSSGFNINKDKVSFRTNFDRQQVTGLVVNKKINIPRNYYDFSKSMAYNYCQYATFKKSSYHTFAKKNSNQGESIIGVLNYIYNIKMEYKNRTTDKPPYIYTEFKIDKPKSPEQLFWSKNSFIRLLLQTYFQESFVYRKKIHLLCEGKTDPLHFKNYISTLPIEIQSYYDFTAFKEEDLTIFQKELNIRSGTPNLKRFIEIYSTLYISKMIFVNPTILIVDNDKAGNEVFQCATGRYKKTTKNGKVIINSIEIEYAYICKNLFIIKLPKINPETTIEDLYDTTLTSTILNGKSFTKDNVYDPNIHYGKVDFFKNVIRKNRTTIDYKNFEAIIEIINRIFNLNFYLNLTNIN

SEQ ID NO: 1374 - protein, 583 aa, Acinetobacter sp.
  source 1..583: note = Related to NZ_VOZD01000001.1
MLATDKKDLANFLNYDYKHFCWILYSQPIHTRYNIIEIPKKSGKLRVIHAPDSHLKQLQKNLAVQLTELFEQKNTGKPSFSFAYRRNNKEEKFGIYFNAKRHRNRKLVINIDLKDFFHTIEFKRIVGYFTRNNHFKFPIDVAIGIAQIACYKDPKTGKVFLPQGSPVSPIISNLITEILDAKITKLAIQYKFYYSRYADDLTLSFDTKKLPQEIIQSNENNFFLGDKIIKAIKSSGFNINNDKICFRTNFDRQQVTGLVVNKKINIPRNYYNLSKSMAYNFCQFATFEKSSFHTFSKNNSDKGKSIIGIMTYIYNIKNEYNNRTINAEPNIYTDFKMEKPKSPEHLFWSKNSFNRLFLHTYFQEFFVYRKKIHLLCEGKTDPLHFKNYISTLDKKIQNYYEFTAFNEDKLTIFQKELNIRSGTPNLKRFIDIYSTLYVSKLSFLNPTIIIVDNDKAGNEVFQCGVGRYNKTSQHGKTTINKLEVEYAYICKNLFILKLPKILKDTTIEDLYEPSVTSTLLNGKSFTKDNNYDSNLYYGKVELLRNVIKKNKLSINYKNFETMLEAIDRLFLMNLYLNLTNSIK

SEQ ID NO: 1375 - protein, 594 aa, Acinetobacter sp.
  source 1..594: note = Related to NZ_VOZV01000004.1
MSKQLNALKQCQTSRDLAKLLGYSYKGFCYVLYSAPIHTKYRMVTIPKKNSPIGRQILIPSNRLKILQQRLATLLTNIYLEINQNNPSCCYAFIPDSNTQNFGIVENAKQHINKNIVLNIDLKDFFTSITFSRIVGFFTKNIQFRLNYDVAITLAQIACYRASPTSHAYLPQGSPCSPIISNFVGQIIDSKITFLAKKFHFTYSRYADDLTLSFDKNQIDSKILEYDQTTREYKLGKLLEKEILKTNFQINYQKLCVRTKRERQQVTGLVVNKSVNVNKAYYYHTKSMALEYCRNGTFTRSTSHAKKIGQPNFHSLMGYFNYIHYIKRENLKRHQPLQPKIILPELTNNDIQRNKKIPKSLNSFEKMMIKAIFHYRFVHSEKIKILCEGKTDPQYLNLYLKIKKSNCFHPTAFSDHTPTFFQNELNIRSGTQNLKRFISAFQNLYISKNEYQLPTIIMVDPDKDGFDVFNYAKSKSNSYIEIQTNSSIKVAHVFHNLYLISLPQNSSINQQQINSIEDMFDKTLQQQKIGNKTLCLDNKCSGQKHNNHYGKVEYFEHIIKSQNNLSFSNFDRLYEVIENICYLHFFKCFSKTFH

SEQ ID NO: 1376 - protein, 565 aa, Acinetobacter sp.
  source 1..565: note = Related to NZ_FMYO01000016.1; note = Acinetobacter kookii
MSSNLLLLQNCKNRQDLADLLDIDYNQFCYILYAQPISKHYNKALIYKKNGKPREILAPDNHLKYIQQRLAILLAKIYDEVNFRSTQLCYSYRKDSEQKFDFHENAKLHIGSKLVINVDLKDFFTNITFSRIVGYFSKNKNLKINYEVAVTIAQIACYKDPISNKSYLPQGSPCSPIISNFIGTILDDRLFKLANRKKFTYSRYSDDLTFSFNTNSFPSDIVTKIEKNWVLCKTIRNTINLCQFEINEEKIVIRDKYKRQQVTGLTVNKKANINANYYKYTRAMIDKYCKTGLYERSKHHSIGIDFSEKSLIGIANHIKNIKGIKYNHTNIIDKNLEPLQIYQNLKGFSKSYIDLMFHINFVHQSKIKIICEGKTDPQHIYNYLRNTDLFHKNQFDIISFEKHLSSFTQPLNLSGGTDQLCKFIKMYSHLYKSIDKSKYPTIIFVDNDPAGNSTFNTAKSYSTYNEIKILRDSIRVAFVCKNLYIIQSAKHCPGIEYLYPSHVLEEKLEGKTLNLSNDKIKDDSEYGKIVFFHKIIKPLGKKIYLGKFRYLCFGFYQIAQHLKNT

SEQ ID NO: 1377 - protein, 316 aa, Acinetobacter sp.
  source 1..316: note = Related to NZ_CP032279.1
MSSNLQLLKQCQNRQDLANLLILDYKLLCFTLYSQPIHNNYKKAIIYKKNGSPREILAPNKQLKFIQQKLALLLNDIFDEINFRKTQLCYSYRKDSDQKYGFHENAKLHTKSKLVINIDLEDFFTNITFSRIVGFFHKNKNLKINYDICIAIAQIACYRDPNTNDSYLPQGSPCSPIISNFLGTILDERLFKLSKRKKFIYSRYSDDLTFSFTTNSIPQDIAQKNGNIWTLNKTLINTINSCQFKINKDKIIIRDQYQRQQVTGLTVNKKANINKNYYKYTRAMIDKYCKSGLYERSAYHSLGMALLHKDLKYKAP

SEQ ID NO: 1378 - protein, 601 aa, unidentified
  source 1..601: note = Related to NZ_CAJHAW010000011.1; note = Psychrobacter salsus
MSSLQALRKCEDRKDLATILGYSLKQFTAIIYAQSPQYKYNSFTIPKKTGGNRNILAPKSDLKQLQQKLATLLSKCYEEIECNRLTKLPKPVSILSFSSHGFRRKIDNKLSSDKFNFDIYSNAKSHTNKKYVLNLDIKDFFKSITFSRIVGYFVKNRDFLLDVDVSVTIAQIATYRETDSTEGYLPQGSPLSPIISNFIGSVLDIKILRLAKKYKLDYTRYADDITLSTNLKDFPYQIAVHRQDRWIVGLQLEKIIKSSGFEVNKSKTRLYTNNERQEVTSLSVNKKVNIRKEYYRYTRSMVNQYCMTGMYFKSSEHRRANIANDNSLNGILSFIYYIKRDRNLVVDDGYIKYCDMKGLQKLYTKFLFHYNFIYQSRTTVIGEGFTDPRHLRIAYKVIYNAHNTSIKFTYLGNTKRFSHFTGMKGGTGLINKFLSEYQLIDKSIAISKFPCIILLDGDKAGNDVIKMAEKLFNKTIRKINIPKVGIMLFYHVYNNLYILQLDKDVDVEKLYDSNVLQTKVDQRTFNPSNKKTDQTKFYGKKEFLEKVIEPNRSSINFSNFEIVFKTLNHIQLYHLIAYRSEAGLAAKTNLSLISAKSSNTT

SEQ ID NO: 1379 - protein, 586 aa, unidentified
  source 1..586: note = Related to NZ_CAJGZW010000014.1; note = Psychrobacter immobilis
MNKLSNLRSCSDRKGLASLLGFSEKQLTNILYSSNINEKYYKFSIPKKSGGDRRILAPHASLKLLQSNMAILLSQCHDEIENERVTKTAQQSSILSFSSHGFRKALKTDNSLEPFSFNIYSNAKKHINKKYVLNIDIVDFFESITFSRIVGYFHKNRHFLLDIDVAILIAQIATYRPSISVEGYLPQGSPLSPIISNLIGSILDARILRLSQRYKLDYSRYADDITLSTNMKSFPTEIAYLKNDEWVVGSKLKKAIEGSRFTVNKKKTRLYTRNKRQEVTSLTVNKKVNISKKYYRYTRSMVNEYCKTGSYSKSSEHRYTEIDSDNSLNGILSYIYYIKKDRNDIAIDHKFREYEKLVSIEKLYVKFLFHYYFIYPEKMLVVGEGVTDPLHLKVACNQLSKSSRKYIKFSYLGEMARFSKFMRFSGGTGHIHNLLTNYHTIFKAKSLSLKPCIILVDGDKAGNDVVKHAKSLFKERQLVFKGANCIRAYHLDHNLYIIQLNKGKEIEDLYHPDIKKTKIGIREFSSENDSKKLDVTKHYGKKEFYEKIVVEEQDTINFSGFNDVLATLYHIQMYHFILWLFSERKI

SEQ ID NO: 1380 - protein, 592 aa, Acinetobacter sp.
  source 1..592: note = Related to AAYLMD010000006.1; note = Acinetobacter baumannii
MNILEQLKSCTDLNSLATLLGYSPKVFSYILFSKSINYQYEKFEIDKKDGSKRIIHAPKEKLKELQRSLANVLNECYNIIEKNRLNLTNKYQCVLSHGFRNKLVLDLPISNKTNIKLKSKEFIFGITSNAKAHINKKYILNIDLKNFFHSITFGRIVGFFEKNINFNLTKKVAILIAQIATYRDSTNMVGFLPQGSPCSPIISNLISGILDKRLYEFAKENKCTYTRFADDITFSTNIKNFPTNLAILSNEKYTPSNQLIRIIEKTGFLINPTKTRLNTFEDRQVVTGLVVNKKVNVSSNYYRYTKSMVNKYCQEGIYYKSKLHTNEKITTSNSLQGILDFIFNIKKPAFVNPTNYKEFSKLDSIEKLSLKLNFHKNFIHNTETRIICEGVSDPMHFKNAYKSLYKSNKYPFFFKVLTSFNSLVKITGIGNGTGNLKHFLSMYKKINTSKINNINPCIVLVDGDNEGEKVLTAAKKIFDKNCYKELSFFSPFYNLDDFQVLHCEKNLYIVMLPTNFTIEDLYDPIYKTFTLGTRTLKLSNEDLDHTKFYGKTEFFEYVIKPNSHVIDFTNFKKIFEVLFHVQLYNFFHSNLS

SEQ ID NO: 1381 - protein, 586 aa, Acinetobacter sp.
  source 1..586: note = Related to JEWN01000001.1; note = Acinetobacter baumannii
MNDLILLKNCKNLQDLAYLLGYTPRILSYTLFKRSILQPYTKFEIPKKSGGKRVILAPNKDLKKLQSALAELLDSCFNIIEKNRLENTSYTTCILSHGFRSKFKIDIPKSHKNREVLKTIDLKLGIYSNAFKHKNKKYVLNIDLKDFFTSITFNRIVGYFCKNENFLLDKKVAILIAQIATYREIRSSEGFLPQGSPSSPIISNLIAGILDNRLNNLAQRYKCTYTRYADDLTFSTNISTFPTELYDYENKVIGKKLNKIIKDSWFEINPSKTRLTHNQNRQEVTGLTVNKKVNISKNYYRYSRSMIHNFCINGTFTKSKLHNKPLVLNINSLTGITNYIFNIKNPNFEKSRTLRDLEDLSSIEKLYVSFNFHKYFSNNEQPNIICEGITDPLHLKNSWKNLNKDQLEYKITSLEEIKSLHEVMGLSNGVPNMTKFLRQYHKLHKSKYKNPQPCILLLDGDDEGEKLLTNISSSFKQKKSLDFYNFRDPSNSLLRVTHLINNLYIMQLPNGKCIEDIYDPSVLTLTLKGRTYNPSNNSFDTTTYYGKKDLIKKVIIPQKNSINFDSFNIIFDTILHIRLYSFFCSK

SEQ ID NO: 1382 - protein, 623 aa, Acinetobacter sp.
  source 1..623: note = Related to NZ_VTRF01000001.1; note = Acinetobacter baumannii
MKNLENLKSCHTAEDLSTLLDFPYKRFLIILYHGHISSKYSSFEITKKDQSLRSINAPHKELKMIQERLADLLEQCLSEIENDRLKKNLEKFHENSPNKYPKFHLTSHGFRKKLYIDPPYNIHTITPGIFTNAYVHTNKNLVLNIDIKDFFTSIKFNRLVGFFIQNKYFELSEEVAFTIARIATFRKNDDEMGYLPQGSPCSPVISNLFTSMLDSRLVKLCKKNKCVYTRYADDITISTNLKKFPQEILTIINDKVKLNDRLERQFEAFGFNINNKKTRISNRKQRQVVTGLVVNKKVNVNRSYYKATRAMVDNYCKTNTFVKSKYHVFHELKIENSQSLNGILNYIYNIKKVEPYKLIENHDDYLKHHNDFIDKKNWESRLLYHHINTLNGLDKIYASYIFHKKYVYNEKKSIICEGVTDVIHFKKAADKLGITSIKFSSFSPDYQFEKLIHLDGGTDNLKKFLSNLKLLYKSEVSLNLLNPTIIIVDRDDAGKGVIAEAKKLFKNSWHEHSSSTVPNMKFYNFFKKFYIFHLPIVPYDPNKTVIEFLYNNSTLLNDTISINGKTLICEAIATSEQIKKKEVYSKISFIKTIIPKHEPSLDYKYFKQVLDVVDEISKLMKTA

SEQ ID NO: 1383 - protein, 623 aa, Acinetobacter sp.
  source 1..623: note = Related to NZ_BKVP01000163.1; note = Acinetobacter ursingii
MKNLENLKNCENARDLATLLDIPYKRFSIILYRGHISSKYSSFEIKKKDQSLRKIHAPYEYLKILQKKLANLLERCLSEIENDRLAENLSKFQENRPNKYPKFHLASHGFRKKLYIDSPYNVHTITPSIFTNAHTHTNKNLVLNIDIKDFFTSIKFNRLVGFFIQNKYFELSEEVAFTIARIATFRENDDVMGYLPQGSPCSPIISNLFTAMLDSRLVKLCKKNQCLYTRYADDITISTNLKEFPQEILTVVNDKVKLNDRLQRQFEAFGFNINHKKTRISDRKQRQVVTGLVVNKKVNINQSYYKATRAMVDNYCKTNTFVKSKYHVFHEHQIENSQSLNGILNYIYNIKKVEPYKLLNSHDDYLDNHNNLINKRNWENRLLYHHINTLSGLDRMYALFIFHKKYVYDHKISIICEGITDVLHFKKASEKLGINNIRLSSFNSEYQFEKLLHLDGGTDNLKKFLSNLKLIYKSEIPLKDLNPTIIIVDRDKAGKGVIEEARKLFKNSFKEHNSSSVKDMKFYTLFQKFYIFCLPIVSIDSNKTVIEFLYNNRDLLNETMSVNGKPLICEAIATKEQIDQKKVYPKILFIKNILPKYESILDYTYFQQVFDVINEISTLMKTV

SEQ ID NO: 1384 - protein, 623 aa, Acinetobacter sp.
  source 1..623: note = Related to JADVON010000009.1; note = Acinetobacter bereziniae
MKNLENLKNCENARDLATLLDIPYKRFSIILYRHHISSKYSSFEIKKKDQSLRKIHAPYEYLKILQKKLANLLEQCLSEIENDRLTENLAKFNENRPKKYPKFHLTSHGFRKKIYIDSPYEVHTITPGIFTNAYTHTNKNLVLNIDIKDFFSSIKFNRLVGFFIQNKYFELSEEVAFTIVRIATFRENDDEMGYLPQGSPCSPVISNLFASMLDSRLVKLCKKNRCVYTRYADDITISTNLKEFPQDILTIVNDKVILNDRLKRQFDAFGFNVNNKKTRLSSKKQRQVVTGLVVNKKVNINKNYYKATRAMTDSFCKTNTFIKSKYHTFHESEVSNSHSLNGILNYIYNIKKIEPYKLLESHSDYLKHHNELIDKKNWESRLLYHHINTLSGLDKMYALFIFHKKYVYNEKNSIICEGITDVLHFKKAAVKLGVDNLKFSSFHSDYQFEKLLHLDGGTDNLKKFLSNLKLLYKSEVSLKDLNPTIIVVDRDDAGKGVIEEAKKLFKNSLEEYSSSSISTLKFYCIFKKFYIFQLPIVPYDSKKTVIEYLYNNSTLLNETMTINGKTLICEAIATAEQIKKKEVYSKIAFIKNIIPKYESTLDYTYFKQVFDIVDEISTLMKTV

SEQ ID NO: 1385 - protein, 623 aa, Acinetobacter sp.
  source 1..623: note = Related to SJOH01000014.1
MTNLENLKRCETARDLAILLDIPYKRFSIILYRGHISSKYSTFEIKKKDQTSRKISAPYEYLKIVQKKLSVLLEQCLSEIENNRLAETLSKFQENRPNKYPKFHLVSHGFRKKIYIDSPYNFHSITPGIFTNAHIHTNKNLVLNIDIKDFFTSIKFNRLVGFFIQNKYFELSEEVALTIARIATFRENDKVIGYLPQGSPCSPVISNLFTAMLDSRLVKLCKKNKCVYTRYADDITISTNLKEFPEAILTMDENLIVLNERLIRQFETFGFHINNKKTRLANRKQRQVVTGLVVNKKVNINRHYYKATRAMVDSFCKTNTFVKSKYHVFHEPQIEDSQSLNGILNYIYNIKKVEPYKLLEQHDDYLKHHNEFIDKKNWESRLLYHHINTLNGLDKMYGSFIFHKKYVYNDKPSIICEGITDVIHFKKAAEKLGITNIKFSSFNSDYQFEKLLHLDGGTENLKKFLSNLKILYKSEVQLNLLNPTIIIVDRDGAGKGVITEAKKLFKNSWKEHSSTTVPTMKFLALFKKFYIFELPVVPFDPEKTVIEFLYNNSTLLNETMMINGKHLICEAIASKDQIDKKKVYSKISFIKNIIPKHESSLDYTYFKQVFDVIEEISTLMKTI

SEQ ID NO: 1386 - protein, 365 aa, Acinetobacter sp.
  source 1..365: note = Related to SJOG01000001.1
MKNLENLKKCETSKDLAILLNVPYKIFLITLYNGHISSKYSNFEIKKKDNTLRKIKAPIQNLKDIQKKLADLLEYCLSEIENERLKKIQLNFSEHSPNKYPKFHLTSHGFRKKIYIESPYNVHTINLGIFSNASVHTNKNLVLNIDIKDFFSSIKFNRLVGFLIQNKYFELNEEIALTIAQIATFRENDDEVGYLPQGSPCSPVISNLFTAMLDSRLVKLCKKNKCIYTRYADDITISTNLKEFPKEILTIDEDRIVLNERLIRQFETFGFNINNKKTRLANRKQRQVVTGLVVNKKVNINRSYYKATRAMVDSFCKTNTFFKSKYHVFHELQIENSQSLNGILNYIYNIKKVEPYKLLSPHDDY

SEQ ID NO: 1387 - protein, 610 aa, unidentified
  source 1..610: note = Related to NZ_LN776178.1; note = Necropsobacter sp.
MNALSRLKNCNSIADIISSFSLNISPKNFSYILYILSDNDKYKEFTIPKSDSSIRTISCPEPRLKYLQKEFSKIINDCVIEIQHKNPSYLIGNHAFEKYKSIASNAYKHEKQRYILNIDIENFFSSIHYGRVVGFLQNDRYFSLSEKTSKIIAKLATHKGVLPQGSPLSPILASLIGNIVDSRLMKLARKYKLTYTRYADDITFSSNRNFSTDLLTFKDGIWVANKKLISAINHCGFKINHKKTRFSDQNHKRVVTGVIVNEFLNTDKKYRKNTRAMVNSLLSKGEFKILDRDNNEIQGTIEQLIGRLNHSISIKYRDRVLNPRLPRDVRIEVQNKIKENLIKIIQYKENTTFLPKNIGLDKIEKAFNIEKDEAKYLLSFVQKRDDRLIIPDCNIRLLRNVLFYKYFLSMDKPVIITEGKTDALYFKAAMKKLLISNDLYFVKHKKNGELDKLGLTGGTAPINAFFKYVYNDNNFVDFHKINVKPKSPVIFILDYDDGLDKVKNLLKKNFSEGKRFSQIKRNIYILLLNKFGDGEDFKKDNKVCIENLISFDGEKIAVSNERVSFQGKELSKNEFSKIVLEEYERFDFTNFSIVFSEINNIINHFNYNRD

SEQ ID NO: 1388 - protein, 617 aa, Pasteurella sp.
  source 1..617: note = Related to PPWW01000004.1; note = Pasteurella multocida
MSTLNKLRKCDSIEDLISSFSLKITASQFSYIVYRVQDSDKYHQFTIPKSDGTTRIISSPHKTLKYLQKEFSKIFMQCITEIQQKHPSYLAKNHAFEKYKSIASNASLHKRQKYLLNIDIKDFFSSIHYGRIIGFLKKDKYFCLSDRTAKIIAKLATYDGVLPQGSPLSPILASLIGNIIDTRLSMIARKYHLVYTRYADDITFSSNRDFSKYLLDNKNNIWHPNNKLISAINKCGFSINIKKTRYINRYHKQVVTGIIVNHSLNVDKKYKKHSRAMVNNLLRTSQFQIHKGYNYKYTGNIDQLIGRLNHAISIKYRDRILNLNLLSEIRKYIQFSIKRNLINIIKYNGRTDKIKKHIGIDRLERTFDINNEQVKKYLTFIQKKDDTLYPSDNQIKLLRNVLFYKYFIGIESTYIFTEGKTDHIYLKYAFQALNFTKNVKIIKHNSNLEKLGLSGGTEPINQFIGRAYTDNFYVDFDKINIKPKHPVIFLLDYDDGLKKIESYIKRCFKTGDQFAHIKENIYILLLEKLTPQQDKYNYTEKNKQTCIENLIHYNDSKIMISSNNHDCVIFDGKEISKNDFSIKVRENKNSFDFNNFSSLITAIRDIENHFKTKVKLD

SEQ ID NO: 1389 - protein, 613 aa, unidentified
  source 1..613: note = Related to NZ_CP031477.1; note = Haemophilus parainfluenzae
MNTLSKLQKCNSIDELISSFSLNITPKKFSYILYVLQDNQKYKDFTIPKSGGGIRTISCPEPTLKYLQKEFNKIFISCIDEIKQINPSYLISNHAFEKYKSIASNAYKHKNKKYILNIDIKDFFSSIHYGRIIGFLQKDRYLKLSEKTAKIIAKLATYNGTLPQGSPLSPILASLIGNIIDARLLKLAKKYKLTYTRYADDITFSSNLDFSSFLLEKENNIWVPNKNLISAVESLGFKINNKKTRYTDKYHKQIVTGLVVNKFVNTDKNYKKKTRAMVYQLFKIGEFKLTGKNKDTITGSIDQLIGRLNHSISIKYKDRILNPFLLNNVRSEVKNKLRDNLINIIQYRGESNLLPKDVGINKLEESIFIEIEEAKKLLSFNKNKNDKLIIPDDSIKQLRNVLFYKYFISFAMNGPVIITEGKTDFFYFKAAMKSLSMNNNFKFIRQNNRSLEKLGLSGGTDPINKFIKNVYHDEKFVNFSKLKVRPKYPVIFILDYDDGLDKVSHIIKEKFKDGTQFAQIKENIYILLLKKITLNSSGKMDYTNEPSKVCIENLILLNGNKINVINDEVDYEGTRTSKSCFAKEVSSNLEKFDFSEFKNIFDKIEDIVTHFHT

SEQ ID NO: 1390 - protein, 614 aa, unidentified
  source 1..614: note = Related to NZ_CP072548.1; note = Aggregatibacter sp.
MNLQKLRNCQSIEDLISSFSIKTTPRKFAYVVYKIPDNQKYIEFEIKKANGSLRKIAAPNSTLKYLQKLFADIILNCVLEIQQKDKNFLVTNHGFEKHKSIISNARIHQGKKYLLNLDIKDFFESIHFGRIKGFLSNDQHFLLHNKTAEIIATLATYGERKTLPQGSPLSPILSVLIGSILDANLMKIANKYNLSYTRYADDITFSSNKDFSKFLLRKDQNGNWQLKGKFEKYINKVGFHINKEKTRYTNINNKQIVTGLIVNKFTNTDQRYRKQSRAMVHKLFQTGTFTPDSKNDGRLYNEDYLIGRIYHSISVKYREIVINPNLLTNDINIINKEINKKISNLIRYDKVCAPDYKPNYTANDILNKLTPPFTDGLIESLSKSLVKRNMPIDSDNQIKLLRDILFFKYFVNINSPVIIPEGHTDSKYLKIAMKMLNINIDLKFYNINPSLDKLGLNGGTAKINSFIQNCYSDNNFVSFNKLKIKSKHPIIFILDYDEGLKSCDEILKYFKDGSNYARIKENIFVILLNKYKILEDKKKKDFNIKDHQVCIENLISHNSQRINVDKDNHDKVSFNNELISKSKFSELVENNTHLFQFLNFSTIFDTIKKIIHEY

SEQ ID NO: 1391 - protein, 582 aa, unidentified
  source 1..582: note = Related to MLHL01000009.1; note = Rodentibacter trehalosifermentans
MAKYIDRLRKCTCIADLVSEFKLKVTAKEFGYVVYHLSDDLKYEEFDIPKKNGTLRRIHSPKPTLKYIQKEFSLIIFNCINEIRLDNANYLACNHAFERDKSILSNADLHKNKKFILNIDIKDFFDSIHYGRIKGFLANDSHFKLNEKVSQIIARLATYHKILPQGSPLSPILATLIGNIMDVRFLKLAKKYRFTYSRYADDITLSSNKAFDKNIVYWCENNKKWVAGEIVINILTDSGFTINSEKTRVSYSNDRQTVTGIVVNKQRNVTLEYRRTNRSMVYSLLSTGSFRLNDNVGKITQLMGRLNHSIYIKYYDSKFSIPLDMNERIKYKEKKQKELIKIINDNWKSDKNNITCADHQMKLLRSVIYFKYIINVDQTTIFPEGFTDPIYFSSAKEKLNINSNIKFQKINNGLKKIGLLGCASSVNTFIHNVKEKIDKFISYKQIGVIPKHPVIFILDYDDGLDDCRFILDKIQIDQQYVFIRDNIYVLLLEPKGKSKNHHKTIENMSCIENLISFEGNRIEAVQGKKEYINFKGIEFKKGSFANYVKEHSSDFDYSGFDKIFKKITEIEEDYAKRMITNA

SEQ ID NO: 1392 - protein, 597 aa, unidentified
  source 1..597: note = Related to VSFH01000001.1; note = Lonepinella koalarum
MEVFISMSSYLEKLKSCTSISDLISEFELNITPQQFSYIVYKVEDSKKYQTFTILKKSGDDRIIQKPHNSLKEIQKSIANILMHCVDDIRKDKPNYLKCSHAFEWGKSIVSNSEIHINKKFVLNIDIADFFDSIHYGRIKGFFVSDYYFSLNETIARVIAKVATCNGTLPQGSPLSPIISSLIGNLIDIKFLELAKKYRFTYSRYADDITLSSNKELSDELVIWDRENNVWKVTNTIESLLNRKSGFKINEKKTRYNRFSSRQLVTGIVVNKEKNVVREYKKQNRSMVNSLLNTGEFFIKDISDEHIKGTIEQLIGRLNYCIYVKYYKPNNLTKLDLDSKIDNKEDNRKNIRKMVSLRIDKNDENFPLQKPDHQMYLLRSVLFFKYFTNITQTTIYPEGYTDPMYFSIATEKLNKKGLFYFQKINDSLKKLGLSGGASSVNYFISKFVEHSYFIRFSSIVPTHPAIFVLDYDNGLDGCQYILNSKRFGFIKKKNIQFSHIKDNVYVLLLSPISNEKSWKKKENYKCIENFITYQGKIIQVSDEEGEYVSFKDDKIKKYNFAQYIMNKPDEFSFSEFSNLFDQISLIESDYKERLAMK

SEQ ID NO: 1393 - protein, 590 aa, unidentified
  source 1..590: note = Related to NZ_JTLX01000008.1; note = Haemophilus haemolyticus
MNKTTIDRLRSCTSIADLISEFQLKISPSKFSYIVYCLRDEDKYTKFEIPKKSGGVRIIHSPKDSLKYIQREVATILLNCIDDIKLSNPNYLRCNHAFEKDKSIVSNANLHEHKRFVLNIDIKNFFSSIHYGRIKGFLISDANFLLNEKVGQIIAKLATYNGYLPQGAPTSPILASLIGNILDIRLLKLAKEYRFSYSRYADDITLSSNQELPNELIYWEKEENIWIAGNKITKVIKKCGFELNPLKTRYIRNTNRQIVTGIVVNKKRNVVSLYRKINRAMTYSLLSTGQYTIRDVSGLLSNGTINQLIGRISHCIYVKYHNPPMIHPLNSQRADLRKKNSERVTKIISDNWNRDSKSNINYYSDHQTMLLRSVLFFKYFISNERTTIIPEGFTDPIYFKTALSSLEINLNLHFQKLNRELKKIGIYGGASFVNSFLCNIETEKKGFISYGMIKQTPQKPVIFILDYDSGLEDCKYLLSKMKDGEQYINITDNIYILLLRVKHNKDHKNINNHIYTERLISYQGNKIQAKDDNHEYILFKNEEYKKYNFAKYISQHKDEFNFDSFKDIFDKIKEIEDDYQAKLATKNIKL

SEQ ID NO: 1394 - protein, 586 aa, unidentified
  source 1..586: note = Related to JQHF01000020.1; note = Neisseria mucosa
MTLYLEKLKKCNSISDFIREFNLGLSAKQFGYIIYGLPDHKKYDSFEILKSNGDLRTIHAPKKSLKFLQKQFASIFLQSILDIQKQNHHYLRCNHAFEKNKSIISNARHHQKKKFLLNIDISDFFGSIHYGRIKNFLINDKYFSMTEKGASIIAKLAVYQGKLPQGSPLSPILATLIGNLIDVRLTQIAKKYRLTYTRYADDISFSSNFPLPEKLVYWDDSQQIWVAGKILEKVILKTGFLINPKKTRYTTIPFRQLVTGIVVNIHTNSPSPYKKQNRAMVNSLLKTGKFYIEKNGIQTKGTLNQLIGRLNHTIYAKYHKPTTDIKLDQEEREKFKEENRNYIIEILSKKWHKGKSSYSEADHQTKLLRNVLFYKYFNSLDKTKIFTEGVTDSIYFQIAAEKFNLKDDLSFQKTNISLKKLGLKGGVPTIKSFFKNIKDNNFINLKQFKTNSEYPAIFILDYDQGLDGCPEIIEKFSNGRQYCHITRNIYVLLLKPYNGKGDYKKNKICIENLIRYEGGQIEVDGAKNENVCWNNSLISKMAFSKYISNHKTDFDFTEFKKIFNLIQDIERDYFRRLTQAQAQDEW

SEQ ID NO: 1395 - protein, 591 aa, unidentified
  source 1..591: note = Related to CP091516.1; note = Kingella potus
MFNHLIKLKLCNNGIDVVNNFHNYLGISVKDFWYIAYSLNHFSQFTSFTILKASGGERTILIPPQPLKDLQKKFATILNFCIREIQQENPNYLICNHAFEIKKSILTNAQIHRNKRYVLNIDLSDFFGSIHYGRISNFFKADKYFRLNDKVAKTLAQLACFRDENNKTFLPQGSPLSPIIASLIGNLLDIRLVKISKEYKLTYSRYADDLTFSSNKPIPEDLVRWNSENFIWEAGDRLRRVIEDSGFKINDKKTRLFSAKKRQTVTGITVNKTLNISEYYQKHNRAMLYSLFTSGKFLIGDKEGTINQLIGRLNYVASVKYLKQHHDMSIQEWEEERKKFAYLCAGNFDNKENSNRSIRLLRQAIFYKYFIGNNKPIIFPEGITDSIYFKLANKILNPNEHKENYIIQSINSELTKISLGGGTALINSFLLHAYKDYFINLKNLKIKSKHPVIFVLDYDQGLDVKDKNEKSKNNIPETHHMKDGQQWVHIRENIYLVLLRPLALENKKPTFRNALEMTCVENLLSHVSIGKIKVDDENHENIKFRNRSYPKTVFAKYVAKRSTHFDFSEFKKIFEIIDEIKKHFYQNSISI

SEQ ID NO: 1396 - protein, 619 aa, unidentified
  source 1..619: note = Related to NZ_CP042408.1; note = Lactococcus lactis
MKEKLSKLKKCTTRIDFLNILFPGEGSKNEYLKVIFSVPDEKKYSTFKIPKKSGGTREILAPKEDLKKIQKKLGDFLSDCYQELYGDKNNYSNAYLKEKSIITNAKKHRNKRYVLNIDLENFFPSITFGRVRNYFIKNKYFELTEEIATLIAKIACYKGILPQGSPCSPIISNFICQILDIRLGKLASKNKCHYSRYADDITFSTNLMMFPENIAHWNGDKIIVGQELGSEVTRAGFNCQHSKTRIYGKDKRQEVTSLTVNRKVNVSRKYFDSTKAMARKYYLTGTCEINGQEATYKQILGRFNYINQLEKYNNKIFFKQNEAKEPENIFTPANEKPLETNQKDSVIAPVQLTYNSKYHTFAVNGSKEKELGKYGYKVGYDYLSAREQAYSKFLYYSTFIANQKPIILTEGKTDILYLKAAIKNLYLEFPNLVEKVQDKFNFKISFYNYSKLNRYLLNIIPSGGGILRVLSPQYLFPSDSLISKHPTILLLDNEEKKGKPLARLLGNGKLKKEIVKKDFASLDKTKITLKESDELFNRVKGVDKFFLLTIPRIESDKESDIENLFTEDFIKEQEFDKESKGAKNELSKIVSRDYKKIDFTNFKPLLENLTNIIRANDNK

SEQ ID NO: 1397 - protein, 450 aa, unidentified
  source 1..450: note = Related to NZ_CM001979.1; note = Dickeya sp.
MPIAPQLTIVKNKTKTMSKNNKLSELKSAKNITDLAKIISVPRQSITYVLYGINRLNLAKYHTFKIPKKDGSERTINAPVKELKDIQKKVSSLLQECFRIVCILEGHRNHLKKINSLSHGFIKGKSIITNATPHKNKRFVLNVDLKDFFGQIHYGRVYGFFKNNKHFQLSDEVAKVLANITCYQQGLPQGAPTSPVISNLIAGILDIKLASLAKKYSCYYTRYADDLTFSTNLKEFPPRIASIENGDVRIGSSLEGIIKKCGFDINHKKNRLQFCNSRQDVTGIVVNKKVNVPYDYRNKARVIWHKLKNGKEIYAINSQPEIKKDINYLIGILSHIHNVRREHRVTTKEEYIIPKKPNKKTFDDIFDADSRMYRDVLFFKNFVKNKKPVIVCEGKTDITYLQCALESQAAKHRSLIIKKELQISFFRPTKTISELFKVTGGTGDIGNLIS

SEQ ID NO: 1398 - protein, 576 aa, unidentified
  source 1..576: note = Related to CP011427.1; note = Pantoea vagans
MSKNNKLSLLKSANNTKDLAEVLSVPFQAITYAIYGINRLRLPKYTTFTIPKKDGTARRINVPVKDLKDIQKKVAALLQECFRIICILEGHRDHDKEITSISHGFIKGKSIITNAIPHKNSRYVLNLDLKDFFGQIHFGRVYGFFKNNKHFELEDEVAKALANICCYQSGLPQGAPTSPIVSNLIAGILDIRLASLAKKHSCFYTRYADDLTFSTNLKEFPKELAIFENGNVTIGTSLNKVIDKCGFEVNVKKNRLQFCDSRQDVTGLIVNKKVNVPSDYRNRARVIWHKMKSGKEIYAINAKPEKKENINYVTGILGHIHNVRREHRITTATEYVIPKKPTKALMDSIFDADSRMYRDMLFFKNFVSGKKPLIVCEGKTDIVYLKCALHSQAAKHRSLILSKELKVDFFRPSKTIGELFRVTGGTGDIGNLISNYSSYCDEFKRFSLPQPVIILIDNDSGAPSVRSLVSQITKSKFDNTDTFTHIIKNLYILQTPLVMGGDSAIEDFFDAKTLNEKLGKKSFSYKGNFDSSKHYGKNHFAEYVVKVKKNSIEFKGFNVLFDSIKAIIKDYKSKPH

SEQ ID NO: 1399 - protein, 577 aa, Salmonella sp.
  source 1..577: note = Related to ABDODY010000002.1; note = Salmonella enterica
MSTNSKLKELQEARSLEDLASILSTPLQLLTYVLHGRHHHGLVNYKSFNIIKKSGGIRTINAPIDELKSIQKKLSTVLQDCQKTINILEGHRTHDKKLVTIAHGFIKGKSIITNAEPHRNRKFVLNIDLQDFFDSIHYGRIYGFLVNNKHFKLNENIARAITNLACHDGKLPQGAPTSPIISNLIAGILDIRLAALAYKHKLHYTRYADDITLSTNLNEFPSSIAYIDNAHVVIGNKLRTSIEKQGFSINPQKSRLQFKNSRQDVTGLIVNKKINVKNEYRNRARVLWNKIQNGKEIYAIGSEPEKTKNINYLVGVLSYIYHVRNSNLVRNGIPSITHKKPTKKEIDSTLDANARMYRDVLFFKYFIANKKPIIICEGKTDIIYIRSALLSLARKHRSLIDKKEAKIDFLRVSKTIKELFKISGGTGDIGNLISNYSSYCEHFKRFSPMAPVIILIDNDSGAAPLRSLIKEITKTPFKKEDDYKYIINNLYIIQTPSIDGKDSAIEDLFDKKILQTKLDGKSFIHKQSTFDIKKHYGKNHFAEYVVRQHQKEIDFSRFNLLFDSIKKIIKDYKSKPH

SEQ ID NO: 1400 - protein, 577 aa, Enterobacter sp.
  source 1..577: note = Related to JAJKGJ010000001.1; note = Enterobacter hormaechei
MSTNNKLKELQDAKTLEDLATLLAIPLQMLTYVLHGRYKLKLENYRSFTLTKKNGGERLINAPINELKTIQRKLSILLQDCQRIISILEGHRTHQKEIKSIAHGFIKGKSIISNATPHRNKKFVLNTDLQDFFGSIHYGRVYGFFLTNKHFQLNEDVARAIANLACHEGKLPQGAPTSPVISNLIAGILDIKLSTLAYKHKLYYTRYADDLTFSTNQKEFPSSIAYEEEGIVVIGHALNSIIQKHGFEINASKNRLQYKNSRQDVTGLIVNTKINVKNEYRNRVRVLWHKIQNGKEIHAIQGDKDDKKNINYLVGVLSYIYQVRKSNKTRTNTITNLGKKPQKKEIDSILDADERMYRDVLVFKNFITNAKPLIICEGKTDITYLRSALLSLSNKHRSLIEKKEIKVDFLRITATIQELFKISGGTGDIGNLISNYSSYCDHFKRFTPASPVIILIDNDSGAAPLRSLIKEITKTPFTRETEYAHIINNLYIIQTPLIDGKDSAIEDLFESKTLNTKLEGKTFVYNKANFDTKKHYGKNHFAEYVIRQSRKDINFNGFNPLFESVKKIIKDHKKKPH

SEQ ID NO: 1401 - protein, 578 aa, unidentified
  source 1..578: note = Related to LR134155.1; note = Serratia rubidaea
MSHSDKLSKLKNAKTLQDLADVINVPLQSLTYALHGMHRLGINKYNSFPIPKKSGGVRIINSPVKELKDVQKKLSQTLYDCYNEMLIVSGYRGLDKKGITISHGFIKNKSIITNAECHRNRRFILNLDLEDFFGSIHYGRVYGFFKTNKHFGLHDLIAHALANLVCYTHGLPQGAPTSPLASNFIAHILDIRLASLSKKHGLYYTRYADDLTFSTNKKIFPADIAYLEAGKTVIGFELNKIINKHGFSVNSAKTRLQFNDSRQDVTGLIVNKKVNIRKEYVRAARILANKLFNNKVIYRIESKKTEDDICDINYLIGVMAFIYNVRQSQLIRVSGDKSAELKNFTKKDIDSSLDANARLYRDLIFFKKFIVSDEPLIICEGKTDVIYLRTAMLSLSAKHRSLVTKGRVNVAFLNHTQTIKELFKIRGGTGDLGNLISNYSSYCGKFARFKPKSPVIIIMDNDSGAPKIRSLVKAITGKVYDKNDGFRHLTNNLYLIQTPPLAGGADSAIEDLFDKKTLDVRLSNKKFSYKGEFIKSKHYGKNHFAEYVVKPRRKDIDFNGFNPLLDEIKAVIKHYKKS

SEQ ID NO: 1402 - protein, 588 aa, unidentified
  source 1..588: note = Related to NZ_CTIT01000003.1; note = Yersinia enterocolitica
MSSADKFLKLKQATTLSELAEILGYKHNSLSYILYGKFRLGLSNYSTFSIPKKNGGYRTISSPAPELMELQRRVSDLLHDCFVQIQIINGFRYRNKNIKTISHGFMRGKSIVTNAETHKKKKFVLNIDIENFFDSIHFGRIYGYFLSNKNFELNPTIAKILANIVCHNGSLPQGAPTSPIISNLVAHILDIKLAKIAQENSCQYTRYVDDLTFSTNKNIFPIGLGTIDEKHDCKINEKLIGLIKHSGFTINNKKTRVQYKDSRQEVTGLIVNKKVNVKSEYRNKARILVNKLYSNKEVYKINSTTNEPATIEYIQGVLNYIYQVRLHNSIKHTENILESQRKKCVSKEQIDTTLDADARMYRDFLFFKNFVINNSPLIICEGKTDVIYLRAAISVLSKEFPNLSNSDNGHQLSFFNNTNTTSQLFKINGGTGDLRNLISNYKKYFTKFERFTPESPVIILIDNDSGSATIRSILKEVTKKEFTKKDNFIHIEKNLYVMQTPLQKNQTESEMEDFFTKETLSLKLKNKSFCYKGEFNKNSHYGKNHFAEYVIKPQKKTINFSNFKVIFDIINLICDDYKQKIKNPIKTR

SEQ ID NO: 1403 - protein, 651 aa, unidentified
  source 1..651: note = Methanobacteriaceae archaeon; note = Related to JAIBBO010000111.1
MSWFCQSIGSSFVTFFSQKLFNKLELLLQSFQSFSQLLTGIKNMSENDLERLRNCKDLQDFSKLIGYKKTKNLSYIIYKIPENLRYNEFKIKKKNSEFRIIHAPVEKLKTVQSRLSSLLQNCYDLISVDLKSKEILSHGFIRGRSIITNALIHKNKRFVFNIDIENFFGSINFGRVRGFFIKNRYFKLNENIATIIAKIACHNNSLPQGSPCSPIISNLIASILDIYLFKLCKKYKLYYSRYVDDLTISTNLNYFPENIAYKNPSSKNEWVIGNELTKIFERVNFKFNFKKTRMQLKNSRQEVTGLIVNKKVNVKYEYKKKVRAMIHNLFMNGKIFIKKEDKEKNVEVEKKINSLHGMIQFIGHIIEYQLETFNLSKVDKKNENAISNMNYWLKMYENFIIYKYFYGIKAPTIITEGKTDTIYLKCAIERLNFQFCTNSFSSLSKAICFHPHTHRNNFQNKIKNKDNYKKSFDKKLKRKPVFLGGNSGATFLMKNYIPNNKLFKNADKILSAPLIYIIDNDESGKKSLNNFLSNKKFINHRLNDNTCFVGLNLYIIKLPQISSENNDYEIEDYFDTDTLSSIIDGKSFNKSNDSFDIKDVYFGKMDFALKIIKNNKNNIDFSKFNKLLDEINFVIQDFYNNKRHQNSLVSN

SEQ ID NO: 1404 - protein, 557 aa, unidentified
  source 1..557: note = Related to SAXY01000032.1; note = Brachyspira pilosicoli
MFLIFENMYKKEEIERAVKKLEELVNCKSKKDFSDWLDIRLKTIYYILLINKEPLYNEFTIPKKNGSMRNISAPNEHLKRIQHNLKKNLDMCYIAITHNNFNKRLAHGFIRKKSIITNSQYHKNKRYVLNIDLKDFFPSINFGRVRGFFIKNKYFQLNEDIATLIAQIACHNNQLPQGSPCSPIISNLLALSLDKYLFSLSKKYRFTYTRYADDITISTNLREFPKGIAYFDEYEEKWFLGNKIIEVINNNHFDINFEKIRMQYKTSRQEVTGLITNKKVNIKRSYIRATRAMLDHLVLYPSSDDYISRRKIVEGRIAFIHQIRKINIENNRDLSLKMLENFFCFDNFINNNNITILVEGITDKIYIKSAFKYFKSEYKFKLKIITKNPFSRTNSQKNSGEGSLNQLLSRFKETKFLDRINMFLKRSKLVKPKNPIIIIFDRDNKKFVNDFEQKNAQYLFLEPNVYYFPIPELPDKKYISIEYYFSDEVLNTPFKGHKLELDIQNKDKKIFYKIGEKGLSKNKFAIHIVRKLAESEFINFKKIFDIINEINIDYKNK

SEQ ID NO: 1405 - protein, 563 aa, unidentified
  source 1..563: note = Related to NZ_SAXU01000001.1; note = Brachyspira aalborgi
MDTLDKLKNCKSKFGLSKIIGIKLKKITYILFVKKYNLYTEFQIPKNNGKFRNISAPNKYLKIIQKKLKKVLEECYNEIQLNKNASHGFLKKKSIYTNSNFHKNKRYVLNIDLKDFFPSINFGRVRGFFIKNKNFQLNEEVATLIAQISCYNNQLPQGSPSSPIISNLIAISLDKGLSILSKKYKFNYTRYADDITISTNLKNFPIAIAYKDDDGNWKLGSEIIKMINNNHFDINFDKVRMQYKSSRQEVTGLIVNKKVNVKRNYIRKTRLMLYNLIKNPNSDDYQSIRNCIEGRIAFIYQIRKMNFENNKRDIAKKMKDMFFYFDKIINNQKITIITEGKTDKVYLSSAYSHFKEYYKLNFQIITKIPYTKHDSNNINNTGDQTLMNFVKELKEKNNIKPYKYLLEKSKIKNPKNPVIVIFDRDRINIIKEFEKNIKNENCKFVFFEPNIYYFVLPKLIGKEYLSIEYYFPNKILNKKIKGKNLSLCQEKHKKHIIYKIDENNDGLSKNEFSKYIKKLRYNTKRDNILNEKNKKYFDNFKSIFDIINDIRKDYKNKLQNINK

SEQ ID NO: 1406 - protein, 578 aa, unidentified
  source 1..578: note = Related to NZ_CP019600.1; note = Brachyspira hyodysenteriae
MILEKLQNCQDKKDLALLLKCDLQNLSRILFKDFNNNYSIFFIDKKDGGKREILAPKKDLKIIQKKLSKILEECYIEISEKNNKINFNSINGFITGKSIITNAKKHTNKRYVLNIDLKDFFPSITFNRIVGFLKKNKYFKLEHDVAMLIAQIACHKGSLPQGSPSSPIISNLIMLSLDKEINILAKKHGLTYSRYADDITLSTNKKNFPNEIASGNGIEWNIHKKLETLINNYKFNINHKKIRMQYKTSRQEVTGIIVNKKVNVNRKYIRNVKAMLNKSIINHSMENYEYFKLSLRGKIDFIYQVRKLYMENDKSNEKDLISKIFNNFLYFNHFINNNKVTILTEGKTDKIYIDTAFSHFKNEYNYQINILKQSDMFTNITKLNGINNLVNFIKSYDSKNGIINKLINKSNIHIPKKPVIIIIDSDEPTKSKALELLDNKNGFIFKEPNLYCFQLPEIKDKKFFSIEYYFPERIRNYENNGKKLGENTKNKYNNKETIYKIEDGGNNLSKSYFSNYIKTLKHKEISDKKNKTKEDIDNIKRINEVNKNSFEEFKKIFNKIDEIINDYKKICNSKTSEQ

SEQ ID NO: 1407 - protein, 557 aa, unidentified
  source 1..557: note = Related to SAXX01000003.1; note = Brachyspira aalborgi
MNLEKLKECKSKYDLANLLKYSLQSLSCILFKDIDSNYSMFYIDKKDGTKREILAPNEKLKKVQKNLSKILCKSYECINKNPKAVHGFIEKKSIITNAKMHKNKRYVLNIDLKDFFPSITFNRIVGFFKKNKHFQLEHEVAILIAQILCHKGKLPQGSPSSPIMSNLIMLSLDKELNILSKKYGLIYTRYADDITFSTNKRKFPKEIAYSINNVDWNVSKILERLINNYHFEINHNKTRMQYRTSRQETTGIVVNKKVNVSRTYIRNIRAMLNKMICNYTMDEYDSFKSSIKGRIDFIYQVRKDYIDLKDKKNYEKDLIVKLFNKYFYFDKFVNNSNVTILTEGKTDKVYIDVAFSHFKNEYNYDIDIVRHSDMFLNITKLNGIKKLKGFIDNYKDKYKQEIVPLLKKSKIENSKYPVVIIIDSDEIEFLKQLKLFDDKYNLKNKYIFKKPNLYCFHLPQLDDKEFFSIEYYFQENIRNKYINGKRLRDIIEKENIYKIDDKSLTKSKFSQYIRKLRYDNEKKTDINSNNKKIFSEFKKIFDLIDEILKDYNTRIQK

SEQ ID NO: 1408 - protein, 565 aa, Desulfovibrio sp.
  source 1..565: note = Related to NZ_VOIQ01000010.1
MYGLHGGPNGQYTDFTIKKRNGTDRNISAPTTALKAIQRSLAIRLSGVYEPKKAAYGYIKKSDNNQDKTVFGNALVHSKKRYVFNVDLKDFFPSIHFGRVMGLFRSNPYKLDRSIAILIAKIACYNDFLPQGSPCSPIISNMICSHMDRDLSDLAKNYRCYYTRYVDDITFSTNVKDFPEDIAFFDGIWNPGEGLVEIIDDHGFKINGEKTSLRTQSDRQIVTGLTVNDFPNVRKRSINQVRAMLHDWKVNGLELAYTKYIEKYDTRNNQHEEEDKTVFGKIIKGKLEWIGSVKDKRFEINEKHKGNKAKLNRLGYSKNLLERQSYKKYIERLKHLTINESDMVTVLGEGQTDWMHLKTAYKRLCSDPELSFPIYFYPHSRKEKGGEDNLWTFCSTAKDHYVTYRHPVVCVFDCDLERINNKHKGKKFIDHGNNVFSILLQKPEGSIYEKYAIEQIYDLHDMLKTDEYGRRLYLSSEFDGNSVHKMNPNIFSKKKTSNDEKIVDNEVFLRKKDGTEKSIALSKTNFAVSIARGIQPFRTMNFSGFMPTFLRIKEIYQLHISDSSH

SEQ ID NO: 1409 - protein, 399 aa, unidentified
  source 1..399: note = Related to NZ_JONL01000015.1; note = Maridesulfovibrio frigidus
MTRINNLSRFQQISTLNQLALFLGFKPKDFSYILYRLSDGPNGQYTEFAIKKRNGKDRTIAAPHTALKTIQRSLTSKLEGIYDPKKAAYGYIKETPHNKDKTVFGNALVHSKKRYVFNIDLCDFFPTIHFGRVMGLFQSNPYKLKRNIAILLAKIACYNDCLPQGSPCSPIISNMICSHMDRELSDLAKAYGCYYSRYADDMTFSTNIIEFPRDIAFRDENWKPGEGLIEIIDKNGFEINSEKTTLRTQADRQIVTGLIVNDFPNIRKRSINQVRAMLHDWKLNGMEAAYEKFINYHDTRNSENKEDSTELFSMVVRGKLEWIRSVKDKRFNIQEIQNKAKSKQNRLSYSSRLLEKQSYKKYFNRYKHLRINESDMLTVLGEGQTDWRHFKNAYEVLYR

SEQ ID NO: 1410 - protein, 351 aa, Leptospira sp.
  source 1..351: note = Related to NZ_RQGA01000001.1; note = Leptospira perdikensis
MELKLNRTDEEILALFKSLNSVETVANILEVSPKILNYYTFKSENYQKFFIRKKNGKPRTIYSPNTNIKILQQKLLYIFNLLYKPNQYAYGYIKERNIVDNANKHLKKKFILNVDLSDYFPSITYRRVIGYLVKNLKIENTAARIITKLICVEDEKNTFLPQGGVTSPLISNFISENLDKDLSYYLKRFRCEYTRYADDLTISSEDLKFPDKIAVEDQFRQVWLHNDFERIIKKNGFEVNYEKIRLRKPNQRQTVTGLIVNGSKPNVKRSYIRNLRSILYNWETKGYTHIQTAYELKYRKFDNAEFKPIPKIENVIDGKLNFLSMVKGKDDEIYLKLKKRFLKLKATLDDV

SEQ ID NO: 1411 - protein, 347 aa, Leptospira sp.
  source 1..347: note = Related to JACCKC010000006.1; note = Leptospira yasudae
MKLELVKTNEEIIECFYSLRTKSDVADLLEIPIEVLNYYLYISSNYTIFTIPKRDGSPRVIYSPITPIKILQRKLLYVFNLIYEPDDNSFGFIKNRSIVQNAARHQNKKYVLNIDLKDYFPNITFGRILGYLKKNLMLGDEASVIITKLACVETEENTFLPPGSPLSPILSNMISRKLDVEISNFVKKYDCTYSRYADDISISTDRIVFPEQVAIRDLYGDIWLNAKFVKVISDNDFNINYRKVRLRSNKQRQEVTGLIVNGVRPNVKREYIRNLRAMIFDWEKNGLENAQSNFEINYWKPKDSDFKQIPRIENVIDGKLNFLSMVRGKDDLLYQKLKTKYDKLVSI

SEQ ID NO: 1412 - protein, 571 aa, Bacillus sp.
  source 1..571: note = Related to LITP01000001.1
MKNKFKRLVDFEDVALLLEIPTEFLWKILIRDKQINYTSFPLGKKSGGFRTIYSPSKNLAILQAKLAYILSLNFTPHNRAHGFIEKRSIVTNASEHLKKSFVLNIDLENFFESISFARVRKMFISYFKLGETVATTLANICIHPGGFLPQGAATSPIVSNILAKSLDKELKQLSIESKGVKYTRYADDITFSTNKRVFPRSIASLNEDGQVELSERLMQIIKKNGFNVNGKKVRMQDSKKNQSVTGITVNEKLNISRTYIRRIRSILNCIEKNIDDLDRAREVFERKYPFRQRAKENYPEMFSVLRGMINHVGHVKGKSDPVYLKLANRFNDVSPEHKVIKSVDKQSSKRKMYEDYTYVIEQENPVVAFASEQRNEFEHVYHNQGTGFLLKGFGLVTNAHVLKDLVDAIELEMVILEPYYVRVFKSNDINVHMMRIECYDIEKDIAILRSNSVDHNTEGFNYNELIQKEQLIDLVGYPDYRRGQEIRVDNGFVRGIRMHTDSSDKTTAHKRYEITPTIYGGNSGGPIVNEKGEVIAVAVKGATMNGVVPNEVIPISEVIELAKRQLFSHSL

SEQ ID NO: 1413 - protein, 551 aa, unidentified
  source 1..551: note = Related to JABMKX010000008.1; note = Paenibacillus tritici
MEIPTEFLWKILIRDKSNNYTSFPISKKSGGYRTIHSPSSNLAILQKKLAYVLSLQFNPHNRAHGFIEKRSIVTNASEHLKKSFVLNIDLENFFESISFARVRKMFASYFKLSGVVATTLANICSHPEGFLPQGAATSPIISNIIAKSLDKELKQLSVESKGVKYTRYADDITFSTNKKDFPRNIAFLNEDSHVVLSEKLLRIIENNGFNVNEQKIRLQDRQSNQSVTGIVVNEKLNVSRTYIRRIRSILNCIEKNNNDLDAAREIFIRRYPFRQRAKVNQPEMFSVLRGMINHVGHVKGKSDPVYLKLANRFNSVSPEQKVIKSVEKQINKRKMYEDYTFVIEQEKPVVALVSKESTEFEHVYHNQGTGFLLKGIGMVTNAHVLKDLVSAIELEMLIPIPYYVRGFNSKDFNVHMMRIECFDTEKDIVILRSKSLDHNKEGFSYSEAIQTDQLIELVGYPDYRRGQEIRVDNGFVRGIRMHINSGDKTVTHRRYEITPTIYGGNSGGPIVNEVSEVIAVAVKGATMNGVVPNEVIPISEVIGLAKRNSLI

SEQ ID NO: 1414 - protein, 582 aa, unidentified
  source 1..582: note = Related to NZ_FCOQ01000017.1; note = Paenibacillus sp.
MKPVLLSTDEEIKNKFKNLTDFGDVALLFEIPTEFLWKILIRDKWINYVSFPLHKKNGGYRTIHSPSKNLAILQKKLAYILSLNFTPHNRAHGFIEKRSIITNASEHLKKAFVLNIDLENFFESISFARVRKMFISYFKLSEIVATTLANICTHPDGFLPQGAATSPIISNILAKTLDKELKQLSIESKGVKYTRYADDITFSTNKKLFPKSIAFLNEDGQIVLSERFMKIITKNGFNVNKKKIRLQDSEGNQSVTGITVNEKLNVSRNYIRRIRSILNCIEKNINDLDYAREVFERKYPFRQRANRIHPEMFSVLRGMVNHVGHVKGTSDPVYLKLASRFNNVSPEHKVIKSVEEQSNKRKLYEEYTFVIEQENPVVAFPFKGSMDFEYVYHNQGTGFLLKGIGLITNVHVLKDLVDAIELEMYIPQSYYVRVFNSIDFKEHMMKIECYDIEKDIAILRSSSLDHNAEGFSYNELIQKDQPIDLVGYPDYRMGQDIRVDNGFVRGIRMHNDSCDNTVKHKRYEITPTIYGGNSGGPVINVNSEVIAVAVKGATMNGVVPNEVIPISEVIELANRKLFVYSV

SEQ ID NO: 1415 - protein, 589 aa, unidentified
  source 1..589: note = Related to NZ_JAKGAO010000024.1; note = Paenibacillus tarimensis
MIFISTLVRPLLQSSDDKIKSKFKTLTDFEDVALLLEIPVEFLWKILIRDKQINYKSFPLAKKNGGYRTIYSPSKNLTLLQKKLAYILSLNFTPHTRAYGFIEKRSIVTNASEHLKKNYVLNIDLENFFESISFARVRKMFISYFKFNDTVSTTLANICVHPDGILPQGAATSPIISNILAKSLDKELLRLSLESKGVKYTRYADDITFSTNKKTFPKAIALLNDDKQVILSDNLIQIIKSNGFNVNERKIRLQDREGNQSVTGITVNEKLNVSRTYIRRIRSILNCIEKNINDLDFARSIFERKYPFRQRVKGNYPDMFLVLRGMITHVGHVKGKRDPIYLKLASRFNRISPKKMIINSAEKQNNKRKAYEDYTYVIDQDDIKCVFDPKMDDMVDLYYGQGTGVLLKGIGVVTNTHVLGTIIDALDNGAKLPSSYRIRVFKHDSELACTITCYDPERDIAILTPDDIDCSAIGLEYNTSITKGQSIDLIGYPNYRQGQEIRVENGFVQGKRIHKGTKGEYIRHEISPTIYAGNSGGPVVNENAEVIAIAAKGATENGVVPNEVIPISEIIKLAQDNGLLNERMSSVQL

SEQ ID NO: 1416 - protein, 568 aa, Bacillus sp.
  source 1..568: note = Related to NZ_CP033906.1
MRTELLANEDKIKRNFQNLNTFNDIANLLEIPVEFLWKILIRDRAHSYRRFELRKKNGDPRIIYSPNTNLSILQKKFLYVLELNFNSHQRAHGFVKNRDIITNANEHINKRFVLNFDLENFFESINFRRVRHMFISYFKLNETVASTLANLCCHPDGFLPQGAATSPIISNILSKSMDKELTRIAINVRGCNYTRYADDITFSSNKRIFPTQIAIQHSDGNIEISEEVIKIINKYGFSIKESKTRMSDWKQHQSVTGIVVNSKLNVSRKYVRKVRSILHSAEKNIDNLDVAVELFNSKYNFRQKNNNTYPDMFSILRGKIAHIGNVKGKIDPVFLNLAKRYNQIAHLNEEPLIIIPPNDIQFYQENTFVMECNEFELYIDKNDETGEFIYGQGSGFLLKGIGLITNAHVVKEVIDLMKNEVKFINKYYVAIHRASPYDIIYKARIICYSIEKDLAILEVENLDIESIGYSANESIKKDMQINLVGFPSYREGNDIKSQSGYVEGIRMHEKINVRYEISATIYEGNSGGPVFNASNEVIGVATKGTTSNGVSPNEIIPISEVLKLAKEV

SEQ ID NO: 1417 - protein, 586 aa, unidentified
  source 1..586: note = Related to JACBYI010000030.1; note = Paenibacillus sp.
MSGHVNVELKSSPTDIRLKFRKLNTFDDIAHLLEIPVQFLWKILVRDKLVNYRTFKLRKKNGDERTIYSPLSNLAILQKKLSYILSLNFTHHDRSHGFIENRSIVTNASEHLRKKYVLNLDLENFFESISFRRIRHMFISYYKFNDKVASTLANICSHPDGFLPQGAPTSPVVSNIIAKTLDKELKRVAIGAKWTQYTRYADDITFSTSKEQFPKEIATINESGIITLNENIIKIIEKNGFKVNDKKTRLQNHKQSQSVTGITVNEKLNIDRRYIRRIRSILSCIEKNINNLDEAHKIFEMKYPFRQRKRGSNPDMFLILRGMISHVGNVKGKQDSVYWKLANRFNKVTPHEPIKLQLSRREFHEDNTYVIDSDYTAKYYNHNENIFDEALYGQGTGFILRTIGLVTNAHVIEGIIEGLEQKFIFSKKYYIEAYKSTLYSFPENAKVLCYDIEKDIAILSVEGLEIHEKGYMYNESIKEEQQIELVGFPGYRKGQDIKIQKGFVQGVRMHLSKDGTKRYKRREISATIYGGNSGGPIVNTDNEVIGLAVKGATMNGVSPNEIVPISEVIELAKKHGIINEHVSISF

SEQ ID NO: 1418 - protein, 585 aa, Bacillus sp.
  source 1..585: note = Related to NZ_JAKUFL010000007.1; note = Bacillus cereus
MELKSDVSVINKRFKKLQNFDDIALLLEIPVEFLWKILVRDKHTNYRVFKLRKKNGGERTIYSPASNLAILQKKLAYILSLEYKVHSRVHGFTKKRSIVTNAFEHLDKRYVLNFDLENFFESIEFRRVRKMFISYFGFNDKVAATLANICCHPNGFLPQGAATSPIVSNIIANGLDKELTRIAKNSKWCKYTRYADDITFSTNNKKFPQEIAHIVDENIVLGETILNVVEKHGFKINHEKTRLQNHKQNQTVTGITVNKISNVNRTYIRRIRSILNCIEKNKNDIVNAEKIFKMKYPYRQKREDNKPDMFHILKGMIAHVGNVKGKKDPLYLKLATRFNGVVELSDLTPFRLPITKKGFQENHTYVIDNPDFEMYFTEDGYEEVMYGQGTGFLLKDIGLVTNAHVIEDVIKTVEKKQGKFQKEFYISFFRAVDYHVKHWAKLLYYDTDMDIAILDVKDINISKTGYEYNEFIEKGQNVELVGFPNYREGQEIRIQEGTIQGVRINESRDRSRKYIRHEITTTIYGGNSGGPIVNENNEVIAVAVKGATLNGVSPNEVIPISDVIKLINQNKQPEEKSEASIEVVQ

SEQ ID NO: 1419 - protein, 591 aa, Bacillus sp.
  source 1..591: note = Related to PPFT01000033.1; note = Bacillus cereus
MSNHTYVELKSDVSVINKRFKKLQNFEDIALLLEIPVEFLWKILVRDKHINYRAFKLRKKNGGERTIYSPASNLAILQKKLAHILSLQYKVHSRVHGFTKKRSIVTNAFEHLDKRYVLNFDLENFFESIEFRRVRKMFISYFGFNDKVAATLANICCHPNGFLPQGAATSPIVSNIIANGLDRELTRVAKNTKWCKYTRYADDITFSTNNKKFPHEIAHIVDGNIVLGETIINIVEKHGFKINHEKTRLQNHKQNQTVTGITVNKISNVNRTYIRKIRSILNCIEKNKDEVARAEKIFESKYQYRQSRKGDKPDMFRILKGMISHVGNVKGKKDPVYLKLANRFNEVVELGNSTPFKLPMTRRAFHENHTFIIDNEDFEMYLNKDGTGDVLSEQGTGFILKGIGLITNAHVLEDFIKVLETEEGRFVNEFYISFFRSVSTHVKHKAKILYYNTDMDIAVLSVKDMDISKIGYEYNEFIERDQKIELVGFPNYRDGQEIKIKEGTVEGIRIQRSKDGSKRYERYEISATIHGGNSGGPIVNENNEVVAVAVKGATMAGVSPNEVIPISDVIKLINQKKQPEEKSEASIEVVQ

SEQ ID NO: 1420 - protein, 587 aa, Bacillus sp.
  source 1..587: note = Related to NZ_CP082279.1; note = Bacillus amyloliquefaciens
MVYKLNFELQSNLEDIKQNFKNLSCFEDVALLLEVPKELLWKVLIKNKGANYKAFKLKKKNGSERVIFSPTLSLSILQKKLAYILESNYKNHRQSYGFVKGRGIVDNAQKHLNKKYVLNFDIENFFESITFRRVRSMFMTYYKFNEKVATTLANICCHPNGFLPQGAATSPIISNIICNRIDKEFSKLAKNNRCQYTRYADDITFSTSRRVFPHDIAYIKEGSIFLNSNVISIVEYQGFKINKEKTRLQNYRQNQTVTGITVNEKLNVKRSYVRRIRSILHCIEKNVEDLQKAEQIFEEKYPFRQKKYLDNINMFAILKGMISHVGHVKGKDDPLYLKLAKRFNKISYLSETISPFKLESLKKFHETYTYIIDYDDKVPLVCFENDKMEEILYGQGTGFLLKGVGLITNAHVIEDAIEAIKDNKKFNNEYGISFFRGNYPDLKYKAKVSKYDLDKDIAILDIKGFNIDNQGYEYNIDMKDGQKIELIGYPDYKIGQEIKIETGHLKGIRKHRDSTGTFHSRREISAIIYGGNSGGPIINESNEVIGVAVKGATLHGVSPSEIIPIEDVINLNSSNSEVSSKIATKPH

SEQ ID NO: 1421 - protein, 583 aa, Bacillus sp.
  source 1..583: note = Related to CP018574.1; note = Bacillus altitudinis
MVYKLNIRLQSNLEDIKQKFQNLSCFEDVALLLEVPKELLWKVLIKNKGNNYNAFKIKKKNGSERFIFSPTSNLSLLQKKLAYVLKCNYKNHNQSFGFVEGRGIVANAQKHLNKKYVLNFDLENFFESVTFRRVRSMFMTYYKFNEKVATILANICCHPNGFLPQGAATSPIISNIICNRLDKEFSQIAKKNRCQYTRYADDITFSTNKRQFPYDIAYVREGSLFLSTNIISIVESQGFKINKEKTRLQNFKQNQTVTGITVNEKLNVKRSYVRRIRSILHCIEKNSNNLHKAEQIFKEKFPFRQKKLFDFNNINMFAILKGMISHVGHVKGKDDAVYLNLAKRFNDTVYLDPTISPFRLESLEKFHKSYTYIIQDDEKVPLAHFEDGMEVIGYGQGTGFLLKGVGLVTNAHVIEDVIKAIEDGKKLNIEYGISFFKGNDPNIKYKAKVAKYDLDKDIAILDIKNFNIGEHGYEYNINMTTGQKIELIGYPDYSIGQEIKIESGYLKGIRKHGDSTGKFHTRHEISAIIYGGNSGGPIINESNEVIGVAVKGATLRGVAPSEIIPIEEIINLNSNLTDVSKRI

SEQ ID NO: 1422 - protein, 586 aa, Bacillus sp.
  source 1..586: note = Related to KB976282.1; note = Bacillus cereus
MSKKMNVRLLSEEDVIKKNFKSLKDFADIANMLEIPTKILHQILVESKKNNYSTFVIKKKNGTDRTIHAPKKNLSIIQKKLSNILALVYNNHLNSHGFIKNRSIVTNAAQHLKQKYVLNFDLENYFETINFGRVRAMFIHYYGFNESVASTLANICCHHEGFLPQGAATSPIISNIISFKMDKELTKIAKKYHCTYTRYADDITFSTKKSVFPKEIAFIKDSSVQISHEVVKIVKGNGFFINKDKTRLNHQQERLSVTGITVNEKLNVERRYIRKIRSILHCIEKNSSDIEVAKSIFNEKYTFRQRRDEGNPDMFDVLRGMISYVGLVKGKEDEVFLKLAQRYNKCVDAMGVSVIKLPVERRRFQELNTFVIEQEYCYYKYDGVPDNSQCVVVGQGTGFLLKGIGLITNAHVIGKDYFDLWELSGVEFNGISINRSKYEKDKTYYAKLLCYDYIKDIAILDVDGIDIDKVGFEYNDSISTDEEIQLIGYPSYQKGIGLSVKDGKVLEQRYTIEDELSRSIRYEISATVFGGNSGGPVVNMNNEVIALAAKGSSEKGNVPNEVIPIKQVIDLAIKKKLIPSREEISV

SEQ ID NO: 1423 - protein, 577 aa, unidentified
  source 1..577: note = Related to WKKF01000013.1; note = Metabacillus idriensis
MLNRMKPELVCEDDAIKRKFKNLENFEDVARMLEIPVKKLREIIVLSKKNNYITFKIKKKNGNDRTIHAPNKNLSILQKKFSYILSLVYNNHLSAHGFIKDRSIVSNATQHIKQRYVLNFDLEDYFENINFGRVRAMFIHYFGFNEAVASTLSNICCHHDGFLPQGAATSPAISNILSFKLDKDLTKLARKHHCIYSRYADDITFSTKKNQFPKDIAFIENSSVQLSNEVIKIVKGNGFFINENKTRLNNNKEHLSVTGITVNEKLNVERTYIRKIRSILHCIEKNIDDIEVAKTMFNEKYKFRQRKENKNPDMFDVLRGMISYVGQVKGKEDEVFLKLANRYNRAIEFFDLPLIKIPVPKKKFQEDNTYVIESLNYDYTFGGERHYSLVSQGTGFILKGIGLITNEHVLKEYIEMLELGVQYDSSENIVIHRSKYSHEKQYAKLLCYDKIKDIAILSIKGLDIKKVGFDYNVSIEPDQEIQLVGYPNFRENMDISIKNGVILGERYTDKTGFVSEKRFETSAHIYGGNSGGPVVNMANEVIAVAVKGATENGVVPNEVIPIKEVIDLAKKNKIITT

SEQ ID NO: 1424 - protein, 581 aa, Bacillus sp.
  source 1..581: note = Related to NUBD01000031.1; note = Bacillus wiedmannii
MIKKMSPELLCEDAILKERFKSLNDFEGVAHLLEIPVKELRKVLVLNKKYNYTTFKIKKKNGNDRTIYAPQKNLSIIQKKFSYILSLVYNNHLNSHGFIKERSIVTNAEQHIKQKFILNIDLENFFESINFGRVRAMFIHYFKFNELVATTLANICCHYDGFLPQGAATSPIISNILSFKMDKELTKLAKKNHCIYSRYADDITFSTKKNQFPKDIAYIENSFIKINSELLKVIMGNGFFINKNKTRLNSHREKLSVTGITVNEKLNVERKYIRKIRSILHCIEKNINDIEVAKSIFNEKYRFRQRKEHGKPDMIDVLRGMISYVGQVKGKNDQVFLKLAKRYNLIVELIDMDLPIIKLPISKRKFQEDNTFVIESLYYPYFIDGESAGEAPIGQGTGFLLKGIGLITNAHVFKGEYTEMLEIGATFKKIEIHRSKYSSGKKHYASLLHYDKIKDIAILSVDGLDMAKMGFEYNEFIEPNMEIQLLGYPNFRDNMDISIKSGTVLGVRYTDTYRLNSEKRYEISAHIYGGNSGGPVVNENNEAVAVAVKGITDDGSVPSEVIPIKEVIELAKKKNIIPLKG

SEQ ID NO: 1425 - protein, 578 aa, Bacillus sp.
  source 1..578: note = Related to PCNZ01000039.1
MTYKLNVDLVQNPEIIKEKFKSLSNFNDVANILEIPSSFLRQILIVSKKSNYGTFTIKKKSGDDRKIHAPSKNLLIIQKKLTSILNLVYKNHNNSHGFVKDRSIITNANKHIRKQYVLNFDLEDFFNNINFGRVRAMFIYYFKFNETVATILANICCHYDGFLPQGAPTSPIISNILANKLDKDLTRLAKRHRCDYTRYADDISISTDKNKFPKAIAHTKDKKTYLSSEIISIVKNNGFFINDKKSRLNSKFENLSVTGLTVNEGLNVKRSYIRRVRSILNCIEQNLDNLDEAKRIFIEKYPFRQISYATEPDMFAILKGMIAHIGHIKGKTNSVYRKLAIRYNDIAEIENILSIKLPSTRRQFQETNTFVIESSFFYKSGDDEEFEPCGQGTGFLLKGIGLVTNAHLFDIYFKKSNDGYNITNFSIEVHQSKYSTNKKYAKLLWHDRIKDIAILQFTNGNLTDQGFDYNTSIKTGMEIELLGYPAHTLDNSIKIESGVVRQERNNPMPDRQKQTRFEISPLIYGGNSGGPVVNKENQVIAIATRGITSNGVVPSEVVPIGDVITLFEKHNPILTKNV

SEQ ID NO: 1426 - protein, 570 aa, unidentified
  source 1..570: note = Related to NZ_NPBG01000156.1; note = Niallia circulans
MTTIYINLKSDDDVIKNRFRTLDTFEDIANLLEIKPKMLRDILVINKGKNYKSFVIKKKNGGERTIYSPEKNLSILQKKFLYILNLVYRNHENAHGFVRDKSIKTNATSHLGQNYILNFDLKDFFENINFGRVRSMFMSYFKFNTIIATTLANLCCHEDGFLPQGAATSPAIANILSYNLDKTFSKLAKKEKCVYTRYADDITFSTNREKFPKNIAFQKKGQVLLSSYVEKIIRENGFLINESKTRLHNKYQNLSVTGITVNQKLNVSRKYIRKIRSILHCIEKNISNLELAEKLFCEKYTFRQRKNSNTPNMFDVLKGMISHLGNVRGKSDDIYIKLATRYNILVNNIDKPEIKLPISAQKFQERNTFVVDSLYSKYSLYGAEDQVLNGQGTGFLLKNVGLITNAHVLYDNIDLLDDGAEYKTEYYIRVHQSKYSIDNKQYYAKIVYYDSFRDIAILSIKDINLNTEGYSYNEEINPNQSIKLIGYPQYIDGQDLRVLDGHIMNSRIHTDGTRTQKRYEISATIFGGNSGGPIVNANNEVIAVAAKGISDKGSVPFEVIPISDVIKIYN

SEQ ID NO: 1427 - protein, 590 aa, Bacillus sp.
  source 1..590: note = Related to NZ_JAHQCS010000163.1; note = Bacillus tamaricis
MNVELTKPDTLLIYEFQNLHSFSDIANLLEIPIEVLWKNVVDKKKYHSLKIPKKQSDKFRIINKPSKNLNIIQKKFNYILSLVYKSSHSTSHGFEKHKSIRTNAICHLNRQLVLNLDLEEFFSSIIFPRVRAMFMTYFKFNNEVATTLANICCDNNNKLPQGAATSPIVSNIIAYKLDKQLSRLARTNGCIYSRYADDITLSTNNKKFRFEIFNGNDGVKEVGEKVKQIIQSNGFKINSSKTRICENSKAQYVTGVKVNSKLNVNRTYVRRIRSILHTIEKNLDNIEEAVKIFKEKYPYRATLFNNYDMFNIVRGMISHIGHIKGKQDAVFQKFVIRYNRIISEINTKEGTNYAFLYRPYTWTEFRQQNIYVIEEDEISYRLGSLNKKIISSQGSAFLLQGIGLVTNWHVVKCFIEGVINNELATFNSNYYIPVTKSRYSDKIWFAKIIMFDKGRDIAVLKIDGVDEKLYGFDYSLDIKENMECCLLGYPEYIRDQTLHEVEGKIQSQRISRYYPNDYVRYTTTMAIHGGNSGGPVVNKENNVIAIAVKGSNNTVAEVIPIGDLLESINQQQMIKIEQHNIVQTTEVSKS

SEQ ID NO: 1428 - protein, 575 aa, unidentified
  source 1..575: note = Related to NZ_CP013661.2; note = Planococcus kocurii
MHVDLKSEDTAILNKFNSLQTFDDIADLLEIPPKKLWEAVIQNKTYSEFTIPKKNSSNFRVINKPSKNLDIIQKKMNYVLSLAYKSTSNVSHGFEKNKSIRTNAQVHLRKKLILNIDLANYFSSITFPRIRAMFLSYFRFNEVVATTLANICCDNNNELPQGAATSPIISNIITYKLDKDLVRLARKHRSNYTRYADDITFSTNRKEFQSDIFNMDEDFYDVGDKVIELISKNGFSINTSKTRIHDSSQPKYVTGVKVNTKLNLNKRYIRRIRSILHCIEKNINSLDEAITIFEAKYPFRKTKFKNRDMFNIVRGMISHLGHIKGKQDHVYQKLAIRYNLIISAVNGSSNENYPYIHRPLTHSEFREQNVYVIESDFVNYKFFESKKNIVTYQGSGFLLKEVGLVTNYHVVKEYIEILEEENTSFEEEYYIPLSKSRYSQDIWFAKIIMYDKARDLAVLHINIVDHFEHGFNYNQSITEGMDSVIIGYPEYKESSSLHIDQGKILGERIHYYNDKRFTRYSTRMPIHGGNSGGPIVNMKNEVIAVAVKGKDNSVTEVIPVSDLLKSIEAKEMCLV

SEQ ID NO: 1429 - protein, 581 aa, unidentified
  source 1..581: note = Related to PDYK01000012.1; note = Sporosarcina sp.
MSFQGSPKLQDSDDNITKKYKSLNSFQDIAGLLEIPQELLWKTLMKNKENNYRTFTLKKKSGGDRIINAPTNNLSIIQKKLNYILSISYKKSHTNSHGFVLKKSIVTNASQHVAKKFVLNFDLDNFFGTITYARVRAMFMTYYKFNNSVASTLANICCNNDGVLPQGAATSPIISNIISRRIDEDLSRLAKKMNCTYSRYADDITISCDSNYFPSEIAYFEESITKIGSQVKSIISKNGFSINMKKNRLRSQYQNQSVTGITVNQKTNVDRQYIRKIRSILNCIEKNIDDISMAEKTFREKYSFRQSQIKKPKMFDVLRGMISYVGLVKGKDDQLFLKLAKRFNKVIKNQNLAFIRVPISKVELREENTFVIDSLYSIYSMDGEKSEACNGQGTGVLIRNMGLVTNAHVLYENIEVLEYGAEFEREYYIRIHKSKYGSQEYFAKIDYFDSFRDIAILTIKDFDTSKYGFEYNEEIEFNQIIELIGYPSYKDGQDLRVSSGVVMGERTHADRVRKQKRFEISAQIFGGNSGGPIVNSDNEVIAIAAKGSTEKGSVPNEVIPISDVINVFDNKTRKFYHLAHS

SEQ ID NO: 1430 - protein, 356 aa, unidentified
  source 1..356: note = Related to CP035485.1; note = Salicibibacter halophilus
MAKGRVTTALLLMLPRRCEFMEIEIRNTDEDVKRNFENLINFKDVAHLLEISAETLYKILFINKHLNYKEFTLNRGKVRTIYSPKKNLMIIQRKLAYILSLLYSHHTKSHGYIKEKSIISNANEHVQQRYVLNFDLKDFFDSISFGRIRAMFMTYFKFNDKVSTTLANICCHPNGFLPQGAPTSPIISNIISYRLDKNLDSISRRYNCKYTRYVDDITISTSRIYFPKAIGHGQKGSDQAVVSEKIKSIVHKNGFKVNDKKTRLNSKYENLSVTGITVNETLNVKRSYVRYIRVILHSIEKGIEEDNLDKAQKKFNEQYNFRQRKKGNLPDMYSVIRGRSPMLDKLKGRKIMSIIS

SEQ ID NO: 1431 - protein, 575 aa, unidentified
  source 1..575: note = Related to JAARUK010000009.1; note = Listeria booriae
MNEKVSEFKNINGFESIAEFLEIPKPELWLMLVKRKKFNYTQFKIPKKNGEFRIIHSPSEKLAESQKRLASVIGHLYASNHTTHGFVAGKSIKTNAQEHVRQSSLLNLDLADFFENISYGRVRAMFGEYFKFNYKDSSTLANLVCHPDGFLPQGAVTSPMISNIICYSLDKEINRLAKRNGCIYTRYADDLTISSKKIVFPRSIAHKNINEGVVLNRQLESIINKNGFSVNASKTRLNTKYECLSVTGVKVNDKLNVNRVFVRRVRSILNSIEKCEGDLISAQKIFDEKYHSRNQGSGNSPNMFEAVRGMIGHIGFIKGEEDLVFIKLADRYNSIINGTSRSGLIKVPLSIEKSRQTYTFVVESNDFIKYKYEEDDGYFICEGGSAFFLKGIGLVTNAHLFGELKDTLKYCENGLIDLVMDEEYYILTHRSRYNAKKMKFRLVAIDFMKDIAILQPENKDAYKYGFEYSCDLKKGDKVVVLGYPEYKANQELRSMVGEILGERSHELETKPAEYAARYEVSATIYSGNSGGPVVNEANEVIGIATKGTTERGQVPNEFVPIVEIVELHKAMITRE

SEQ ID NO: 1432 - protein, 446 aa, unidentified
  source 1..446: note = Related to NZ_CABGOR010000004.1; note = Enterococcus gallinarum
MHLQELKSFTDIASSLDVTAGHLRRLLFEEKNNLYFEFEIPKKNGSLRKIYAPNDSLLFIQKRLSAILSSSVKLHDKAYGFINKRSIVDNAQLHIRKNVLLNIDLENFFPSISFGRVRSMFMNYFRLDKNVATTLTNICCHPGGFLPQGSPTSPVISNILCKTLDKDLDRLAKNSFGATYSRYADDITFSTKTSWEEIISSKVTLFQKLNDILFDQTIVLDIASSYNPSIHKYEERLLKKKYYSALQSIGFISKHELDTDLSVLHGDIGEFLMHHLVSNYISDNNSVKYLYPKLVLKSNPKMPAYGNDGTIYVPSKKEIFYLEAKFYTNLTKAINKAVDSLKEHNEVTQENIDHKTELFRNIKTKSNDEIIEITDDVNEKLVLFLICDNIFKEEDVLKCLKKNNGLIELKKSFEVIIFVLPILSKSEFLESFKKQSILRGNQYYVQ

SEQ ID NO: 1433 - protein, 546 aa, unidentified
  source 1..546: note = Related to JAHUZB010000013.1; note = Enterococcus alishanensis
MKMRLQELKSFNDIASSLNVTTGHLRRLLFKEKNNLYFEFEIPKKNGTFRKIYAPNDSLLFIQKRLCKILNSSVKLHNKAYGFINERSIVDNAQLHLKKNVLLNIDLENFFPSISFGRVRSMFMNYFKLDKNVSTILANICCHPNGFLPQGSPTSPVISNILCKTLDKDLDRLAKNSFGATYSRYADDITFSTKKSFKENIVIEKNGEIILGSSLTDIIRRNGFKINPNKTRLQKAIQHQEVTGIIVNQKLNVDRRYIRKIRAMLYSIEENSNNLSIPLEKFAEAGYKGNDIENILRVIKGMINYVSMVKGKYDAVFEQLANRYNTILEELEIENLKPIFIPPKICLEESVCVIKETAITLFSDKENMITAYYGQGSGFLLKNHGIISNYHVFEYLIEDLSRGFSTIKNEFFVEVFFGKRTSKLVKAKIEKYNKDKDLVLLVPEDSSLLDFGFEKFEDVLEQNTEVYLLGYPDFADGDQMKFEKGHYLRTVNSKGIKKYEISQIIFGGNSGGPVLDRENRVIGVATEGKRISINRIIPIEYLHDLK

SEQ ID NO: 1434 - protein, 552 aa, unidentified
  source 1..552: note = Related to WVEQ01000007.1; note = Carnobacterium sp.
MRIQEFESFKDIADALGIKSGHLRKLLFEERNNLYSDFEIPKKDGSLRKIYSPSKKLLFIQRRLLLILENSIKVHPQAYGFVKGKGTVSNASLHLRKNYLLNIDLKDFFPNITSGRVRSMFLNYFKLNNTVASTLTNLCCHPKGFLPQGAPTSPIISNILCKTLDRNLDRLAKNSFGSSYSRYADDISFSSNRPFKENIVSEQNGNVILGSSLLDIISSNGFKINLDKVRLQKNHQHQEVTGIVVNDRLNLDRRYIRRVRAMLHSIEVNIDDLSIPTKKFEESNYKGNTFDNLLMVIKGMIDYIGMVRGKADNIYEKLAVKFNYILELLELDNIKPLFITEKIENNVCVIKFKKIFLFKTDFSEMVELDYGQGSGFLLKSYGIVTNYHVVEGLIESGFLNGFPKSTNEFYIETFFGKHSSKIVKAKINKYSKEKDLVLLIPEDLSLLDKGLDISTDALNLNEEIRLLGYPEFYEGDELKNELGNYLRTVVDNVEGNSIKKYELNTMIFAGNSGGPVINSDGKVIGVATEGRKIETNRAVPIDYIKTLQSLDI

SEQ ID NO: 1435 - protein, 542 aa, unidentified
  source 1..542: note = Related to NZ_CP047363.1; note = Macrococcus canis
MKIQNINSFTELSFVLGYKSGHLRRILFNINSSSYTSFEIPKKNGEVRKIYSPQSQLLILQKKVAAILENSFNPHYKSFGFIKGKSIEKNAKLHLKRKYLINIDLKNFFESITAGRVYSMFVNYFKLDRNIAAILTNICCHPEGFLPQGAPTSPIITNILCKTLDKELNNLSKKYSVTYSRYADDITFSSNKAFNSCFLTREESLSDDIKRIIEQNGFFINDNKFRYSKFNQRKEVTGIIVNEKLNVDRRYIRKIRAMLYSIENNLDNLEVPRTKFDKSHYKGDSIENLLNVIKGMISYTTMVKGNNNISTKLAMRFNDILECLEIDSVKPIKVKPLDINEEKVCVIKLENVFFYSKNGEPYDIDYGQGTGFILKNVGIVSNYHVFEFIIEEIEKEKKPLCEDKYFINLYFGINCTKKVKAKVLKYDIDKDLVILQPKDLNILEMGFELEEGTIENNSKVTLLGYPSYNEGDRIKEEQGKLLRKINDIKGFEKYEISSVIHAGNSGGPVLNNKGKVLGVATEGRGNDINKVVPITNVLSMLK

SEQ ID NO: 1436 - protein, 560 aa, unidentified
  source 1..560: note = Related to NZ_ATXL01000020.1; note = Bavariicoccus seileri
MRIQDISTFDQIAKALGISTGYLRRLLFEERDNFYTEIEIPKKNGDSRKIFVPSDELLQLQKKLNTILISSFNPSSRAFGFVQGRSTVQNASLHLKKKYILNIDLLDFFPSISSGRVRSMFINYFKLSSIVASTLTNLCCHPDGFLPQGAPTSPTISNILCKTLDKELINLARKLGKITYSRYADDITFSTNSTFSRKLVRRNNGEICLGNELIEIVEKNGFEINSSKTRLQNNNQHQEVTGIKVNRKLNIDRRFIRKIRAMLFSIESNLDDLSIPATKFAESDYKGDSIGRLMKVIKGMISYVGMVRGKNDALFIGLAKRFNKLLLVVDQFKDEKPIVIDSGLSQLPNLVCVVPQTNIQLWKKDNEMNIFSEIDYGQGTGFLIKGIGIVSNYHVFEFVIDSIKDGFLPRETEYFVNLRFGASQSKKISAKISFFSEELDLVILIPEDQIILNNGFERELREPEQNETITLLGYPDFSEGDQLKMERGDYLRTTFSKKVEMYEISPIIFAGNSGGPIINKSDKVIGIATEGRRIALNRAIPIKYVDEEKLTTLTYTLFKF

SEQ ID NO: 1437 - protein, 588 aa, unidentified
  source 1..588: note = Related to CP027781.1; note = Clostridium botulinum
MAGKVELPFCFGGFLLLLKELKSFSDIAEALSVSSGNLRNIIFEYKKNSYEKFDIPKKSGGIRTIYKPNSQLAAIQHELCDILYNSYKPHYNAHGFIKDKSILTNAENHVGKKYILNLDLENFFESVKFPRVRGMFINYFGLKENVATILANICCHPEGFLPQGAATSPVITNILLKTLDKELTRLAKESNWAKYSRYADDITFSSNKKFIKNIVEEIDGQIVLGKELVWLIQKNGFKVNEKKTRLQTKYDHQEVTGIVVNKKLNVDRRYIRRIRAMLHSIDMNKNDLKIPKDRFKKKYFPRNCNCSGDLFLTLKGMITHVGHVKGIYNLVYKNLAMKFNRLLLECRLPYPAPINILEKSDVYYDNVFVIDSSKDIFFIDNNGDMESYDYGQGTGFYLKGYGIITNYHVLEYVLDEINSGKKPISSSGNQYFIEFFSGRDPSTIMKAKYLYGSKEKDIVVLEPSDSSLIGQGFDIFKSKIIPQNMELNLLGYPDYNKNDDLKIESGKFLRKIVPDGNSRIEITQTIFGGNSGGPVLNSDNEVIGIAVRGDGKYPNTAIPIYEVENLHASHIESLPNSSVKDNNLSMQR

SEQ ID NO: 1438 - protein, 575 aa, unidentified
  source 1..575: note = Related to NZ_RHLQ01000054.1; note = Lysinibacillus halotolerans
MSLIFHISDIKNYQDLADYLEVTTGYLSKVINDPNRYQCFEIPKKDNSLRSIYSPTKDLLVIQLKIKKLIEQNFNPHYKAHGFINGKDFITNAYNHIGKNFVLNLDLNNFFESISIKRVNNMFQRYFKVRPNISTVLAHICCHPDGFLPQGAPTSPIISNVICKSLDKDLTELAKSLKLTYYSRYADDITFSCKKKDFPKILAEDINGNIVLSNHLTNLIEKHGFKVNLNKTRLQSKYMHQEVTGITVNKKINLNRRYIKRIRAILYSFKKYVDEPDIPIGKFCEFYNITNNNIEETKYRIFNILKGHIIHISHVKGYNDSNFLDFMRKFNELLELYSLSIPAIKVLDSSNNFFKRNTLVIYPLNSLDDPQYFVDRDFIKNGNFEIDSVCYGQGSGFYLKDIGIVTNYHVVSLIIEEVLEKKLTFCKEYYLEYFTESNGKQYKYHAKIIAYDKEKDIAILKPKYPDLVDSGFKYNKRFNINDSITLLGFPNHTTGSEFRSDKGKIIRKIKNKNISTYEIDAKIFAGNSGGPVLNYKNEVIGIATKGFTDRGIVPPEFIPIKYAIEVYKNHTDKKL

SEQ ID NO: 1439 - protein, 565 aa, unidentified
  source 1..565: note = Related to NZ_ATCL01000009.1; note = Exiguobacterium sp.
MNNPFSNLTVKLKKSDDELINAFGSLSTFEDVASILEVSSHALWIILVKNKPYNYREASIPKKDGGERKVYIPNNNLFILQQKLKYVLELIYSPHFTSHGFVNDRSIISNAERHVNKKFVINIDLKDFFPTIKYNRIVNMFVKVFRCSPNIANTLANIVTHHEGFLPQGSPISPLISNVIARTMDDQLFKLCKEIKEVQYTRYADDLTFSTNRKKIPNSIVKNSNNSYELSDKLINIIENNGFEINYKKFRVQSEYDHQSVTGIKVNKKLNINKSYIRMVRVYLYIFEKNEDINQAIKEFNLRRPKKSNLKHRLIKNEFQNQIFHLKVLKGMIEFIGSVRGRRDRIFNKFSKRFNTICETAGLNNIQINIPLLLEEVIDNKILVVGNNDQYFYTLDQGINTKEISLSKSLAVSNNERGIISTKANWTTFRDDFEGTHYYDFHTIPLYRKNTTDVLSYLKINRVAENDLIYFEGPEELTKNLQEINTEIESLKIGNVILVGLHNNTIEIFEGILTKRILFGESKFIFKPISNENLPISFGFVFNQVGNLVGTLSRGNSELYVNSIK

SEQ ID NO: 1440 - protein, 566 aa, unidentified
  source 1..566: note = Related to JACTIL010000004.1; note = Listeria seeligeri
MADKFTLLEEIDDVLNFKFRNLNNFKEIADMLEVSSEFLHSILYKKRSYETFFIQKKSGGYREIKTPNNNLKLIQKKLAYILSLNYKMHKSAFGFIKNKSIIDNANLHINKKWVFNFDLEDFFHQFNQGRVIGLLRKYYKFNNTVAGILAEICCYENTLPQGAPTSPILSNILAFELDREFQKECKKYHCTYSRYVDDISISTNKSHFPKNLAYKNSQEEIILGEIAQTILDKTSFKVNPKKVYLRHETQHQNVTGLVVNEGVNVSRTYIKRIRATLHNLRVSNEEDGKNKFFLELSKHSSSRSQQFDMYAILKGKIQFVGQVKGKENQVFRKLATSFNQLDLPASVKPISILSSTEKKRCQNTYIVEVGYEIGEELFYYTGTAFYMKGVGIVSAAHTFKNYYDCKEYADSHHLYLINENKLTEKINITKKYIDYELDIAIFDIDTQLNTDDWGFEYSNSIIEGQSCVLLGYPRHIDGNTLNTEFGKITQKINQKCPNRFNKKTGTLGVEQTRFKISSDIYSGNSGGPILNDDDRVIAIAVKGYGDNAVEVNTVVPISDIFTYMLP

SEQ ID NO: 1441 - protein, 565 aa, unidentified
  source 1..565: note = Related to CP030808.1; note = Listeria monocytogenes
MTEKFTLLKEIDDVLIFKFRNLNNFKEIADMLEISPEFLHSILYQKKSYETFFIQKKSGGSREIKSPNNNLKIIQKKLAYILSLNYKMHKSSFGFIKNKSIIDNAKQHTNKTWVFNFDLKDYFHQFNQGRVIGFFRKYYKFNNVVAGVLTEICCYENTLPQGAPTSPILSNILSFELDREFQKECKKSNCTYSRYVDDVSISTNKFYFPKKIAYKDAQEEITLGEISKKILDKTGFEVNQSKVCLRHKTQHQYVTGLVVNEGVNVSRKYIKRIRAALNNLRTNNETNGKEKFFIELSKHSRNSSQQFDMYSILKGQIHFVGQVKGKDNQVFRKLATSFNQLDLPVSIKPISILSSTEKKRCQNTYIVEVGYENDEGIQCFTGSAFYMKGVGIVSAAHTFRDYYRCIKEAVNPYLYLINENKPTEKIEITKKHIDYDLDIAIFDIDSSEDTANWGFEYSNSIFEGQSCVLLGYPKHTDGNNLNTEVGRITQKLKQKHPNKFNKKMSDLGVEQTRYKISSDIYAGNSGGPVLNNDERVIAIAVKGFGDNGTEVNTVVPVSDIFSYMI

SEQ ID NO: 1442 - protein, 578 aa, unidentified
  source 1..578: note = Related to JAARWF010000001.1; note = Listeria booriae
MDNKSILLNAIDDVLIFKFRNLNNFKEIADMLEISPQFLHSILYKRKSYNVFQIQKKNGGTREIKSPDNNLKIVQKKLAYIISLNYKMHRSSFGFIKKKSIVDNAKPHTNKKWVFNFDLKDFFNQFNQGRVIGLFKKYYKFNDSVAGVLAEICCHENVLPQGAPTSPILSNILSFELDREFQHKCKKYNCIYSRYVDDITISTNKAYFPKKIARRDAEGEIVLGSVSQEIVDKADFQVNQSKVYLRHSSQNQHVTGLTVNEGVNVSRKYIKKIRATIHNLKVNNEKVAEEKFFKEYLKGPIPKKTDLNMYSILKGRIQFVGQVKGKENSLFRKLAKEFNDLKLPKQVNPISILTALEKNRRRYCFIVEVGHILGEDIYHYTGSAFYLKGIGLVSAAHTFKEYYENKEYADKHYMYVVNENKPDEKIPIVKKHIDYALDIAIFEMPTKLRDNNEGFLYSTTVNVGQKCVLLGYPKHFVGNTLNTEFGQINQELKVRLPDKYNSVTGELGVIQKRYKISAVIYAGNSGGPIIDEREKVIGIAVKGHGENGVEVNTVVPISDIFTYIQDYSLEHRTSLSSK

SEQ ID NO: 1443 - protein, 564 aa, unidentified
  source 1..564: note = Related to NZ_FYBO01000001.1; note = Listeria sp.
MQQIQLKEIDEVLVLKFRNLNNFKEVADLLEISPQFLRDILYEKRKYSHFYISKKNGGEREIFSPVNNLKIIQKKLAYIFTLDYTPFKSSFGFVKKKSIIDNAALHTNKKWVFNFDLKDFFHQFNQGRVIGLFRRYFNFNNVVAGVLAEICCHQNILPQGAPTSPILSNMLCFEVDRELQKLCSSKQCTYSRYVDDITISSSKDYFPRLFAFKDGEGRMRLGRLLEEILRKTGFDVNQEKIYLRTPNQNQNVTGLTVNEIVNVNRNYVKRIRASIHNLKVNTEEAAREKFFIEYTKRKAHINPNANVYSILKGQIQFVAQVKGRENPVFKKLASQFNSLNLPSNINPISPLTRVEKFRRRNCFIVEISFEREGEFFCNTGSAFYLKKIGLVSAAHIFKDYFEHYDSAVKREIYIVNEVDRKHKIKINKKYIDYDLDIAIFNLDTTIDTMNWGFNRSDTIYENQKCILLGYPEDCNGNTLNTEFGKITQVISNSFPNKFNSIEQELGLTQIRYKISATIYGGNSGGPILDIHENVIGIAAKGTSDNGITINTFVPISDIKFLMNS

SEQ ID NO: 1444 - protein, 561 aa, unidentified
  source 1..561: note = Related to ABHH01000013.1; note = Carnobacterium sp.
MTKRIDQLKTEDSNLISNFRKLNSFYDIASLLEVTPKFLYYILNVEKSYTPFKIPKKNGDMRTIMAPSKNLKIIQKKLSYILTKSSSLNKSAHGFVQGKSIITNAAMHVNKKWVLNFDLKNYFDQFNQGKLIGFFKSYYKFNDEVIGILVSICCHNNILPQGAPTSPILTNILTYNFDKQMSQLCRKNNYIYTRYVDDITISTDKYEFQKRFVYYNENNDVQIGNAINKILEKTNFEINTKKTRLRINYQNQTVTGITVNRKLNVSRKYIRKTRAILHNLKVNNDNVAQKKFDEYYPVRHYRDYKASDKYNVVKGMIEHVAQVKGRDDRIFKKLALSFNDLNLPEHVYELNLYSPFEKNLRKNCFVVEIEYSLYGDFYPATASAFLLKGVGVITSAHTFKQYLEYKDEVEDIKIWAFRENETTLKRPLDIKNFDFTLDFAICHVAGINHTEYGFEFSKHISLGEDITLLGFPQYQHKNLLNKEHGVITQEINEYFQEKLNPKTQSPGYNQKRYGISSQIFEGNSGGPVLNSDYKVIGIATKGITSDAVKVNTIVPISDIFQ

SEQ ID NO: 1445 - protein, 581 aa, unidentified
  source 1..581: note = Related to NZ_RHHV01000019.1; note = Brevibacillus parabrevis
MSYFRAKPTLQASDAKLVSSLKSLQNFDDVASLLEVTPKHLRYILFEKKVSGYYKCFDIPKKSGGSRKIWAPQGSLKILQEKLNKIFSLTYKPNITSHGFVKDRGIVSNATVHLRKRHVLNFDIEDFFHRINFGRVRGVLKSFFGMSWDAATVIANICCYNNVLPQGAPTSPIISNMICFNMDMEMRKLAKKHNCHYTRYADDLTFSTTRQTFPSAIAHLDEERVVYLGSKIQKILDNNDFAVKKSKTRLNNRDQNLSVTGITVNKITNVERNYIKKVRAILKCLESHPLSEAQKIFESKYYSKPGKKNAEIMNVVKGMISHIGYVKGKQDPIYEKLARRYNRLAGIETLKVGEAFLKDWSQNVFVIEVGYDNSGVFDPQQQGTGFFLKDVGFVTNHHVVKEYIDDPDIYEIRVHRSRYNKKCFQAKVKMYCKERDIAILEIDGFNITGFDYDLINYDGQSIKVIGYPRYGHEDSLFVDQGTIVQYRSEFMRTIYNKKTQELGLYQERIICSARIIYGNSGGPVINTRGQVIGIATKGFSNVSKKEEDDDSSAASYLVKIGDVFDMIGEKEESVPSPVSAI

SEQ ID NO: 1446 - protein, 578 aa, unidentified
  source 1..578: note = Related to NZ_VDZO01000006.1; note = Paenibacillus xylanexedens
MSHFMAKSQLKASNEKLLESFRTLQSFDDVADILEVSPKHLHYILFKKPKSQYYRSFAIPKKNGGYREITAPTRSLKILQEKLNRIFSLVYKPNITAHGFIKGRGIVTNATVHVRKKHVLNLDLEDFFSTINFGRVRGILKSFFKIGDDAATVIANICCYNNVLPQGAPTSPILSNMICFKLDKEMRNIAKLYNCDYTRYADDITFSTNHQTFPKEIALFREENIVHLGIKVENIIESNGFKTNNSKTRLNNRNQKLAVTGLTVNKIVNVNRGYVRKTRSILRCIEKYSLEKAQEIYVEKFAKNHKGVKIINVVQGMITHIGHIKGKQDQVYEKLARRYNRIRGEEVLKIGDTFLSQNICVIEVGYYDDEQNFMPEVQGTGFFLRGVGLITNRHVIKEHLELPEIYSIKIHRSKYDYTYYNAVVRMSDEERDIAILDVIGIAPEGFEYDNDNYTGQNIKLIGYPDYGHKDSLYMDQGVITQYRKQWMPNVYNLDTEELGVFQERIVCSVRIVIGNSGGPVVNLNGQVIGIATKGFKKIDKSEKDDTSTEASHLVKIEDVFELLAEQEQKLLTNTLENV

SEQ ID NO: 1447 - protein, 579 aa, unidentified
  source 1..579: note = Related to NZ_BOSB01000004.1; note = Paenibacillus lautus
MNYFNAKPELMANDQSLISSFKSLQSFRDVCNLLEVTPTHLRYILFEKTPSQYYTFFTISKKSGGIREIIAPNGALKILQEKLNKIFKLAYKPNASIHGFTIDRSIVTNARMHLGKNHLLNFDLADFFPSINFGRVRGVLISFFGMGSEAATVIANICCYKNSLPQGAPTSPILSNMVCFNLDKQLQLVARKNGCTYTRYADDITFSTTKHLFPKSIAFVENEIVYIGPKILKILEDNSFKVNHLKTRLNNRLQHLGVTGITVNKILNVKRDYIKKIRAILRCLEINSLEQAQFIFETKYTKIRNKAPNSEYPSILNVVKGMIDYVGAVKGTQDPIYEKLAFRYNQICKLPVFKIGEENTESWNKKVWVVELCIEAEDDGKIEYIPVIQGTGFFLNDIGFVTNAHVVRDYREYDIIRISRSRYGSEVKKASVIKLDRDRDIAILKIDDFEDWSGFNHSFVHYIGMDVKVIGYPNFGGNDSLYVHKGEILQYRVEHFPDKYNKATDSLGMNQHRTVISARIIAGNSGGPVVNMQGEVVGVATKGFKEISPGKHDDDTATSIMIKIEDVISFANEMEPTKA

SEQ ID NO: 1448 - protein, 575 aa, Bacillus sp.
  source 1..575: note = Related to LYUE01000007.1; note = Bacillus siamensis
MSYFDAKIELQATDEELIHSFKDLENYRDVCSLLEVTPKHLHYILYKKKNLYYQFDIPKKNGGTREIYAPCDSLKILQQKLNYIMSLIYKPKYTIHGFVKSRGIVSNAKQHLGKSYILNFDLYDFFPSINFGRVRGILRSYFGLGDHAATIIANICCFNNSLPQGAPTSPILSNIVCFNLDKELQFIAKQHSCIYTRYADDITFSTTKKDFPKSVAFKTDSQIFLGKKILKVIEKNSFKVNENKTRLHNRYQNLSVTGITVNEKLNVPRNYIKRIRAMLRCIETNTPEDAQVIFLEKYKFRYRANMEPPNIMNVLHGMINYVGFVRGLDDEIFKKLALRYNLIVGNDKIKVKKDNLALWESYVWVVEVGYKDDDDFYAEEQGTGFFLKNVGFVTNAHVIEKYDGESINAIYLNRSRYSEEQKLASIITIDKDRDIAILYVEGFDIDYGFSYNIHHNLGQEIILLGYPNHGDGNSLYINKGQLVQYRSHYMPNTLNKETGKLGVKQERVTISSRIVTGNSGGPVINLQNEVIGIATKGFKDISPNLKDDSTAESMIVKIKDVLSVLSQMSKLHREN

SEQ ID NO: 1449 - protein, 580 aa, unidentified
  source 1..580: note = Related to NZ_VDST01000009.1; note = Priestia megaterium
MSYFDANIELQAKDEDLIVAFKKLKDFRDVCDILEVTPTHLHYILYKKGPSKLYHPFNIPKKGGGTRQILAPNDSLRILQQKLNYIMSLIYKPKFAIHGYVKGRSIVSNAKQHLNKNYILNFDIEDFFPSINFGRVRGVLKSFFGIGKDAATIIANICCYNNLLPQGAPTSPILSNMICFQLDKEMQLIAKQHSCVYTRYADDLTFSTTKKSFPKAIAYHGDDCVHLGKRILATIESNGFKINNNKTRLHSKYQHLGVTGVTVNEKLNVKRDYIKKIRAILRCLEINSLDEAQKIFEDKYIRRHTKEVNFPNIMNVVRGMINYVRLVKGPEDSIFEKLARRYNKIAGVEVFTVGIQHSRFWTSYVCVVEVGCKDEDEFYADDQGTGFFLQGIGFVTNAHVVKKFNGIEFNAIYINKSRYDQTKIAASILTMDEERDLAILKIDGFESNIGFSYSTNYYGGQPITLLGYPNHGGTDSLYTENGEIKQYRPHYMPNKYDEKTGKLGVHQERIVISPRIVTGNSGGPVVNSQNQVIGVATKGFNEISPGSKDEPTADSIIVKIEDVLALHTEMRSDETPIANQ

SEQ ID NO: 1450 - protein, 581 aa, unidentified
  source 1..581: note = Related to NZ_AUCI01000050.1; note = Salibacterium aidingense
MNTNFKANLQIKSSVEDIQKKFKNLSSFDDVSDLLEISPKHLRYILFEMKDRYKSFEIPKKNGETRSIVAPSKSIKILQRKLNYILSLNYSNRPTSHGFIKGKSIVTNAQPHVKQSVVLNFDLKDFFSTINFGRVRGVFIKFFDIGDDAATVLANICCKDNVLPQGAPTSPIISNIVCYKLDKELLKFAKKHSCVYTRYADDITLSTNKKHFPNEMIQLNKQTYTLSKSLFNKIENNGFKINDNKTRIRYCSQRMEVTGLTVNEKPNVTRHYIRNIRAIIRSIEKYGLEVAQEIHEGKYIKIHLKSTPQITNLLIGKLNYVKMVRGIEDSVFNKLAKRFNKAMGDELVETYKSKRELRELHTYVVDCGFIVDGEFINESQGSGFFLKGVGFVTNAHVVKLYKENNSNELPYEIRIHRSRYSDTVLKAILTIYNRDLDIAILNVEGFNSDYGYSYNLDNEYGQEIRVMGYPNHNKRDSLATDSGEIKQYRDNYLKETVNQETGELGDFQERFVVSARIVDGNSGGPVINNDDEVIGIATKGFRTLTDSGYDEDTDTSIAVKIEDVIKLIESKDQKDLNYQHY

SEQ ID NO: 1451 - protein, 487 aa, unidentified
  source 1..487: note = Candidatus Dojkabacteria bacterium; note = Related to JACPFP010000003.1
MDESQITNICTFDELANALEIEPSKLRYILWGKKPPSYYSRFTIPKANGTKRQISAPQGPIKVLQYRLLRILNAYYSPKRVVHGFTKGRSIVSNANSHINKNWVVNIDIKDFFPSINFGRVRGLFLKSFPGMTKESATAIAQLTSVFNSLPQGAPTSPIISNMICSRLDRDLMDFARQDNIKYSRYADDITLSGDGAVRSSIGEYSNGLLVLSSKCIKIFNDNGFQINSDKVRVSFKYRRQEVTGLVVNSKINVSRKYIRNLRALLHNIETLGLSEAQELYTEKYHGRGSLQSYIHGKLLFLRMVRGSSDNLYDRLVNSFNLNIADRPGNDSNTHLPTRAEIKAILSRLDPSYGNRYHRIWRELYDETDSTGENLKTALYLMREVIGGLIRRFAKNESVENYLNLSPNLRITRLQRCKYLSEKSLATGEERLAKLFMYIPGYYNDLNKLHSLEIVDKVDVKVLVDKVNELIIEVVKSIEMLELFRLS

SEQ ID NO: 1452 - protein, 552 aa, unidentified
  source 1..552: note = Related to JABBOU010000010.1; note = Acidithiobacillus sp.
MSFVRNRVNSNRNRSETIKEFCDNIGVSKEGFLLYNKENEKEYKVFDLIKKNGSLRKVKAPSAGLAGLQRKISKILQTIYNQPNCVHGYVPDRSVVSNAQCHVNKRYILSIDINDFFGSITRNRILGLFRSIFSDQNLCEALTNICVVDGCLPTGSPASPVLSNMIMFKMDRKIMSICKNNHVFYTRYSDDLTFSTKTKSFPSEFVYLDACGSLTLGKSIVAIFKENGFSINLKKTKLRSRSNRQVVTGVVVNKITNIPSSYMSNLRAIKNSISKHGVDGAQKIFDENYKETRYKNRVNIGHHISIKDMVRGKIEYIGMVRGKQDALYRKNLDWYNKNFRSLGDPEECVYPIYFIIDMPEKSKQKDHRIKNDCGQGTCFFLEDVGILTADHFLPSVEDVEAAGDHLRLYFETKDGCKHNVKIENRYPKIDMAVLSLEDNLFRSKKLYVNTDFSHSDRLTVSLYGFPDCAVGESLQVRDSVITGTRNRADEKEIIIRDGIKAGMSGGPVTDQANRVVGVIHKGGIDESGKCYYKPINDLYHIIKPMHSSNRSR

SEQ ID NO: 1453 - protein, 568 aa, unidentified
  source 1..568: note = Parcubacteria group bacterium GW2011_GWD2_42_14; note = Related to LCCS01000006.1
MVLNKNFPVDIPEDIRDCRNITDLAKLLNINLKALFFFAYKKERLYLSFNIKKKNGGARNISAPIEALKNTTKKINSYLSVVYEEYKPKSVHGFVYDRDVVTNAGNHLDRKYILNIDLLNFFETITAQRIYGLFKRYPFIFGNKFASILTGIVTYNNCLPQGSPCSPVLSNMVCLKMDKQLINLANENGWRYTRYADDITFSANKISSNLANFASDGINVGEKIVNIINKNGFAINEKKTRLSSHNQSKWVTGIKVNKKCNVSRKYVRNVRAMLHVWEAYDEKLAEKTYNAKYNFGKNKKFRSVVNGKIEHIGHVKTKKDLIYIKLHNRYCELVGESHKRLPETKKDEYLNKVLMIQGQSGYGSGFFITQHLILTCAHVVKGSKKVKFTTRLNKLPVEFKEASVIDINIEKDYAILFSEKKFNEFVFKCNLNKGLNMYSHNDAYISVGYAGFRTDGNFWVEPSIADQKIVQTNQRKNVNSFDVSGAMWKGMSGGPIILEHTDYVEGYIVNGASSLDTSEDVKSHSFYPISNIPKKYYEPKFLTLLIDEMYGSRFTETKEVGMPDQFFT

SEQ ID NO: 1454 - protein, 527 aa, unidentified
  source 1..527: note = Proposed Pseudocnuella soli; note = Related to NZ_CP037755.1
MNLPEAAYHFFEMSLFAKDDKSLLEAFYSAKNYIDLADVFEITPKQFKFHVFMVPGDKKYVQFTLQKKSGGVRNIYAPNGNLKFIQNKLSYILYKIYKPTFSAKGFVLNESIVSNARLHSGKKAILNIDIKDFFESINFGRVYGLFKSKPFSFNTEIAAELANICCFDNKLPQGAPTSPIVTNMICVGLDKNLQSLAKKYNLIYSRYADDITFSTDFKFLPQAIALGKLNVVEVGETVKSILIKHGFKINDKKSRIYYHFNRQVVTGLIVNKQVNVSRNYIRNLRGIIHSIEKFGLPAAEIEFQRKYDKQRLPGKSVPPFTFYLKGKLSFLAQVKGTESSVYISIVKKLRSLIPGEFEKTLTKLEELRKDFDDLNKLVYKGASITARQRGFEFEKFLAELFSFFKIDVTESFKRVGDEQIDAAINFDSWHYLIECKWKSTQCDTRDVDSLTMKLSRSGSQTGGLFISINGWSANVVENLSRNPIKNTILINGDDIKDILVEKVALDQLLKFKLQRLNLYSEPYARWE

SEQ ID NO: 1455 - protein, 466 aa, unidentified
  source 1..466: note = Melioribacteraceae bacterium; note = Related to JAIOIR010000177.1
MLSITNNTMEVVTDTFNKKYSKYFRNIDESTISEEQFSNRLKSSWKSSSWVNDNESFFANYLVNDDFLLQIIKNSTLPDFQKHLALEEFKRRWQQYEIAKEKFLQIVSGRDLAVFFELKYQSFLSTIGLLKFNNQKKYSEFTIPKKSGGARIINSPNQQLLHLQRKLNFILNLFYDPPKAAHGFINKIINKEKVSSRGIVSNAKSHSGRKLILNFDLEDFFPSITGNRIFSFFRASPFNFNKEVAGLLTEICCDPNIKGLPQGAATSPILSNMIARRLDIKLIHLASKHKLIYTRYADDITFSSNKLDVPSDFLDEFYSVITSEKFKINREKTRQHRYSQKQIVTGLIVNKKANVSRKYIRNVRAILHNIENYGYDKCEEVLNEKYAKSKKGMISLENYLRGRIEFIGNVRGKNKEQDKNDIYNKLKNRFENLVVGPSFEPSPIIENETSNRNSKTLSERMKEIDK

SEQ ID NO: 1456 - protein, 577 aa, unidentified
  source 1..577: note = Related to NVXJ01000024.1; note = Arcobacter sp.
MKIIRFLLNILEEFYLLHTRNFEYALWNIREYGYRTKKITKKNGTARELNIPPSFVKTMQKKINELLQEQYIAPKPVHGFIKADENNKKSIISNANMHTKKYIVINLDIKDFFDSINFGRVRGLFLSKPFEINEKIATRLAQLVINDNKLPQGAPTSPILSNFICKQMDHNLIKVAKKFSLTYSRYADDITFSSHKKNLNLKYIIKEITEVVKNNGFTVNTKKTRFQMAHHTQIVTGLKVNQKVNINTKYKKQIRSMLYSWFTDGLTKATQLHFKEYNKQKRKYLPEKEKSFKNIVIGKINFLGLVCGTDNPLYQKYRHTYFLLSDKFILTRKLDEYEELDINDIKRRKALSIFIQIYNSILIFTEGETDILYIKSALQSFQKKGMYLDLNLRFCNLRGWVNVKNIHEIFYKNTNKSNDLTLINRRKCVSPFIPKSFKLCFILDADDDGIRKYFKHQKHKNYHLIDEANQGYIEKFIDKNIIIDIIKNSGYSIDPTKAGTTKQKLIDHLKDNKEKDEIFSIDNYIVYKLLLIKKTELANIISKKDIDFSNFKEMFDFLKKLEPDNDYADELCCNSLY

SEQ ID NO: 1457 - protein, 568 aa, unidentified
  source 1..568: note = Related to SDAZ01000111.1; note = Sulfurovum sp.
MNELEDFYTHNKKVIEYALLIIRKENYTKKYISKKNGSLRELNIPPPFVMQIQKKFNSLLQKLYSPPAPIHGFIEKKDDIVKSIVTNANQHIQKHIVINVDIKNFFATINFGRVRGLFLAEPFKTTEQIATRLTQLVITENQLPQGSPTSPTISNLISLKMDNQLTRLAKRHKMVFTRYADDITFSSYRKNINVQEVIEEIEKIVKINGFSLNPQKTRVQYPHQSQTVTGLKVNQKINLDRKYVRQIRSKLFSWYSAGLDKATELHFEKFNKQSVKYASADKTSSYKKIVLGKIHFLGQVLGQDNSHFIRFLHTYYLLESNFVLDREKVEEIYEKFDLNNPNPNDVIKTFSQIYDSMLIITEGITDVIYIKQALKYFQSKGKFIDLKLRYCTMGGYVDVIKLHKILHDKDLCKSFCDVEKRNFILPLINKNLKTYFVLDADEKQILDYFNNKNQLMKNYFLLDEVNRGYIEKMIDKEIIIDFIMSKGYDIDPTREELGDKSKNGLKEYLKSSKFTDEEIHAPKNTSYIAHKKKIIEKTRLAKHIKNKEDVDYGNFESLFLKLDEIKNH

SEQ ID NO: 1458 - protein, 574 aa, unidentified
  source 1..574: note = Related to NZ_CP041166.1; note = Sulfurimonas xiamenensis
MHKIEEFYHSHKKIFEYALYQIRTKGYSEKIITKKNGGQRKLNIPPTFAKVVQKKLNTLLQDIYIPPKPVHGFIKSYKFDTKNIVSNALKHTKKSIVINVDIENFFNTVNFGRVRGLFISKPFEIDKDIATRLAQLTVFNNELPQGAPTSPIITNLICKKMDFQLLKVAKENSLVFSRYADDITFSTNKQNINIENIISDIEQVIVDNGFKINTSKTRVQLQNQTQTVTGLKVNQKVNLDRKYIRQIRSMLFSWYTDGLKEAAEKHFEKFNKQPDKYLTDLESSFKNILIGKINFLGQVKGRDNFLYIKYRHTFYLLDSNFSLSKKLNEFEKLDLNHLNQRCVTTIFTQIYSSILVFTEGITDIMYMKKALKYFQEKGKYEGLHLRYCNLESWSNVSNIHKVFYENQKDLSIINMRKCILPYVKDDLKFCFILDADDRNIKQYFERYKHTNYFLIDDDRSGYIEKLFEQGIVIDKIKKLGYTIDTTKEGLQKSTIKALKEYVSSELVTEEAIHSIPSTSYIAYKDKIIKKTDLANFITKDDSVTYDDFESIFVYLDSMKHNKDYVKPLCCNSLY

SEQ ID NO: 1459 - protein, 579 aa, unidentified
  source 1..579: note = Related to FAXN01000046.1; note = Sulfurovum sp.
MKILEQFYNDYEKLFELALYDNRKKKYKRKNISKKSGGKRRLLIPPETTDKLQKKLNRILQTIYNAPNSVHAFIKSKENEEKKSIVSNAKQHVKKQIVINIDIKDFFDTINFGRVRGIFLAKPISLDETLATKFAQLISYDNKLPQGASTSPIISNIICKKMDHNLIQFSKKHSLTYSRYADDITFSTHKNSLDTDFILNEIEKIIVDNGFEINTLKTRIQLANQSQVVTGLKVNQKVNVPRKYIRQVRSMLYSWKTEGIEEASKKHFKSFNNQTKKYIDSKEESFKNIVLGKINFIGQVKGTDDLNYIRFYHTYYLLDSSFSLKEKLDYFEHFDFYNMQQDRAKLLLTQIYDSLLVFTEGVTDIIYIKEALKFFKNKKMFTSLNLRYSYFGGYADVIKMHRILYDEHIVRMSKLNELDIANIRKCILPNIDKSLKFCFVLDADEIAIEKHFEKHDYKNHFLLDLKNKGYIEKLLDKELIKKIIKKYGFKIDVNRKEFSEKTKTELNKYMKIKNKYSNISAVSNYIAYGVKIIEKTNLAKFISNKDDVDYSKFEDLFCVLEKINHNFRSPKQLCCQSLY

SEQ ID NO: 1460 - protein, 578 aa, unidentified
  source 1..578: note = Related to NWVX01000040.1; note = Malaciobacter marinus
MNELENFYLTNKKNVEYALFLIRSEGYRNKTISKKNGNTRILSIPPDFTKIIQSKFNEILQELYIAPKPVHGFVKTNNDISKGIITNASMHIRKSYVINVDIENFFDTINFGRVRGVFLSEPFNTNEKIATKLAQLVSFENKLPQGAPSSPTISNIICKKMDHELIKIAKEYSLTYSRYADDITFSTHKKKINKIRILRAISKVIKNNGFTINENKTRVQKYIHTQIVTGLKVNQKVNIKREYIRQIRSMLFSWYKDGLASSADKHFDRFNKQESKYIDNREESFKSILIGKINFLGQVKGKENRLFIKFRHIYYLLRDEFKLLEKTNTKFSFEHIDVNNLTSNEVLKIFTQVYDSRLILTEGVTDVTYIKSALKYFQSKGEFQSLKLRYCWVGSISILVTFFKILYAHKMKELDIINKRKCVLPLVDKNIKISFVMDSNDDKINTFVKAKNFNNYYLLDLSNKGYIEKLLDKNKVIEFIESNGYIIDTTRPELKPDSKRGLEEYLLSSQKSDGEIHSVQKTSYIAYENKIIEKTKLSKLFEESEDIEYEKFRELFTHLEKIESISIQNEKLCTGSIY

SEQ ID NO: 1461 - protein, 574 aa, unidentified
  source 1..574: note = Related to PDKI01000002.1; note = Arcobacter sp.
MNELENFYITNKKNVEFALLKVRDEKYVIKNISKKNGKTRILHIPPSYTKIIQKKFSQILQKQYIPLKPIHGFVKIENNTSRNIITNASNHINKRYVINIDIENFFDTINFGRVRGLFMSNPFNINESIATKLAQLVTYENKLPQGSPTSPIISNLICRKLDHQLIKIAKDYSLTYTRYADDITFSTYNKKINYIRIIRDIDKIIKNNGFIINKSKTRIQKFNQTQIVTGLKVNQKINVSRKYIKQIRSMLFSWYKNGLENASNLHFDKFNKQESKYILDRNESFKNILIGKINFLGQVKGKEDRLFIKFTHTYYLLRDEYFLKEKQNKFEILDINNLKYCEIIKIFTQIYDTKLVLTEGITDIIYIKQALKYFKNNNKFKNLKLRFCQVGSISNLIEIYKVLFENPKDLTVINRKKCLLPYIDKKLNMCFVMDSDDKQIELLKKTLHFHNYYLLAEDIGGYIEKLFNKNLIIEIINKNGYVIDTSNPKLQDSSKKGLEEYLRSTKKSDNEFHAVPKTSYIAYENKILKKTELSKFIIDSENVNYDRFENLFNYLENIKIIDFKYDKLCSNSIF

SEQ ID NO: 1462 - protein, 602 aa, unidentified
  source 1..602: note = Related to MICH01000013.1; note = Sulfurimonas sp.
MFFKNFLRNTTKHVLNLFKKKKNYENILIDEFHNRESKIFYKNNKKIIELSLSNIRNNKAYFHKEISKKNGGKRRLSIPDSYTKVVQKKINILLTKFYHAPKSVYAFVKSSDNKKNIVTNAYMHINKKIVINVDIENFFNSINFGRVRGLLMSYPYNIDKDLATKIAQLTIFNNQLPQGAPSSPVISNMICYKLDKQLMHLAKEYRCMYTRYADDITFSTNDKYLNQKAFFKELNKKINENGFSLNSSKTRVQKYCHSQIVTGLKVNEKVNLSKKYIRQIRSMLHSLHKDGLAEASVKHFKLYNIDEKYSKDKEKSFKRILRGKIDFMGMVLGKEDYKYKKSIYLFYLATNNYLPLNYYQKLEKMNSEDEDFLKLSLQEMYSSIVVFTEGETDITYLKAALNFFHSKDKFLELKIRFVSLGGFPEVIKYHKAIFLTKNDNVTLELREKLSPYLNKSVNYYFLLDADDPDIKNYFNKTYVPNSFYLIMEKTDGYIEKCFQKELIKDIINKHGYKIEPEKSTKQKVTNQLLNHLRNNSKKDDFFSIDSYIVYAEKQIFKTILAKYICDNKEVDYSVFKDFFDFIIKNKTNNLIPTKLSIDDEYK

SEQ ID NO: 1463 - protein, 523 aa, Leptospira sp.
  source 1..523: note = Related to NZ_AP025028.1; note = Leptospira kobayashii
MAKVRTLIWAFLYHMLTLDEFEEKIGISIGKLNYIGYILKEEDKYLNFEISKRNGNSRQINSPNSILKHIQNRIKLILEENFHPYSVVHGFVNDKSILSNAKKHLNAKWILNLDIENFFGTINFGRVLGLFLSKPYKFDKKIATLIAQLVTYQNVLPQGSPASPIISNLICNKMDRDFISFCKSKHLIYTRYADDITISSQKRKYMNFDSTLDEDLLEDIKKLVNENGFKINSDKVSFSYGKDGGIVTGLRVNEKINIPRKTIRSLRGLYHSIRSNGYQVANEIYNRKYKNLNRLPKENKELINHINGHLNFIFMIKGQFDDVYSNYYNKFKTQLKLNIKSPIPKSVWDYIFIMESESTQKQGTAFKLNKFGIISCEHVYDNYSKIFLKNNFSKKFDLELIKKDERIDLIKSRALDLFIEDGLEINLDFHYKIGSKLRLLGFPNYRIGDSGMDKLITIVSKRTVSGVERILVDSGIVAGNSGGPILDLNGAVVGIAVTGAEDHDKLDVTENHSFIPIKYLLQF

SEQ ID NO: 1464 - protein, 618 aa, unidentified
  source 1..618: note = Related to LKGI01000141.1; note = Lacticaseibacillus paracasei
MDNPFSELDTNEISASFRHISNVSELASFLGVTRQKLFYYCAEHLNKKHYELFDIPKKNGGTRTIEEPTKGLKLIQKKIAFAVSINYHPAACVSAFTEGRSIRYGAERHKGARKVVCFDLENFFPSCPQYKVFGVFYKFFKLPKEVSDCLARLCCYKKHLAQGGPSSPILSNVMLNSMDKKFLSLAKKTKTVYTRYADDMSFSSKGDMPSLIWQNNNISSYITSIVQESGFHIKQEKTRILGRSCRMQVTGVVINKFPNVPRTYYRRVRAMLHNFKTTKDYEETKKNFLKYYGKSDDCNPAKVIQGMISYIFQVRNDGGTHSTLARNMMQEFNTIQWPGNEKFKVEMAMPHSYKLHKAVFAVETKIGEDFFYGTAFLCNNKIISCSHIFKKGHEKKLSDEIEYVHLIEHNVEDNSIYKKYNVTRIEYWPDFDVAYLHTDSCINKAKQKQFSTPNFLHQGGNKVFVVGFPASLQTGSSSRMYEEKETIQEDHRVELQYNEFAVGQKQTIIDKRRMTFISNQNGGINPGNSGGPILDISEKKVIGIALKGDNVKDSKSLSNNRSEFFDLYEWLNMDKPKAFTWEKIVGKLKFEFKHLYLFVYIHNSKNCDLLGRLHNKLF

SEQ ID NO: 1465 - protein, 406 aa, unidentified
  source 1..406: note = Related to NZ_CP065154.1; note = Lacticaseibacillus paracasei
MLSNIILYAFDKQMLELARRTKTVYTRYVDDITFSSQNTMPRLLWQGENWSTTVKKIVEEAGFQLSEEKTRKFGKGNRLSVTGVVVNEKMNVRRMYVRKIRAMLHNFKITEDYDSTVKKFNGFYLKDKIVDPERVLKGMISYVYQIRSDPEQDQVLSRRLMQDYNSINWPGGSRFELKLAIPQKFKRYNAIFAVEVVTLFKDFFFGTAFLCDGKIYSCCHIFENRNEPDDQPKSIKLIEFDPETLEVHKTYKVDKVDLWSEDDISMLYSSALNKTKRKSFNSPAHPLKGPAKVDILGYPEAFQIGEKSRMYTAEETTIITIGDNISQSHKSENSRSVVLLTNDNGGIQSGNSGGPVVSIGNGTVVGIAIRGAQPKDGNYEVVRSEMVDFYNWLHSNKRTPETLRLR

SEQ ID NO: 1466 - protein, 580 aa, unidentified
  source 1..580: note = Related to BJWE01000002.1; note = Pediococcus parvulus
MKDLFWTKNNTDIKRQFPDLKSARELASFLSIKYSQLTYYVSKGKKYKSFQVKKKNGEIRILEAPIVGLLLIQKKLAYTLGLIYTPSPSAMGFVKGRGIRKNAQVHVNSREVLNLDVENFFPSIRSNLVFGVFHKFFRFNIKLSDTLTKLVCLDGALPQGAPTSPILSNIIMNSIDRKFTALARSNHCLYTRYVDDITFSSRNTIPRTLFRNKDVSDLIKQILKEKGLKVNENKVRLRKRFQRQDVTGVLINKKINVQKNYLRLTRAILHSFELNEYKDAKKVFLSHYRNENHLGKKIEPEHVVKGMISYIYQIRKDPKDDEAVSRKLMQRFNRINWPYNSKFDQKISNPVLFQKLNSTFQVYVSFKKENGDFDRFTGTAFLCNGEIYSCSHTFVQGSRKNVGPELNDAQLVEFDSFKKNQRKCYKITKIEYNTDLDFCHIYTNHKFEGGFRKPTTAPYENEKLQVVGFPSILDHNNTVGLYQKSGRITSTFSEPNPDYDKEKGEVEDGKLFMPLKQRLLINTDATILEGNSGGPILTKDLVVIGIVLKGQNRESATNNTALDFNFALNSDFLMKKYYLK

SEQ ID NO: 1467 - protein, 538 aa, unidentified
  source 1..538: note = Related to NZ_AZLR01000004.1; note = Oenococcus oeni
MNAESKKIRSQFTQLFNVDELASFVGTNAQTIQTITNKTTSYYKSFELKKRSGGSRTILAPKQQLLSIQKKIATTLEKIYPVSIYSHGFIYKKGIKTNAEEHLRSTELLNFDIDNFFDNIPEYRIFGIFRYYFNMNNYISGILKELTCVERHLPQGAPSSPILSNIICYKIDKDLGKLARRNHCKYTRYVDDITFSSKRKLPSSIYNRINKSCSNNIVKILSDSGFTINHRKTRLLTKSQRQEVTGITTNKQLNVSKTYIRSTRAMLYNFKNSKYQVANAKFKKYYKAKQNLNPNSEILPEEIIKGRISYIYQIRKSRKEQSLDNSVTHKLMQSFNMVYWPKGSKFDQKIANPEKFKLYNSIFEIEVKAKDEDLCEKDNIMTYTATAFLCEGKIYSCFHIFKKPKQIIEPKLKEYDCYTKKIRATYEIASIDFDQNFDVSIIHLNNTCKIKKSGFKSPKKDATENEQLILAGFPEFSHHQGNTLNLYKKNTQIEDIYKENITKLNKPPYSFSNKMKAEKNLLFFQYFSLFNKIIAVFV

SEQ ID NO: 1468 - protein, 584 aa, unidentified
  source 1..584: note = Related to JAAUUP010000156.1; note = Deltaproteobacteria bacterium
MDEDKKYKTFTIPKRSGGRRQILAPCGPILGLQHKLRDFLDACYEPPPSTHGYVPGRSIRTNAVPHEKCQYMMKLDIVDFFPSITFARVYGLFKAAPFRFTNKVASTLANLLCYREVLPQGAPTSPVVSNLICQRLDRDLLKFAREYSSQFTRYADDLTFSTKDGAQWGLVVLNDKRKCPHPEIERIIQENGFRLNEAKTRFLNKYCRRIVTGVVTNERLNVPQSYLRTTNRMLKLAGTNGLDNVGRWYCQDNHIFSSTVMNFADYVVKVLQGRIAYAKMIRGSDDPICQKHSIYLDNIVSGRPLTYGAGNYMKFAKLTPLRVLHLSDFHFRVETSWNATPLLEDLVNCIGDPARMSLLPPDLVVVTGDIAFSGRKAEYALAADFLSQLCARISLPINRVFMVPGNHDVDRAAVSDVALREQKDLLKLDEPGARISAMFKDADIRRVLLRRLDSYVDFCKNFYGSGLRAEPWWKETVQVRDMNIGISGLCSSWMSVSDGEQGQLMLGLPQVNEVMHRGFTHDLTMTLLHHPLNWISEKDAESVDEIRAWSDVVFHGHVHTSDIATTYSQCRGDDDIGSRSGVRW

SEQ ID NO: 1469 - protein, 346 aa, unidentified
  source 1..346: note = Related to NZ_CP029480.1; note = Arcticibacterium luteifluviistationis
MKKLYLADIEERSRRFLGCRTIDDLCCLGFVKNELLLHSLNISYYSFELRKKSGKMRQIESPNESLKKVLRQFNYYLQCVYYIHQTDASQGYIITPKKSKVCKSILENARVHLRNRFMLNIDFQDFFHQISFERLAKRLSETPFKFDTSTSKLLALLFTYKGRLPMGAPTSPVLSNLCVMKLDMEMSEWSKKNGVTYSRFVDDLTFSRDDSEFISDTYTEINHICLKHSLKVNPAKIKYFGEGSLRKVTGLILRETIDIEDGFYHELDKDFNRMKNLVEVVIINHGVKSNDEVQTFKKEIEGQINFIGMVEGYNSPIFNQYRQKLKAVMNPAEEVLSVRWTNFNYV

SEQ ID NO: 1470 - protein, 346 aa, unidentified
  source 1..346: note = Related to nan
MRKLYRDEVKNRACQFLECQNMIDLHRLGFDTARIKLLALAPPYYCFDMPKESGGVRHIEAPEEHLKDVQRQFNRYLQCVYFEIQTPPSYGYIIRTKGQTPWKNVLENARQHLGARYMLNVDFKDFFHQFTLRRIHRMLQCPPFQFDNKTAHLLARLFCYKGRLPMGAPTSPALSNIGTIAFDNDMYAWASNQKLTFTRFVDDMTFSSPIVPLTDEHLAHINTICQKHALLINPDKTVFFGEADTKKVTKLLLRDTVDIDPDFYRELDKDIIRLKHLTEVNILMENHKRGQLLRKFKKEVEGQVNFIGMIEGFDSSIFYKYRMKMKEALKPDNKALSSRWTNFNYF

SEQ ID NO: 1471 - protein, 346 aa, unidentified
  source 1..346: note = Saprospiraceae bacterium; note = Related to BQJU01000031.1
MRKLYLKEVEQLAKQFCACENLKDLERLNFAINRIRLLSLNPQYDVFKVPKPNGKTRLIEAPEVELKEVQKQFSNWLQCVYFLLQPKSVFGYIQRVKDVLPAKNILEHARQHLGAIYLLNVDFQDFFHQVSHTDLVRLLQRPPFRWTKKAAAILAKLFTRNGRLPMGAPTSPVLSNFAAIQLDLDMEKWAQKQGINYTRFVDDLSFSTKDQALTTAHLDQVKTICAKHQFVINPQKIKWYPPGVSKKVTGLVINETVDIDPSFYQELNRNLNRLQGLSDVNAIVNQSRQNDLYQDFKKEVQGMINFIGMIEGYGSQLFFDYRQKLKEALHVSPECLSVRWTNSQYF

SEQ ID NO: 1472 - protein, 339 aa, unidentified
  source 1..339: note = Related to JAIOTP010000164.1; note = Desulfobacula sp.
MNRCFSSFMAMREPGDMCALLRLPLFKLKLLSLRSVYNTFEIKKNGGARLIETPAQPLMKYLKSLKNFLQAAYYYLKTDAAYGYILNPGQTKNPRNIMTNAKIHLGNPWMLNIDLDDFFHQVKEKHVQQIFGMLPFRFSGELVQLLCKLSCYKGRLPMGSPTSPPMSNFAMIPVDNRLLKWARSNGIVYTRFVDDLTFSSQKPINSCTLTRIEEILYEYRWKINQDKVVLFGESDIKKVTGLELRNRVSVPDTYFEEVAKDIVRLEKAKELVIRAPFHESTAWIKKLEQHVNGQINFLGMVYGYGSPEYLNKRTKADAVLQRDYEPESLNWLDFPYQFF

SEQ ID NO: 1473 - protein, 336 aa, unidentified
  source 1..336: note = Bacteroidetes bacterium HGW-Bacteroidetes-7; note = Related to PHDA01000024.1
MLGKIKTTKELALYLGTSYEKLNKIDPEKSFASFYINKHGSTEKRLIEYPRGELFRILDRLSDGLQWLYLDHLTTAAYGFIRKLKPNKDPRNIYTNAKRHLGKKYLLNIDLDDFFHQVDTRKLQNLFSDYSLFSLNQESEQLLVKLVSYRGRLPMGSPTSPSLSNFATIGIDNDLSVWAGRNSFDYTRYVDDMSFSSNIKITQNHINQIIEILFAHRFLIDPNKTKIFGPQDTKEVTGLVLGKTITVPDEFINAFMKDINRFSEMHHLACQNPDSRVFEWLEKMRKVLQGRMAFLKMVHGPKNETYKLFQLKLDNIYKPELLETSVSWRYAGYEYS

SEQ ID NO: 1474 - protein, 348 aa, unidentified
  source 1..348: note = Related to NZ_FNZH01000018.1; note = Cyclobacterium xiamenense
MAVGYRHIYRTARYLRSCRQLSDLEGLIKVSKADITLHSLHPKYYEFRVLKKNGGFRKIEAPQPGLMDLLRKLNFVLQCLYFFEKPPASYGFVMSHKGNKQPRNIRTNAERHINSACMLNVDFEDFFHQIKVDKVYAVLVNPPFHFSRESADVLATLCTFKGRLPMGSPASPALSNFAVRDMDWMLDAWSKERGYRFTRFVDDLSFSSETSAFHPTMMPEINAILSNFNMKINPTKTKWFGPGEVKVVTGLEVTDQVRIPGSFYYDLSNDLKRLKYSIEAQVQVMGSQHNEMVEKLKKQVRGKINFVGMIQGKGDRKYTDLLRDYDNAIHPDIDKLSVRWVDFPYQDF

SEQ ID NO: 1475 - protein, 344 aa, unidentified
  source 1..344: note = Related to JADJWN010000021.1; note = Saprospiraceae bacterium
MATPIKTIRTRNHAFRSMRVIGDLCRLTGESNLVLGLMADKPRYRQYFMRKKDGSKRPIEDPDARLKAVLRVINDHLQAVYYYLRPGAVHGFTISSTSDETERNILSNARAHMQSHYMLNLDLKDFFHQITQKSVVQLLSSHFDQWDDSLIHLVAGLCCFRGRLPMGSPASPALSNFAMTDLDHELMTLCKVYDVVYTRYADDLTFSSREPMSSVFRDMVNDAVRHRGFEINPKKVRYYIMEDSKVVTGIIVTKDELCLPEEYMHQLRKEIDLYRNSVIVDTMYETGMSGKKLSLFEQEITGKLSFAKMVMPDDDEVKELEDLFYNEVDVHSVMQSWLDIPYIF

SEQ ID NO: 1476 - protein, 350 aa, unidentified
  source 1..350: note = Related to JAGQVH010000109.1; note = Chitinophagales bacterium
MHMGSSSLRFFRSNAKRFASVRSKEQLARELDSSKYTLELLAVSPPYRSFKIPKKDGTWRSIEEPEEELKLVLKLLAFHLQTVYFFIKPPCAYGYILSHRSDPDKRNIVTNAHRHIQAHTLLNVDMRDFFHQCDEAEVVSVLRPHFPEMEQDCLELIANLTTYHNRLPMGSPASPVLSNYAAFRLDHAMLAWSQERNIVFTRYVDDMTFSSRTVLPVEYVKQLEEACAKFGFPLNPAKTKYYGPEDEKYVTGLMLTKEEVVLPGKYFSFLQDDLDRFAALYPVFSCLSDERSSAWVWHFEQGLTGRINHIGAVYGRSSATFRHYQKKLQAAKRPVAEEIYMNWLDLPYET

SEQ ID NO: 1477 - protein, 349 aa, unidentified
  source 1..349: note = Related to CP083757.1; note = Cytophagaceae bacterium
MTFGDIQTKASLVSKCDTLTELCFLLKTPRKALLAIADKPDYNEFFMPKPDGKGRRLIEDPVAVLQYIQEILNDYFQAVYYLIRPEAAYGFQLSFDDDHAGRNIRTNAERHLHKPWLLNMDFKDFFHQVTSQKVEMILRGDSFSFDKECVEVLCSILTYKGRLPMGAPTSPVLSNMAVMEMDNQLGQMAKEKRLIYTRFADDLTFSGHQEINEFTIKAIKAVVAQFDYFFNENKTRLFTPEMEKTVTGVKLGDRLGLEPKYLDKVSLEIQKYEHTKEIQGINGIESSEYLTKYEQQLSGHIEFIGFIYGKQAPEYVHLKKRYDKAESSSYFDSRSWMEFDRHYTFFNKK

SEQ ID NO: 1478 - protein, 348 aa, unidentified
  source 1..348: note = Related to NZ_KE384045.1; note = Runella zeae
MARLNKIKKIKKLAEYFASIHTTEQLATFVGVPVYQLTLLAEFPAYNCFSIPKQNGKPRMIEDPHKPLKKVQQILNSALQCGYYCNKTHAAFGFLLNPEDDTDPRNILTNAQRHINRLWLLNVDYVDFFHAVSTHRVVELLLSDYFSFDEPTALLIAQLCTYKGRLPMGAPTSPVLSNWAARTLDEELLAWSHRHGFVYMRFADDLTFSRQEPILPQHVQEIRAISTVNGFTFNEQKLKICAPSAEKIVTGLVVGKNGVQLPSGFLGELEAEILKFRTVLEVQARAGRAQSVWVEEFRTQLEGHLSFASFVLGEDHADYRRLSRLLEEAMQPSVAHDSVSWLHFNYFF

SEQ ID NO: 1479 - protein, 365 aa, unidentified
  source 1..365: note = Related to NZ_FOFB01000012.1; note = Lewinella agarilytica
MAKKVSIYELRRRANSFLACKGTLDLARHWRVDNVRLAVLAIEPEYREFRIPKKKPGTFREIEDPRPKLKAILRKLNRDLQAVYYFQRSPAAYGFLTSPARDPDPRNILTNAQQHLGAKWLMNVDMRDFFHQIETHEVAELFRQPPFSFPKATAKLLAGLTTYKGRLPMGAPTSPILSNWYAIPLDKTLTEFARQREWTYTRYADDITFSSKTSPIKFEDVGRVNVLVRGRELELNHNKTVIYPPDAPGKEVTGLIVGAEQVQLSSEFLAKVKDGLRRLNDVVDTKYLMPSGRLAKTPWVEEIAQQVRGLVSFAQKVLPPADPLGMELEEAYATALAPPQNYGPVSWLEFGYLDFRIDTNPDQIK

SEQ ID NO: 1480 - protein, 360 aa, unidentified
  source 1..360: note = Related to RFJJ01000149.1; note = Bacteroidetes bacterium
MPKRPTIRTLRRHAEQFRACRGQTQLSWLLRTEPVRLAMLAADPKYATYRIPKKRKGTFRLVEDPEPRLKRVQKRLNYYLQAVYYFHRPKNAFGFITNPVDDPDQRTIATNAARHLGCQWMLNVDMKDFFHLVNRERVYELFRASLLKFPKNLARVLADLCTYRERLPMGAPTSPVLSNLACIPLDHDLDHFAEQRGLTYSRYADDLTFSSREQPINWELIPQINEWITAYDFQLNPAKSKLYGPADPHKEVTGLIVGVQQVSLSPDYIASLRKGIQQLDQVVNAKYVMPSGRLRATTWVDEIAQQLQGRLAFASQILPDTDPLRIELETAMDEALAPPTEYGPVSWLDFGYTLFNMPPA

SEQ ID NO: 1481 - protein, 375 aa, unidentified
  source 1..375: note = Related to SBLB01000002.1; note = Spirosoma sp.
MPGYRYESDGEEISIARGHTIDMKYTRKRVNWLARQFGQLTDPASLSQLLGVQLHLLQLLALQPRYNTFRVPKKNGTFRLIEDPEPHLKQVQKRLNTYLQCVYYLRRTPATYGFQISVDGDNDPRNILTNARRHVGNPWMLNADFLDFFHQVNYDWVYRLFTREVFTFEPDLAELLAKLTTYGGRLAMGAPTSPVLSNLATMPVDDALTELARSYDWTYTRFADDLTVSAQACIAPAQVQEFLNTIAPFGLAFNEAKFAVRSPAMPKTVTGLVVTAQDVQLPASFVTDTLTEIEKLGHLLEIHYRSGRPVTRWLEQYQQQVEGQLAFAEFILDDADSQLHSLRAAFVRIQQTPDLGEPVSWINAAYLEPASHTLY

SEQ ID NO: 1482 - protein, 350 aa, unidentified
  source 1..350: note = Related to NZ_CP013355.1; note = Lutibacter profundi
MKNQKLTLNQIKRNDVLIKKCKTSKQIASLLNCSAKELTLHSFEPIYYHFKVPKKRKGAFRYIEAPSQEIKHLQRKLNYYLQSVYYLNQSKASYGYIIKAIGQKNTKNIYTNALQHLGSTYMLNADFKDFFHQIALNDVVQIFKSKLFNFNKNTAYTLAKICTYKGRLPMGAPTSPALSNLYSIALDHDLSTWATLNKLIFTRFVDDLSFSSKNNLLNQTHFKQINNIALKYHLNFNPNKTKYFSKTDKKIVTGLVLNNTVDIDKSYYNELDKDINRLQKVIEVHHITGKTQGLAFLKEFKQQIMGKINFISTIEGKNSKQYLTYLNSFHNALEVNNELVNRWTKFSNYI

SEQ ID NO: 1483 - protein, 349 aa, unidentified
  source 1..349: note = Related to NZ_FOZP01000010.1; note = Lutibacter maritimus
MKQQKPTLNQLKWYENQIFNCKTLEEISVLLNCSKNELLLHSYNPEYYQFSIPKKSGTFRIIEAPNESLKRLQRNLNQYLQAVYYLNQSVCSYGYVISILGEKQTKNIYTNATQHLAKPFMLNTDFKDFFHQIKIDDVTQIFKSEFFNFDIYTATTLAKLCCYKDRLPMGTPTSPVLSNLYTLKLDNELLQWAKKHNTSYTRFVDDLTFSSVTTSFSPLHFKQINEIALRHKLNFNEEKTRYLNSDDIKTVTGLVLNTTVDIDNAYYLELGKDLIRLKNVMEVYYITGKTHIITFLKTFKQELFGKINFIGTIEGRNSKQFLNYLNLFYNALEPDTDLVQRWTKFSNYV

SEQ ID NO: 1484 - protein, 347 aa, unidentified
  source 1..347: note = Bacteroidales bacterium; note = Related to JAAYJT010000001.1
MKITFKKLKKEADLFCKLSTLNDLAAVISVSKNEILLMAFEPVYYHFTVPKSTGGQRYIEAPDIELKKIQRRLNYFLQKVYYLNQSRAAHGYIISVIGEKNPKTILSQAEKHLGANYMLNVDFSDFFHQISITDVKNIFQCSPFKFNQYAAYTLAKICCYKDRLPMGAPTSPVLSNFYTRSLDEDLIKWSMPQKITYTRFVDDLSFSSLDSPFNITHYEQITEITNNYGLVLNPSKTVYYDIKDEKIVTGLILRETVDILPEFYEELDKDINRLKAINEVVYITGKIQKPLMLSTFKQEVMGKIAFIAQIEGKNSPEYNHYMEKYEDAEAPDEELSVRWTKFGNYLI

SEQ ID NO: 1485 - protein, 350 aa, unidentified
  source 1..350: note = Related to JAIORQ010000052.1; note = Bacteroidales bacterium
MSKKHTKKQILNKAAEFSNCKNIKQVSFVLKVSPMQLATSALLPQYYYFKMKKLKGGFRNIEAPEPPLKKLQRKLNTYLQYCYYSEQTKAAYGFIINPRKQKAKNIVSNAQQHKNNSYMLNIDFDDFFHQISIKEVIAIFRKSPFNFNKNTAGILSKICTNKGRLPMGAPTSPVLSNFACSGLDKELQQWADTRIITYTRFVDDLTFSSNMPITKQHYNEIKEITDKYDFQIETTKTKWYGKEQEKTVTGLTVGETIAIPEAYYTELDKDLHRLQKTTEVHIITGQVYKADAGKKFKQEIMGKINFIAVVHGYDGNKYETYMQKYEDAINPPDKDELSMRWLRFSNYMQF

SEQ ID NO: 1486 - protein, 349 aa, unidentified
  source 1..349: note = Related to JABXHO010000062.1; note = Flavobacteriales bacterium
MKLNQKLTRKQIYKKAKMLFSCTTLKDVEQLIGAELNSISLHAFDPGYFHFTMPKSNGELRYIEAPEDELKRLQRKLNHYLQCAYFVVRTPSCYGFTIGAISEKNPRNILSNAQKHLNCSYLINVDVDDFFHQISTERVQFIFENDPFRFDRYISKTLAKLCTYKGRLPMGAPTSPVLSNFYTIEPDTELQKWSENQSITYTRFVDDLTFSSTKNLNSRHIESISGILDGFNLPLNSGKHKLYGPEDPKTVTGLVVGNSVEIAPSFYCALDEDLVRLKKVVEVHQITGMTSGLSFLKRFKQEVMGKINFVKQIKGTFSEEYVRYLDQFHEALEPDERFVARWTSFNNYV

SEQ ID NO: 1487 - protein, 350 aa, unidentified
  source 1..350: note = Saprospiraceae bacterium; note = Related to JADLBE010000330.1
MNKRHTSEWRRLGEDLLQTRTPDDLSRLLGITTARLADTAEAPAYATFYVDKRNGGKRLIEDPAPPLKALQRRLNDLLQGLYWLERSEAAYGFVVNPLDDPHPRHIVTHAERHLGCRRLINVDLEGFFHQIDNDRVRKTLLAPPLQLEAEAVELLVALTTWKGRLPMGAPTSPVLSNLAFRDEDLYLTRFARDRGWLYTRYADDLTFSSRNQDMEPHHLHEIVQHLEDGLKYTVHPEKRRYSDDGDIKSVTRLVLEGNQVTLPEEYFHQLDETLNDLSSARRVHHRMGGRHTLWLEDYNARIEGLLSYARYVLDERDPVYMDLKRRYDDANQASPDDFGAYTWFDFPYFE

SEQ ID NO: 1488 - protein, 347 aa, unidentified
  source 1..347: note = Related to nan
MLSLRQLQYRRNRLTKLRTMQELCLLLGKPGHKLELLCAQPMYNEFHIRKRNGGKRHIEDPRPPLKRVLGILNDLLQGVYYFEKTEAAYGFIAIARDDPAPPRHIVTHAERHLGCRWLMNIDLTSFFHQISTEMVLDRLKDPPFHFDDEVADLMARLCTYKGRLPMGAPTSPVLSNLVFQREDEVLKAWADDHGWLYTRYADDLSFSSQKEISSWEMQQTINLLENHSYAVHPEKRRLYGPDDVKNVTRLVLGDGELELPPDFLEELRDCIEDLRRTTRTHLRMGVARPPAWLTKYRQRLNGMMGFAKHVLGEYDEDFLQIQRSYDEAVNPPDEDFGTYSWLDFPYW

SEQ ID NO: 1489 - protein, 345 aa, unidentified
  source 1..345: note = Related to JAGQXW010001063.1; note = Saprospiraceae bacterium
MDNSIAALAGLRKAFFAMRTAGDLAELLAVSPAHLVAVAFRPWYHIFELPKKDGTMRLIEDPDDRLQPLQDGLNDYLQAVYWHQRSPAAYGFLVIPTGDPEPRHIETNARKHIGKPWLLNCDLEDFFHQITAGRVHKLFADAPFGFDEEVCDLLVRLTTFRGRCPMGAPTSPVLSNLVFSATDADLTDLARRRGWTYTRYADDLSFSSYDPLDWDDYTHIQRAVIRHDYEFNPEKAALFGPDDPKIVTGLLLGTQDVEVPPDFFPQLTDDIHQLAGAMRVQFRVNPRGSRTTARFRRSVEGKLRFAERIMGRKHPGVAKLWKDYRNAVKPPAKHIQRSWFDFEYW

SEQ ID NO: 1490 - protein, 355 aa, unidentified
  source 1..355: note = Related to JABAQK010000028.1; note = Haliscomenobacter sp.
MADTITIKGMESRARRFLDVQTVEQLAKILGKDPMKLAVLAALPQYREFDIPKKNGGKRHIEDPAPPLKKVQRKLNDFLQAVYFFHRTDNAFGFITNPVDDPSPRHILTNAQAHLGCRWLLNVDMKDFFHLVSQERTEQLFEAPLFGFGEHVSTLLASLACYKGRLPMGAPTSPVISNLVSIPLDEDLNAFARERGWTYTRYADDMSFSSQTEIPPDAVQEIEAWVKAYDFELNPAKVKLFGPGSPNPKEVTGLHVGETEIGLGADYTGQLTGAIQHLNDIVDAQYLTPSGKSQPSRWVEELEAMVRGKLEFARQILGEADPLYQDLSLRLENALEPPETYGPLTWLEFGYATPR

SEQ ID NO: 1491 - protein, 353 aa, unidentified
  source 1..353: note = Saprospiraceae bacterium; note = Related to JAEUUQ010000028.1
MADTITIRGMRGRADRFLACQTFDQLARLLGKQPLQLVGLAAHPQYREFYIPKKSGGKRLIEDPVPPLKKAQRRLNDYLQAVYYFHRTASAYGFLTNPVDDPQPRHILTNAGQHLGRPWMLNVDMKDFFHQITQERAQELFKAPIFGFNDEISTALAALCCYKGRLPMGAPTSPILSNLASIPLDQDMEDYARDRGWVYTRYADDMTFSANEPITEAHFSEIENWITAYDFILNPTKKRFYGPGDKKEVTGLVVGDSEVELADDYLDMLTGAIQHFSDIVDAQHLTPSGKNQPSPWVAELQAQVKGKLEFARQILGENDERFIDLETRLIKAAEPPESYGPLTWLEFGYDVKL

SEQ ID NO: 1492 - protein, 354 aa, unidentified
  source 1..354: note = Lewinellaceae bacterium; note = Related to JACJXZ010000021.1
MADTITIQGMRNRAKRFLSSGTLEGLALSLGKASLKLLALAEQPSYNEFRIPKKSGGMRRIEDPTPELKKAQRKLNDYLQAVYHFQRTDAAYGFLANPVDDPSPRHILSNARVHMGCRWLLNVDAKDFFHMVSEERVKQVFQSGPFHFEEPIAGLLASLCCYKGRLPMGAPTSPILSNFASVPMDHALMELARKYDWKYTRYADDMTFSAQEEITEAHFAEVGAIIRSHGFLLNPEKKKHYGPEDEDKEVTGLLVRESRIDLPEGYLEQLEKAIDHLDKAIDAKYSMASGRGQKTAWLEELEQQIRGKLEYARQILGEGDLLYLDLVVQLDEALTPPDYYGPMAWLDFGYALPK

SEQ ID NO: 1493 - protein, 350 aa, unidentified
  source 1..350: note = Bacteroidetes bacterium; note = Related to JAIUPL010000043.1
MANHPSRLELRALKDAFLAIRTPADLCSLLAEDMLELSALALKEDNYEAFFVQKRNGEQRLIENPSPPLKRIQRKLNDCLQAVYHFHRSSAAYGFLSACSDDPPWAHRGIVANARQHLGRPWMLNMDVEDFFHAILADRVAWVFLNKPFSFDTELTNLLMRLCIYKGRLPMGAPTSPILSNFAARLLDTDLELLARSKQWLYTRYADDMTISSRQEITEDDVQLLRDYYRAHSFEANEKKTKLMGPKDVHTVTGIVLLENRLDLLPEFFEDLDSEIGKLSEIAGVKGRLGITLMDWVDDYAEKIQGMISFAAHVLGESDARVVKAEKALGKAQHGPKDYGAVSWLDFPYH

SEQ ID NO: 1494 - protein, 347 aa, unidentified
  source 1..347: note = Lewinellaceae bacterium; note = Related to JACJXW010000005.1
MDKKTRQRHQHNKAVFCSIRSIRSLCSLLKTDQRRLLLLARQPPYKVFTVPKKDGGERQIEAPGAELKKVLGHLNRYLQSVYYFEKSSAAYGFIVGVLNDDDRRNVVTNARKHAGRPYLLNIDLIDFFHAITREQVVEIFQSKPFQFKKDLPELLADLVTYQGRLPMGTPTSPVLSNLACRELDEQLSAFAEDMLWVYTRYADDMSFSSRKPIDADKIDSVRAIIEKAGFEVNQRKLKTYGPEDDKIVTGLLVTDKVTLAPDYLPQLDEDIRQLQNVLLIQNEQGQLSTRWVEQFKKNIIGRLNFAGFVLKRSDERYIDLKDAYYTAINPPQEDFGAVSWRGFPYNL

SEQ ID NO: 1495 - protein, 347 aa, unidentified
  source 1..347: note = Related to JAGQXN010000602.1; note = Phaeodactylibacter sp.
MDKKTIARHQHNRDVFCSINSIRSLCSLLKMDQRRLTLLVRQPPYKVFTVPKKDGGERIIEAPGTDLKGVLGRLNRYLQSVYYFEKSSAAYGFIVGVHDDNDRRNVVTNARKHAGRAYLLNVDLTDFFHAVSRERIVEIFQSKPFQFKRDLPDLLAGLTTYQGRLPMGTPTSPVLSNFACRELDARLTTYSGNMLWVYTRYADDMSFSSNKPIDADKVDSVRAIIREEGFEVNERKLKVFGPEDDKIVTGLLVTDKVTLAPDYLSGLADDIHQLQNVLLIQNEQGQLSTRWVEQFKKNIIGRLNFAGFVLKRNNESYMELKDAYYTAINPPQEDFGAVSWRGFPYNL

SEQ ID NO: 1496 - protein, 347 aa, unidentified
  source 1..347: note = Related to JAGQXH010000872.1; note = Lewinella sp.
MKKDTRERHQHRKMVFCSINSEHTLCRLLHIDQRRLQLLAKQPAYKSFTVPKKDGGQRQIEAPNAELKRVLGRLNRYLQSVYYFEKSSAAFGFIVGVTNDDDRRNVITNARKHLGKPYLLNIDLLDFFHSISRDRVYQIFREKPFNFRRNVPDLLADLTTYQDHLPMGTPTSPVLSNFACRDLDRELLIFSQTHDWTYTRYADDMSFSAAEPILQGQVEALGAIIQQAGFAINPRKTQLFGPEDEKIVTGLLLTDTVTLAPDYLPLLQAEIDQLRNLLLVQNEQGELSTRWVEQFKKQLMGRLNFAGFVLRRNHPDYMALKDAYYAAIHPPQEEFGAISWRGFPYNL

SEQ ID NO: 1497 - protein, 347 aa, unidentified
  source 1..347: note = Related to JADJZS010000008.1; note = Haliscomenobacter sp.
MDKRTVERNLHVKTVFFGVRSIRALCGVLQIDQRRLLLLAKQPPYRSFTIPKKDGGERHIEDPGAELKKVLGKLNRYLQSAYFFERSMAAYGFILGVQNDNDRRNVVTNARKHLKRPYLLNTDLRDFFHTIARDRVYAIFAGPPFHFPKEIPEILADLTTYQGRLPMGAPTSPVLSNFACRNLDLELAAFSENMLWVYTRYADDMSFSSHQPIDADKIQSVRTIIEKEGFAVNERKVKVYGPNDLKIVTGLLVADDVQLAPDYLPNLEAEINRLQEVLVAQNEQGQLFTNWVEQYKKQITGRLNFAGFVMKRSNPEYMRLKDAYYTAIHPPQEEFGAMSWRGFPYNL

SEQ ID NO: 1498 - protein, 346 aa, unidentified
  source 1..346: note = Related to JACSRK010000282.1; note = Saprospiraceae bacterium
MDKKTRERHQHQKMLFCGIGSVRALCGLLQTDQRRLALLAQKPPYKTFSVPKKEGGERLIEAPGEELKRILSRLNGLLQSAYFFEKSSASYGFIVGVLNDDDRRNVLTNARKHAGRKYLLNVDLKDFFHYVSRDMVLKIFTGEPFRFKGELADLLADLTTFQGRLPMGAPTSPVLSNFACHDLDAGLITLSENLLWVYTRYADDMSFSANQPFNAEKIASVGALIHNAGFVVNQQKIKIFGPGDEKIVTGLLVTDTVALAPDFLPRLEADISHLQQIMKAQNEQGQLLTKWVEQFKKQIIGRLNFAGFVLKKSNDAYIRLKDAYYTAINPPEDEFGAVSWRAFPYN

SEQ ID NO: 1499 - protein, 348 aa, unidentified
  source 1..348: note = Related to NC_015510.1; note = Haliscomenobacter hydrossis
MDKQALYQHQQQKTVLCSINSLNELARLLRLDQRKLTLMAERPNYRTFEIPKKDGGMREIETPGDDLKRTLGILNRYLQSVYLFEKSSAAYGFVVGVKNDDDRRNVLSNARKHIGKPYLLNIDLANFFHSITRERVLKVFTEAPFRFKRELPDVLADICTYRGRLPMGAPTSPVLSNLACMDLDRDLSILANSLFWNFTRYADDMSFSSDTPITPENIVSLRKIITDAGFTLNEQKLKLYGPADPKTVTGILLEADDCTLDPSYLDLLDEEIKRLHEVMRAQNELGQLNTRWVEQLKQQIRGRMAFAGFVLKRKNERFVELKNAFHSAINPPTEEFGSISWRGFPYNF

SEQ ID NO: 1500 - protein, 347 aa, unidentified
  source 1..347: note = Related to NZ_JPOS01000080.1; note = Phaeodactylibacter xiamenensis
MDKRTRQRHLQLKTQFCSLRSVTEFSMLVKTEKRKLQLLAAQPAYNTFTVPKKDGGERLIEAPAPALKKAQGSINRFLQSIYYLEKTTAAHGFVVGVRNDDDRRNILTNAKKHLNKTYLLNIDLQDFFHTVTRDEVLDVFMKPPFNFKRQLPDLLADLLTYSGRLPMGAPTSPVLSNFACREMDRRLTAMAEDMLWAYTRYADDMSFSSNRNIDEETVNTVIRIIREEGFVPNKRKIKVYGPKDQKVVTGLLISDKVSLEDNYLAQLETDIRQLGDVLLAQNEQGQLATRWVEQLKQQVRGRLSFAGFVLGRRHERYNQLKDAYYNAVNPPQEEFGAISWRGFPYNF

SEQ ID NO: 1501 - protein, 347 aa, unidentified
  source 1..347: note = Bacteroidetes bacterium; note = Related to JAAAOU010000417.1
MDKRTRQRHLQNKKKFCGLRSVSELCLLLKTDKRKLELLANQPPYKTFTVPKKDGGERLIEAPGGPLKKVQGLLNRYLQSAYFLEKSTAAYGFVVGVRNDEDRRNVLTNAKKHLGKTYLLNIDLQDFFHSVTRDQVLDILLKPPFNFKRRLPDLLADLLTYNGRLPMGAPTSPVLSNFACRELDRRLSAMAEDLLWTYTRYADDMSFSGNRPFDEEKVNSVLRLIREEGFTPNPRKIKRFGPKDEKVVTGLLLTDKVQLEKGYLDQLQQDIQQLADTLRAQNEQGQLATRWVEQFKQQVRGRLSFAGFVLGRRHERYQQLKDAFYTASNPPQEEFGAVSWRGFPYNF

SEQ ID NO: 1502 - protein, 344 aa, unidentified
  source 1..344: note = Related to nan
MKTLSKRRLKQRRDKFLSMRYVDDLAELTSFVRYKLTLIAGVPQYHFFSVPKRNGGLRHIENPARKLKKVQRTLNNFLQAVYFFEKTEAAYGFIIRARDEAPRDIVSNAHQHLNVPWLMNMDLTDFFHYVKREDVFHIFCHVPFNFSEDLAEILTQLTTYKGRLPMGAPTSPVLSNFATIDMDIDLLAFAQARGWTFTRYADDMSFSMDTAPMDSEIEAIRQIAGKHQFLFNETKLKIYGPEDEKLVTGLRLGEEVTLSSAFLQEIREEIDRLQKVVEARAMAGQPPSKWVEKYTQQVQGRMAFAEKVLGEYDPIYVELEKAFNRALNPPDRFSSVNWLDFPYH

SEQ ID NO: 1503 - protein, 324 aa, unidentified
  source 1..324: note = Related to JACETV010000001.1; note = Emticicia sp.
MARLLGIEHRTLDYLAERPQYNEFDVPKKNGGFRHIEDPDNELKNVLRLFNDYLQAVYYFRKSDAAYGFVRVPDNDTAPRNILSNAEKHRNRPWMLNVDFLDFFHQIKQIEIYELFVCPPFNFGEELAVLLSKLTTYKGRLPMGSPTSPVLSNFATLLLDQDLLGFATKKDLVYSRFADDLTFSANSPLSVEHLTGIRQICAFYGLKLNENKINFFLPHQTKIVTGLIVTNRVDIPHTYLEDLRKEIDKLRTVLEINYRTGRQASEWVQRFHQQIEGAIEFIRQIETSKSPDYQQIRQYYAESQQMAENYQPTSWLDFGYHKFI

SEQ ID NO: 1504 - protein, 356 aa, unidentified
  source 1..356: note = Saprospiraceae bacterium; note = Related to JABARE010000025.1
MTLFEQRNNPAMAGKIRTQGNAARFIQLRNCQDLAVSLRIDAYRLQLLVLQPKYNCYSVRKPKGGFRLIEDPQGRLKSVQSRLNDFLQSAYLPLRPECAYGFTRAKSEDDDRTVVGNALQHLGCRYLLNIDLKDFFHQVSDEKIDGVWQSHFRRFDAGLRQLLTGLVCFRQRLPMGAPTSPALSNFASLEMDHHLTEYAHRSCMHYTRYADDLSFSSTEPIGKGEYHDLRNIIGECGFEVNPSKVRWFGDGEAKEITGIELGEECLRLPGNYLGRLAREIERYRAFFELESRYQTGASGKKLKLFEQELRGKLEFARQVLTEDDPVWQKLAESFEQAQFALEDFESVDWLDCPYLY

SEQ ID NO: 1505 - protein, 345 aa, unidentified
  source 1..345: note = Related to JADJYQ010000001.1; note = Saprospiraceae bacterium
MSIKTAIKIRAKRFSKIETLRDLCSLIRKHEQQVVLMAHQPRYHRYEIPKSKGGLRLVEDPEKKLKIVQTFINEHLQAFYSLIRPECVYGFVIKREAGEDRTITGNAMQHLGCNYLLNVDLKDFFHQVSRVRVEEIFKIHFNHFHDELIDILARLTTYHDRLPMGAPSSPVLSNMASIEMDRELIQYSKHTGLVYSRYADDLSFSTLDLMEPEHLDNIKSIISQCGFNVNPQKIKWFGHEDRKEITGILLDGNRLGLPELYLEGLQKELMRYKSYMEVESRYRTGASAKKLKLFESELRGKINFALTVMPEDQGVGKLFDQFEEAKEIMQDFESVSWLDLPYEFF

SEQ ID NO: 1506 - protein, 344 aa, unidentified
  source 1..344: note = Saprospiraceae bacterium; note = Related to JADJXG010000001.1
MANRSTIRSKAKRFEKLRTVFEFAHWLGREEAKLQLLSFKPRYKEYQIPKPGGGWRQIEDPEPKLKSVLQKLNEHLQACYYSVRPASAYGFVISASEDEDRNIVTNAKKHLGCKHLLNIDLKDFFHQIREDKVVAIFSRHFPQFEDALIDLLARLVCYKARLPMGAPTSPVLSNYAAIPLDEQLMAYCSQSGISYTRYADDLSFSSKQAISRIDYEHFLHCVQTCGFEVNPKKIRWAKENNPKEITGLFLKMGEVCLEENYLRQLETEIGRYITYYEVEARYRTGASMKKLKLFEQELRGKLSFAQLVEPDNERIDYLRDQMDQAKEALEDFESVHWLDLPYGF

SEQ ID NO: 1507 - protein, 345 aa, unidentified
  source 1..345: note = Related to JADJKX010000012.1; note = Saprospiraceae bacterium
MAASSTVKLRARKFSQLRSVFDLAHVLKVPQHNLVLMGSKPRYRVYEIPKPKGGMRLVEDPEKSLKKIQSHLNDFLQAAYYLIRPDCAYGFTIACPGDQLRNIKTNAERHLNCKYLLNIDLKDFFHQVKDIHLINLFNRHYPEFDSELVSCLSNLFSYHGRLPMGAPTSPVLSNYAMLELDHGLQNYCKSGGIVYSRYADDLSFSSTNQIQDFDFVSIDAMIKDYGFEPNPKKIKWYEPKDKKEITGLVLGDDGVELQDGYLQHLYQEIQRYKIYLEVESRYRTGASLKKLKLFEQELRGKIQFATMILPENEELLNWMQMVEDAMSVLENFESVDWLELPYSIY

SEQ ID NO: 1508 - protein, 333 aa, unidentified
  source 1..333: note = Related to JADJZM010000017.1; note = Bacteroidetes bacterium
MKCRTTDDLAQACQTDANQLVLFGLKPRYKEYYIPKNKGEMRLIEDPSKELKKIQTHLNKLLQAWYYTQRSDASHGFGIATSKDEQARGIKTNASVHLQCNYLLNIDLLDFFHQIEFPRLQKTFETYLPKQKADIRNLLLQVCCYKNRLPMGAPTSPVLSNIACLDLDGSLQQLCKHANLNFTRYADDLSFSSLLPIEKEVQDMIKDAIMHEGFSINYNKVNYFSIEDEKLVTGLVLHPDGVRLPKEYVPLLLKEIERLKIINDVEYRYQTGMSRKKLNLLEQEIQGKIRFVSDVLGSHAIETLSIEKAYLNAIQAPEDFESLSWLELPYEFL

SEQ ID NO: 1509 - protein, 341 aa, unidentified
  source 1..341: note = Saprospiraceae bacterium; note = Related to JAGOCA010000053.1
MATGIPIIRKRQRAVLNVKSMSDLSKLLQCQEHVMAAHALTPEYDTYFIPKKNGKRLIEDPNPVLKEMQGILNDHLQAVYFYIRPAGVFGFCISSTTGEEKNIVSNAKKHIGNDYMINIDLKDFFHQIKTNRVAQIINDVFLHSETEVKEMMTALMVYKGRLPMGAPTSPILSNFALQNLDHEITNICQSFGVTFTRYADDLTFSSMEYMNDTFEAMIKDAIVYEGFEINPEKVKHYLPSSIKIVTGIVVGREDLRLPELFLDQLQKEVIIYGNVVLAEHRYQTGMSQKKLDQFRQEISGKINFAAMVDSENPKLLKITDTFNANDEIENLSFDWLDIPYA

SEQ ID NO: 1510 - protein, 344 aa, unidentified
  source 1..344: note = Saprospiraceae bacterium; note = Related to JADJXD010000001.1
MATNPRIIKKRKDAIDRVRTTADICKILGENELRLQLMANSPRYKVYTIRKKNGNLRLIEDPEIQLKEVLRTINDHLQAVYYYQRPDCVHGFCISSTHDPDRNVVSNAQAHMMSATMLNIDLKDFFHQISVSQVKGIIKRQFHRWDNYLAAMIASLCTYKKRLPMGSPTSPILSNFAMLELDHELMQLSRVFEVTYTRYADDLTFSSGSDLPTDFVKMVRDALQHHGFTVNENKVKYYQASDIKIVTGIIVNPTGLSLPDDYMTQLRTEIDLYRNSRLVDAMYQTGMSERKMTLFEQEIIGKLNFGYMVMPDDPELNELNQLFEVEIDVESMTQSWLDIPYNMM

SEQ ID NO: 1511 - protein, 345 aa, unidentified
  source 1..345: note = Related to JAIBAX010000022.1; note = Chitinophagales bacterium
MMSSLKIKQQVQSLLRSKSVDDLAKVLKFTAENITLLSISKKYEVYKIPKKDGSFRMIEDPYAPLKALQKRLNEVLQCYYATIRPSPVYGFCISTSPDKPLNIKTNAQRHVGNPWMINIDLKDFFHHISEKRVQNIFSTNFKHWDKNLVKTMAAIATYKHRLPMGAPTSPVLSNLACINLDHELQNFTKNSGITFTRFADDFTFSAHHELNKNDIDIIFSALHHYGFLENQKKVVIYPPDDIKIVTGLVVGNDDVSLPKDYIPQLLIEIDRLKNILSVEKRYQTGMSNKKLQLFKQEIEGKINFATTILGNQHVDIQHIEQAYIDATAPEDDYLSMNWLEMPYSL

SEQ ID NO: 1512 - protein, 341 aa, unidentified
  source 1..341: note = Related to nan
MKRKKLNTIYKKITSIRFIEQLGFLTGISPHIMVLQSVLPKYDMFYVRKRTGGKRLIENPNPILKNIQRKLNKYLQVVYYIHCPQPSHGFVINVKRGKKKGIISNAKVHIGNDYMLNIDLKDFFYYIKYNTVYKIFNSDLFNFNTYLVKILADLCCKDERLPMGAPTSPVLANLACIDMDLKLESICNSFAIKYTRYADDMTFSGLNPIPDHLIKKIYSIIDEYGFVVNEKKVKLRGINDQKKVTGIIVGDGLSLAEFFFEETLIEISKLKTLMELNYRYRGNKDKLVNKHKQKIDGYINYATQIYGKDNEKVQQLIDELDKAMSIEDFIEPMSWDDFPYV

SEQ ID NO: 1513 - protein, 311 aa, unidentified
  source 1..311: note = Bacteroidetes bacterium; note = Related to CP058707.1
MKSNPLYTDYRIKKNSGGFREIEDPCPVXKKIQRGLNGYSQLEYSSCRPQASHGFCVALPKEEIPRGIKSNALCHLGNPYMVNFDFKDFFHQIRSEQIHKILKEQFPEQHSDLRTTLXIRLTTRNDRLPMGAPTSPVLSNFACIHLDEELDSICRASSITYTRFADDLTXSSKKVIESVELKMIRDCINNHGFQINEQKYKYSGPGNEKIVTGIVLENDRLGLPKTFLSQLRNEIERYNHVLMVESRYKTGMSHKKLKLFEQELQGKLSFATEILFPDDPVLLELIREFEHLLNSPEDFELTNWLDIPYNF

SEQ ID NO: 1514 - protein, 343 aa, unidentified
  source 1..343: note = Bacteroidetes bacterium; note = Related to JAEUUL010000001.1
MKNSGITYQSNLFHALQRTADLEKLLHTDIPGLIQLFREKPYQSFYIPKKNGGRRLIENPKPVLKEMLKRLNLLLQCSYLQFRPKCVYGFTIRKGSEKSRNIISNARRHVRKKFLLNIDLKEFFHSVKENRVRQIFESKLGKKDPLLVLLLSKLVTLNGRLPMGSPTSPVISNLALLDTDWELEALCSNLQLEYTRFADDLSFSSNQRITTKDIQLLKQVIRYHGFEINREKVKLYGPEDTKWVTGLIVEETVKLPPDYLLLLEKEIFRFKEFTLLHHKYKSGADEDKIKLIQSEIRGKWNFANMVIPGDEKLMELQLQMEYAFNPVEEYESTNWLDMPYTFF

SEQ ID NO: 1515 - protein, 336 aa, unidentified
  source 1..336: note = Related to JACJYP010000014.1; note = Lewinellaceae bacterium
MYTFSEQKSELNTTQVTALGKRFENLRSVAELAGLLGTTEPLLSRQMARPVYYTFYIPKPGGQKRLIQHPAPALKIVQQSLNRYLQAMYYGVKPDCAYGFILSPSDELRPRNIYSNALAHLKGEWFLLFDLKDFFHTVTLTHLRDLFRNVLFFPPELCNALCQLCAYQGRLPMGAPTSPVLSNLCCLFFDYQLERLAAGAQAVYTRYADDLTFSFRSEPPSGFADEVRMVVLRHGFAVNESKVRLQSRPEQPEITGLVLGKNALPVPGKNWLKSLKQEIKIYTWLMSEAVRERGLFHAWVFDRFRRSVQGQIEFLGFILGKDHREYRKLAGKVRWG

SEQ ID NO: 1516 - protein, 334 aa, unidentified
  source 1..334: note = Saprospiraceae bacterium; note = Related to JADLDL010000205.1
MYTFSEQKSALHTTQLATLGQRFEALNDVQGLAKLLSVSEAVIAKHVDKPVYHSFHIPKPGGRKRLIQHPTAALKAIQQVLNHYLHAVYFGVKPDSAYGFILSPVDELRPRNIYSNALAHSKGEWFLSFDLQDFFHTVTLTQLRDLFRRVFFFPPELTAALTGLCTYQGRLPMGAPSSPVLSNLCCLFFDFQLEQLAASAKAVYTRYADDLTFSCRQAPPPEFGDQVRQVVLRHGFVVNESKVRLQTRLEQPEITGLVLGKKVLPVPGKAWLKRLKQEIKMYRWLMSEAVRERGLFHAWVFDRFRQSVAGQVEFVGFILGKDHGEYRKLAGMVR

SEQ ID NO: 1517 - protein, 336 aa, unidentified
  source 1..336: note = Haliscomenobacteraceae bacterium CHB4; note = Related to QWGW01000034.1
MYAYLPPKSDLTTLQLKALAQRFEALTDVPGLAKLLGITENSLTKAAAKQDYLSFYVPKPGGEKRLIQHPASALKMLQQTLNGYLQAVYHGIRPDCAYGFILSPADELQPRNIYFNAMRHIKNEWFLLVDLKDFFHTVTKTHLKNLFRHLFFFPPDLTSVLTDLCSCQGRLPMGAPTSPVLSNFACLGMDHQMEKLAETHRAVYTRYADDLTFSFSTPPPADFLESVRAIVLFHGFVVNDKKVRLQSRLEQPEITGLVIGKGSKPVPGKEWLKHLRQEIKIYRWLMSEAVRERGLFHAFVFDRFKKSVLGQVEFVGFVLGKGHKEYRKLAGKVRWG

SEQ ID NO: 1518 - protein, 336 aa, unidentified
  source 1..336: note = Related to JAGNMJ010000669.1; note = Saprospiraceae bacterium
MYYFQQFKSELSTAQLRTLSSRFEALESVKDLSVLLKKETPALMKMAESPSYQEFYIPKPGGEKRFIQHPAPTLKAVQQELNRYLQAVYYGIRPPCVHGFVVSPGDESQPRNIYTNALAHTRGHWFLNIDLKDFFHTVTAQHVFDLWRHIFWFPEHLSTLLACLCCYGGRLPMGAPTSPVLSNLVFYELDGQLLQLARSSDAIYTRYADDLTFSFPRPPADDFTDRVRHLLLTHGFTVNEKKVRLQGRLEQPEITGLVVGHGAKPVLSKSYLKTLKKEVVIYRWLISEAVQKRGFFQQWLFDQFRKSITGQIEFAGFVLGKGDRVYQRLAGKMRWG

SEQ ID NO: 1519 - protein, 333 aa, unidentified
  source 1..333: note = Related to SCUG01000636.1; note = Saprospiraceae bacterium
MYDIAPPSLELTLAQMDAKAARFLAIKHPGELAGLLKADAALLAKFAAKPHYAVFSIPKPGGAKRIIHNPHPDLKTIQQSLNLYLQCAYCQLMPPCAFGFIPRPTDEPRPRNIYTNALVHFGSQWVLNLDLKDYFHTVTSRHLTWVFRELFGFPEALANQLIALASYRGVLPMGAPTSPVLSNLAALPLDQELQPFANLLDAAYTRFVDDLTFSFDTQPTPEVIAAIRQKVEKHHFILNETKIRLTAKKDNPEVTGLILKSPHPDVSGSFLKKLKKDIRLYRRLTTPGMMQRGIFHASVLDKLRRSIAGQVQFVKFIRGRVEKGLKRWEKVVG

SEQ ID NO: 1520 - protein, 333 aa, unidentified
  source 1..333: note = Related to JACJYR010000001.1; note = Lewinellaceae bacterium
MYTIYPPSLDLTLAQSDAKAARFLAIKHPGELASLLKADAAKLAKFVAKPYYQVFSIPKPGGARRIIHNPHSDLKTIQQTLNMYLQCAYYQLKPPCAYGFIPRPTDEPKPRNIFTNAMTHLGSEWVLNLDLKDYFHTVTSRHLTWVFRELFGFPEALANQLLALVSYRGVLPMGAPTSPVLSNLAALPLDADLQSFANLLDALYTRFVDDMTFSLEQQPTPEVIAALRQTVEKHQFTLNETKIRLTAKKDHPEVTGLLLKEPHPDVSEHFLKRLKKDIRLYQKLTERSMMERGIFHANVLDKLRRSIAGQVQFVKFIRGRVERELKVWEWAPG

SEQ ID NO: 1521 - protein, 332 aa, unidentified
  source 1..332: note = Related to JABWBR010000013.1; note = Saprospiraceae bacterium
MYGVIPQALELTLAQLDIKANKFRALRHPGDLAGLLKADAAQLAKFAAKPHYQVFHIPKPGGDRRTIHNPQAELKTIQQNLNVFLQAAYYGIKPPCAYGFIPRPTDEPRPRNIYTNALVHEGSEWVLNLDMKDYFHTVTSRHLNWIFKELFELPEALSLHLIGLCTYKGVLPMGAPTSPVLSNLAALPLDAELQGIAAQYNALYTRYVDDLTFSFDAEPDILFTGVVREAVERHGFMLNESKIKLTRKRDHPEITGLILKPPKPDVSKTFLKHLKKDIKLYRELISADMMHRGIFHASVLEKLKKSIDGQLQFLAFIRGKQDKAYLRWAALA

SEQ ID NO: 1522 - protein, 342 aa, unidentified
  source 1..342: note = Related to JAHBTU010000001.1; note = Saprospiraceae bacterium
MQYFRQSFKKLTSQQVLAKGQLLVKARTVKAIAALTMTEETWMREQAVNPQYYAFQAPKANGTFRLIENPHPKLKEFQRALADMLQGVYYGIRPRASYAFVPSTADETSPCNIYTNALRHCKSKWILQLDLKDFFHSISAHRIKELFMRIPFEYPEDTAQVVARLVTSKNRLPMGAPTSPVLSNLICFELDHLLDKLSRDHGWTYTRYADDMTFSGAKRFSNESVEIIRQQIEGNDFVLNYEKTQQHRIEDEPEVCGLALKEDGKPDLSNMFVKDLKADIKTYKQLTSDKMIAQEIFSAEALNRFRQHIEGELAFVRFIKGPNNGLYLKLRFMLADGMLGVE

SEQ ID NO: 1523 - protein, 342 aa, unidentified
  source 1..342: note = Saprospirales bacterium; note = Related to JADJYG010000004.1
MQYFRQPFKQLTAQQVLTKGQFLLKAQTVKAIGSLLLCEEAWMREQAANPQYYAFQAPKANGAFRLIENPHPKLKDCQRLLADLLQGVYYGIKPRASYAFIPSTADETSPSNIYTNALRHCQSKWVLQLDLKDFFHSISAQRIKEMFLAIPFNYPEDTALVMARLVTSKNRLPMGAPSSPVLSNLVCIDMDHQLDKLARDQGWTYTRYADDITFSGERRFTNETVELIRQQIEGNDFVLNYEKTALNRTEDEPEICGLAVKPGGKPDLSERFVKDLKTDIKIYKVLTSDKMIAQEVFSAEAINRFRQHIEGELSFVRFIKGPHHGLYLKLRFMLADGMMGVE

SEQ ID NO: 1524 - protein, 342 aa, unidentified
  source 1..342: note = Related to JACJYO010000002.1; note = Lewinellaceae bacterium
MLYFRQPSKKLTTQELLTKGQFLLKARTLKAIGALLMCDDSWIREQAASPQYYSFQAPKSSGAFRLIENPHPKLKECQRLLADLLQGVYYGIRPRSAYAFVPTTADESSPCNIYTNALRHCRSKWVLQLDLKDFFHSISAHRIKTMFCALPFNYPEDIAQVLAKLLTSKNRLPIGAPTSPVVSNLVCIELDHQLDKLARDYGWTYTRYADDITFSGEKRFKNETVEHVRQHIESNGFVLNFEKTAISRTQDEPEICGLAIRPEGKPDLSSRFIKDLKMDIRIYKTLSSDKMIAQDLFPAEAINRFRQHIEGELSFVRFIKGPNHGLYLKLRYMLADGLPSAE

SEQ ID NO: 1525 - protein, 345 aa, unidentified
  source 1..345: note = Bacteroidetes bacterium; note = Related to RFHL01000354.1
MSTPEYHQLTPATVKLSTHQVAARARTFLSQPHLGQMAHLLGLDKNQLVLLSKSPRYDCFFIPKPKGGKRLIEAPREPLKGTQQRLAKWLQCVYFVHRSEAAFGFMMVPVDDEDPRHIYTHAQRHREATWLLNIDLKDFFHQIPADRVLRLFQQAPFGLTPKAAACLTGLCTFQGRLPMGAPSSPVLSNFACRDLDAELEALARREGWVYTRYADDLTFSGPKPFTQAHWESISGLIGAAGFKMNTKKMRLRHRKDKPEVTGLILKKNPDVSPDFLAGIEADLLVLEALVSERMLLRDIFSRQPVKRLRRSIQGQINFLKAIRGKDHKSCRKLQNRLDQSVIKLK

SEQ ID NO: 1526 - protein, 340 aa, unidentified
  source 1..340: note = Lewinellaceae bacterium; note = Related to JACJYN010000022.1
MYLKISTQTGDKPSAYELQEKGRQFIAADTFPALAELLNIKEETLRAKMYNRKYTQFFVPKPNGEKRLIENPEDWLKSLQGQLNKHFQAAYYMVRPPCAYGALLAVADEVKPRNIYTNALRHIGQKWLLNVDIRRFFPSISYEKVYMTLRRPPFSFNPNAAKCLSMLTTFEQRLPTGAPTSPILSNIICLPLDSMLLQLSKKHGWAYTRFIDDLSFSGENKFKKKHLRAIQGILLSQGFLINEKKLKINRVRDKPEVTGLILKKKKPDISPSFLKRLKKYIHLYHIMTEQDMLNRQLFPAELIQRYRNFINGQLAFIKFIRGEGDKDYLRLFKRFQPRGY

SEQ ID NO: 1527 - protein, 344 aa, unidentified
  source 1..344: note = Bacteroidales bacterium; note = Related to JADHTI010000120.1
MKRGKTRGYQKNAANFLGIRTHMELANLLGISLSQLEVLINKPTYKEYTIRKKRHGVRIIYDPSPMLKAVLKQLSFFLNAVYSTLQNDCVYGFIPHLDKTGPQKNIRENAIKHVGKNHLFSLDLKDFFHSISTKRVFQIFQEEPFNFYKSIAVPLALLTTYRKSLPMGANTSPILSNFACLELDAELSRLASRSDLEYTRYADDLTFSSDLPFTDQLKSDIREIIQKHGFQINEKKVRERSKNRRQVVTGIKVNTKPNLDRKYIRNLRALLFDWRINGIYKAVIHHYNLDGIPTFQQITHFLSSTRGRISFVGFVRGKEDPIYQKLQVEFERLTTFHGHKELSG

SEQ ID NO: 1528 - protein, 362 aa, unidentified
  source 1..362: note = Related to JAJTDX010000011.1; note = Cryomorphaceae bacterium
MKDIQQTAIEFNSEISNGAFETTLVNKKQFTRTQKKALELLRIESDQDLILFSGVSANALLRNINAPVYSEKNIRKKNGGFRSLDIPEKSLKLLQEKLNDHLQSVYTYLRPQTTHGFVRYPNRKSCNILKNASVHTSKNYVLNMDLKDFFHSVNALRVKHVFQNSPFKFNEHLSNCLALLTTYKGRLPQGAPSSPVLSNFAALSLDYKICKLCKTYAIDYSRYADDLTFSSQSFMPEAFKNELNNLIEKEGFHVNADKTRLRSKNRKQLVTGVVVNHKANVDRTYVRKLRAMIFDSEINGLPSAAAKHLNLTTKPTTDHISFFVRRLNGMLAFMSQIRGKDDALTLKMKNRFLNVLSIPLNQ

SEQ ID NO: 1529 - protein, 371 aa, unidentified
  source 1..371: note = Chitinophagaceae bacterium; note = Related to DPFD01000024.1
MRSPAELLAFAKSNKKIIFRYLYGNSDRCPAVLKQLRKHELSALLFLTIESPAELCRFLHTPFFQLENIINHPSYERYTIRKKKGGHRQILEPEEQLKHIQKCLNYSLQAYYLCVKPNQVHGFVVNPHYLGTQCNIVENAKAHTGKKQVLNIDLKDFFPTITAKQVKHVFTSSFFNFSEELANAFTXLLTTYEGNLPIGAPTSPVISNFVCYKLDSDLIHYCKINHLTYTRYADDLTFSSDSDITLYKTLEIVNLIKKNHFEINEKKLRKQSCNRRQSVTGLTVNEMVNVDRRLLKKIRAMLHDLTRSGMLAAAQRHFKMAWESEAQLKMMFMYRLRGYINFVGQVRGKSDALFLRLKASYENVVRTTDLV

SEQ ID NO: 1530 - protein, 378 aa, unidentified
  source 1..378: note = Related to JMTN01000017.1; note = Pedobacter glucosidilyticus
MITIEEILTLSKTNKSELQKYFSGGSYHLDKSMESFQKHELNALYFLSIEEPKELTRFFKTSFFQLEEILNNPLYKNYTIKKKRGGARQICEPEKHLKSIQKRLNYFLQAYYLWIKPNEVHGFVVNPHYLGIHCNIVENAKVHVNKKDVLNIDLKDFFPSISAQQVKNIFSSNYFNFNEQISTALTLLTTYEGKLPIGAPTSPVISNFICHQLDNDLITFCKQNNLTFTRYADDLTFSSDNTISDDNTLNIFDLIKKNQFEINEKKVRLKRSHRKQTVTGLTVNSKVNVDRKLLKKIRAMLHDLVKNGIETSVKKHFNIGNIEQRHKVIFINRLKGYINFVGQVRGKNDSLYLKQKSTFNNILISSKGKSLEIDMKQA

SEQ ID NO: 1531 - protein, 434 aa, Flavobacterium sp.
  source 1..434: note = Related to VFPJ01000001.1; note = Flavobacterium branchiophilum
MSNIYNIAVVFLQPKSSCKQENIAIYCDAHCVPLLINSKKTKDNLQRLFLNKNRMTVPEIQQLVQRHKKEFKKYFSDDFYLTNLALQDFKKHELNALCLLSIEEPFELAKFLTTPIYHLEELLNNPPYKHFTIQKKRGGTRQIFAPENSLKGIQKRLNYFLQAYYLWLKPHHVHGFVINPHYLGTSCNIVENAKVHVSKNFVLNIDLKDFFHSITANQVKDIFSSHFFNFSEPIAIALTLLTTYKGKLPIGAPTSPVLSNFICHELDDDLLRFSAENDLTFTRYADDLTFSSNFKISHDITLDIINLIKKNFFEINSKKIHLKTQNRKQIVTGLTVNQKVNVDKKLLKKIRAMLHDVSINGIEKAAQRHFKLNKIDKRYSSQFMNRLEGYINFVGQVRGKGDTLVLKFKEEFKLIFEIEIHKESNKKLDENNIK

SEQ ID NO: 1532 - protein, 376 aa, unidentified
  source 1..376: note = Related to JAFDYI010000013.1; note = Bacteroidetes bacterium
MPTIEEIVTFSKAHKSNIQKYFNGGHPYSTLPKLVQKIKKHERNALFLLSTETPTELCTFLKTPFFQLEEIINNPIYKQYEIKKKRGGNRQIYSPEKKLKAIQRRLNYFLQAYYLWIRPNEVFGFVVNPHYQGTFCNIVENAKPHTGKKHILNMDLKDFFPSISASRIKSVFASSYFNFSEQIATALALLTTYEGKLPIGAPTSPVISNFVCFQLDADLKNFCETTGLQFTRYADDLTFSSNLLISNETVLDIINLIKKNGFEINEKKLRLKSSNRKQTVTGLTVNERVNIDRKLLKKVRAMLHDLTTNGIDVAAKRHFNWSGETDAKQRSKFIHRLEGYIHFVGQVRGKNDAVYTKLKQPLDKFSATQQRAEQMW

SEQ ID NO: 1533 - protein, 372 aa, unidentified
  source 1..372: note = Related to JADLGP010000058.1; note = Chitinophagaceae bacterium
MPIVKEILTFSKDHKSKIQKYFNGGYLYSKTPKLLQEKKKHELNALFLHTIETPAELCKFLNTSFFELEELINNPVYKNYTIRKKKGGERQIYSPEKKLKAIQRRLNYFLQAYYLCIKPNEVFGFVVNPHYLGNYCNIAENAKPHTGKKHLLNIDLKDFFPSISASRIKSVFTSSYFNFSEQIATALTLLTTYEGKLPIGTPTSPVISNFVCFQLDADLKNFCKTNGLQFTRYADDLTFSSDTLISIDIVLDIINLIKKNSFEINEKKLRLKSSNRKQTVTGLTVNEKVNVDRKLLKKIRAMLHDLTTNGIDIATKRHFNLNGEIDTKHRGKFINRLEGYINFVGQVRGKNDTVYIKLKQPFDKVFSNTATC

SEQ ID NO: 1534 - protein, 366 aa, unidentified
  source 1..366: note = Bacteroidales bacterium; note = Related to JAGOLH010000034.1
MTNTSTIIEFARRNKGVLQNHLADGSLRLPVALEILEKHQLNALYLLSIETPIDLCSFFKSGLLQLESIINNPQYTHYTIKKKRGGNRHIYAPNKKLKAIQKRLNYFLQAYYLMIKPEEVHGFVVNPHYLGSHCNIVENAKAHTGKKHLLNIDLKDFFPRITAKQVLDLFSSPVFGYSDQVATAITLLCTYEGRLPAGAPSSPVISNFICLNLDADLKAFCATHNLEYTRYADDLTFSSNAAIETNTLLDIISLIQKNNFEINSNKLRIRPANRRQIVTGLTVNEKVNVNRKMLKKIRAMLHDLSTNGVETATRKHFKISGKAKPFQEGKFLQRLEGYINFIGQVRGKTDALYIGYKEQFEQAFEN

SEQ ID NO: 1535 - protein, 356 aa, unidentified
  source 1..356: note = Bacteroidales bacterium; note = Related to JAGNBV010000013.1
MIQKYHFEGLYLNNIVLQQFTRHELNALFILTVKKPLELVKIFNVSFCMLEEQINHPAYRYFTLPKKNGGSRDIYAPSVKLKSIQQCLNYYFQAYYLFIKPEEVHGFVINPHYLGKRCNIAENAKAHVKKKYVLNIDLQDFFPNIKAKRVKETFLSPVFNFNEQIATALTLLTTYKGLLPAGAPTSPVISNFICLKLDKELKYFSELNDLTYTRYADDLTFSSNHEIPGDMILDIICIIHRNDFRINEKKLRLKPSNRKQTVTGITVNQKVNVDRKLLKKTRAMIHDLGTHGLYAATSRHFKVAEDKNSSLNAKFIRRLQGYINFIGQVRGRDDAVYLKLKTTYLSLFSFQTEDFC

SEQ ID NO: 1536 - protein, 371 aa, unidentified
  source 1..371: note = Bacteroidetes bacterium; note = Related to JACPOC010000038.1
MNSQEEILSILIPAKDKIWNSFYGIPIRKKSKQLEQLKKHELNALLLLTINKPSRLAQFLSTPFFELEGIINNPNYRHYTIPKKKGGMREIYAPANSLKKIQRRLNYFLQAYYLCIKPKEVHGFVVNPAYLGKKCNIVANARLHIGKSHVLNIDVKDFFPSISAKQVKGIFSSHLFNFNDQISNALTLLTTFEGRLPAGAPTSPVISNFVCTKLDSDLIEFCSLNSLSYSRYADDLTFSSNNVIDNDIILDLINIINANNFKINDKKLRLKASNRKQTVTGLTVNEKVNVDRKLLKKIRAMLHDLTTNGIDKAAKHHFNINKDIDEKLRGKFIYRLEGYINFVGQVRGKKDLLYVGLKSKFDNEFKVIPLS

SEQ ID NO: 1537 - protein, 368 aa, unidentified
  source 1..368: note = Bacteroidetes bacterium; note = Related to JADKCP010000006.1
MNSPEELIYLARNKKWLVWKDNFLELAGKDLALHKFKKYELVALRLLSIETASNLVKLASVSLDTLQNNLNHPEYKHYQTKKKKGGSRLINAPTGELKKIQKRLNNYLQAYYLCLKPKEVHGFVLLAPLIQQRSNIVANAEVHVGKKFVLNLDLKDFFPSITAKRVKAFFMSPLFNYNEQIANALTLLCTFQGKLPIGAPTSPVISNFICLKLDADLQNFCAANELNYSRYADDLSFSSNSSISNDTILDLINLITKNDFTVNYKKLRLKSSNKRQTVTGITVNEKVNVNRVLLKKIRAMLHDLTSNGLEVATHKHFKFNGFVDQKYKERFLFRLKGYINFIGQVRGKEDFIFLKFRNELKMILIEIT

SEQ ID NO: 1538 - protein, 386 aa, unidentified
  source 1..386: note = Related to JAFDYB010000054.1; note = Bacteroidetes bacterium
MKNLPDISIALKNVRENFNSYFNWNSLPQNKSEKYKLHEINALILLSIKIPTHLCLALSNSISGIEVLINNPVYTELKVKKKSGEFRQIYAPNYELKRVQKRLNYFLQGYYLCIKPNEVNGFVINPFPFDAKCNIAENAKYHVNKKHVLNIDIKNFFPSISAYRVKKIFTSELFNFNEQVATALTLLCTYKGVLPIGAPTSPVISNFICFQLDRDLKNFCNEKNISYSRYADDLTFSSNEKITDEIISEITLLINKYGFELNKNKFRLRLSNRKQVVTGLVVNEKVNIDRKLLKKIRAMLHDMSRNGIEVAAKRHFKSENPPIKTNSLTNKNTAIFESEQSDNEINIAFACRFKKIVIGYINFVGQIRGTDDRLYNSFKAAYKNSW

SEQ ID NO: 1539 - protein, 392 aa, unidentified
  source 1..392: note = Related to JAIBCH010000012.1; note = Saprospiraceae bacterium
MMTVEEILKLSKTSKSKLQKYFSGGSYHLGKSMENFKKHELNALYFLSIDKPAELTRFLKTSFFQLEEILNNPTYKNYTIKKKRGGTRQIFAPEKHLKSIQKRLNYFLQAYYLWIKPNEVHGFVVNPHYLGTHCNIVENAKVHVNKKFVLNIDLKDFFPSISARQVKEIFSSTCFNFNEQISTALALLTTYEGKLPIGAPSSPVISNFVCLELDLALKEFCQKINSEYFYNDNNKLLHKKKQFVFFETYDIAYSRYADDITFSSNIPISTEMLSNIISIIHQYGFELNEKKLRFKLSNRKQTVTGLTVNEKVNIDRKLLKKIRAMLHDLTTNGIEQSVQRHFKVTNIEQRHKATFINRLEGYINFVGQVRGKSDSLYVKQKTAFDNVFEQRK

SEQ ID NO: 1540 - protein, 333 aa, unidentified
  source 1..333: note = Bacteroidetes bacterium; note = Related to JADJOU010000017.1
MKHEKIINFVESNLEIIRSNINSREIIFGILQGPQHKFQRNAAVFLSITHAYDLCNFLQLSYSVLQNQINNPVYKQFEIKKKSGGMRSIEEPNDILKGIQKRLNYYLQAYYLWIKPAEVHGFIIRPQQYEHRYNIVENARAHIGKKHVLNLDIKDFFSSISVAQIFELFQSDYFRFNENMCVALTLLVTHQKHLPTGAPTSPVLSNFICLGLDRDLREFAEANQLTYTRYADDLTFSSDVHIPEDVVLDVMNILKKHAFDINPKKIRMSSSFRKQVVTGITVNDKVNVDRKLLKKVRAMLHDFAENGLKEATSKHFKISVDEDSIYCRVLSID

SEQ ID NO: 1541 - protein, 362 aa, unidentified
  source 1..362: note = Related to REAG01000285.1; note = Cytophagales bacterium
MLTPFRFASLVFKIRYAPPNFVKKMIRIVNKRYHFLKIKNASDLSKLLFVSFENLQIEINQPTYKTFEISKKSGGKRIIHQPLDNTLRIQNELLSIFQNYYTKIKPNHVHGFVSYSKKDGKKSNILENAKPHVGKKHLLNIDLKNFFPSITAKKVKQLFESDFFKFNTNIATSLALLTTFEGKLTIGSPTSPVISNFICYPMDIILAEFCKKNNLTFTRYADDLSFSSYDYIKNDTLLDIINIITENGFDVNYKKLRFANSNAKQTVTGITVNQKPNVDRTFLKKIRAILYDINQNGLEMAAFKHYSISKKGENTLSFLNVLEGYILFVRQIRGVNDTYYQCFNNKLKEIRLKNLEIENKKI

SEQ ID NO: 1542 - protein, 364 aa, unidentified
  source 1..364: note = Related to JADKDL010000038.1; note = Bacteroidales bacterium
MNNIKNKAKQWRNKYVSTETKRFTFNKNERKRYTFNALHLLSLENETQLCRMLDISLDTLSEVINNPVYQTFEIPKKKGGKRTIDAPEDILKDIQRKLNYFLNAYYLMINPEVVFGFVIQPHELGKICAIAENAKPHVGKRQVLNIDIKDFFPSIKTTHVKALFQSELFQFDEHLASLLALLTTYKGTLPIGAPTSPAVANFICYQLDKELQEFCKENDLSFSRYADDLTFSSDTKFHSDTILDIVSMINKRGFSINEKKFRIQSANKKQTVTGLVVNAKVNVDRKFIRKLRAIMHDIRLNGVKIAAQHHFNLKQEPDEKLLAYFIHRLEGLINFVGQVRGNHDKIYTRFKYEFDEIFTTSLNV

SEQ ID NO: 1543 - protein, 368 aa, unidentified
  source 1..368: note = Related to JADKCJ010000003.1; note = Bacteroidetes bacterium
MNNRKEMARRWRKKYVSADTNRFKFNKKARQKHTFNALHLLSLENENQLCRMLDIQLGSLSNVINNPIYQSFEIPKKKGGKRNIDAPDDELKNIQQKLNFFLNAYYLMIKPNAVFGFVIRPSEYGKICAIAQNAKQHVGKYQVLNVDIKDFFPSINAAQVRALFQSEIFQYDEHLATLLALLTTYKGKLPIGAPSSPAISNFICQQLDDELQLLCNAKEIAYTRYADDLTFSSSVKIDTDFILDIVSIINKHHFRINEKKFRIQSENRKQTVTGLVVNQKVNIDRKYIRNLRAILHDIRLNGVEEAAKNHFKLKQRPNDTTINYFINRLGGLINFVGQVRGNQDFIYYRFKGTFDELFASRLKQPKYF

SEQ ID NO: 1544 - protein, 352 aa, unidentified
  source 1..352: note = Related to JADLAH010000132.1; note = Chitinophagales bacterium
ADTGRFFFRRDAPQRYPFNGLHLLSVEHESQFCKMLDVTLKAMSALIHHPAYTTFEISKKKGGKRTIEAPDEDLKEVQRRLNYYLNAYYLMIKPASVFGFVIQPKENGRYCAIAENARPHVGKKQVLNIDIKDFFPAIKAGRVKALFTSEIFGYNEHLATLLALLVTHKGALPVGAPTSPAIANFICYPLDMELMQFCSDHGLTYTRYADDLTFSAEETIDTDDILDIVSIINSHHFAINEKKFRIRSAHQQQMVTGVVVNRKVNIDRRLIRRVRAILHDIQQNGLIAATMRHFRIDEMPDDAAISYFSRRTVGLVNFIGQVKGPKDPVYLRYKRILDDLFPSSVSSPKTYF

SEQ ID NO: 1545 - protein, 359 aa, Flavobacterium sp.
  source 1..359: note = Related to NZ_CP089095.1
MTLINKIHTRLAEYNSYYYGPFEAIEFRFEQTFFVSKLLSLIEISDLCLLLKTRLFDIEHVINQPQYETFQIPKKRGGSRLIQTPESQLMFIQSRLNFYLQNYYHLIRPECVHGFVINPNKNEKKCNIVENAKIHVQQKYVLNLDLKDFFPSIQAYRVKELFLSDYFRYTEHIATALTLLVTYDGKLPIGAPTSPVISNFICLELDEALSVYCKKNEIRYSRYADDLTFSSNHFISKTIITDLEYIINSFQFKLNPKKTRIKTKNRKQTVTGLVVNEKVNVDRKIIKMVRAMLHDTLQNGISKAAKKHFKSINEIRNTSEAYFLNRLEGYINFIAQVRGNDDSIVIKFRYYYKMIFQLA

SEQ ID NO: 1546 - protein, 359 aa, unidentified
  source 1..359: note = Related to AAXX01000006.1; note = Flavobacteria bacterium BAL38
MILINKIHARLEEYNSYYYGPFEAIDFRFDQTFFVSKLLSVVKIADLSLLFKTRLFDIENLINHPQYETFQIPKKRGGNRLIQTPESQLMYIQSRLNFYLQNYYHLVRPEGVHGFVINPNKKEKVCNIFENAKIHVQQKYVLNVDLKDFFPSIKAYRVKELFLSDYFRFNEQIATALTLLVTYEGKLPIGSPTSPVISNFICLELDSALSAYCMKNEIRYSRYADDLTFSSNQSISKAQYTELKEIIEQNQFELNVKKTRLKSNNRKQTVTGLVVNEKVNVDRKIIKMVRAMLHDTLQKGISKAAKNHFKSKNEIRNTSETYFLNRLEGYINFIAQVRGHDDPIVLKFKYHYKMIFQLA

SEQ ID NO: 1547 - protein, 363 aa, Flavobacterium sp.
  source 1..363: note = Related to NZ_QLSZ01000003.1; note = Flavobacterium aciduliphilum
MNNPLKTIDKIHTRLEEYNAYYYGYQGDVVFKFNQTFFVQQLLSVVKLSDLKVLLKLNFSWLGPLINAPHYDSFSIPKKSGGMRKIEAPEVLLRATQARFNFYLQHYYHLVRPEGVFGFVINPNKKESFCNIVENAKLHVHKKYVLNLDLEDFFSSIKAYRVKALFQSEYFRYTEEVANALALLVTYNGTLPTGAPTSPVISNFICLQLDAMLLAYCNENALHYSRYADDLTFSSDREITTLHLEELSKIIHSNHFTINSKKTRLRLHHRKQTVTGLIVNEKVNVDRKTIKMVRAMLYDALQNGVSKAAKKHFSITKETSQMSDTYFLNRLEGYINFIAQVRGKEDAMVQKFKEEFKMVHLLS

SEQ ID NO: 1548 - protein, 374 aa, Flavobacterium sp.
  source 1..374: note = Related to NZ_CP037933.1; note = Flavobacterium nackdongense
MKHKLLLDKIHSRIEDYNRYFYSSENDVIFRFEQKFFVTKLLSIVTIPDLKILFKVHLSYIEKVINEPNYTSFLIPKKNGGNRLIQSPESDLKKIQMKLNFYLQQYYHWIRPDGIYGFVINPNKKEKICNIVENAKVHTNQKYVLNLDLKDFFPSIKAYRVKELFLSEYFKFSDCVATALALLTTYEGKLPIGAPTSPVLSNFICLELDADLVAFCNKNQINFSRYADDLTFSSNNEITDETINIISEIIKKNQFSINPKKTRLKSSNRKQTVTGLVVNKKVNVDRKTIKMVRAMLYDASNNGITIAAIKHLKLDRNANVVDVSYFLNRLDGYINFISQVKGDDDLLVLKFKSEFKNLAKMKTKHIKSNSYNNS

SEQ ID NO: 1549 - protein, 400 aa, unidentified
  source 1..400: note = Related to JADJXZ010000007.1; note = Crocinitomicaceae bacterium
MVTAFTCFCVAHCVPLLKADEIQIISNGSFFMLTSDELISTARRYKRWMKLNYRLRYSMRPAVLNHLSKNEFESARLLMIENSHDMICFFDQIPKSYLEKILNEPNYTEYALNKKKGGQRKIQIPEPVLKRMQKKINAALQAYYLLIGYENSFGFVKKTSHAAFTSGIATNASKHIGQQVVLNLDLKDFFESVSAARIFTLFKSPLFKFNEDIAAALALLCTWQKRLPTGAPTSPILSNFICLELDQNLHEFSLKNKLNYSRYADDLTFSTNERITEEMKIELKEIICRNQFEINAKKWRIRTQNQKQLVTGLVVNEKVNVDRKFIRKIRAMIHDLKLNGLENATGNHFRKSTKNNHELQFRFINKLHGYIDFIGQVRGREDTIYKKFKWELVPFGMADS

SEQ ID NO: 1550 - protein, 364 aa, unidentified
  source 1..364: note = Crocinitomicaceae bacterium; note = Related to JADJEU010000021.1
MTKTNDIIQYARANKKWAQHRKVSIANGTAGIKDVIQQREMAALHFLCMDSAHDLTRLFKRDISFVEYCMNYPVYVEHLIAKKTGSKRIILAPDKNLKRMQRGLNYYLQCYYNLIKPDVVFGFVKTIRRQKNPSAIVQNASMHQKKKYLLNLDLENFFPSISAKRILTLFSGPHFQFNSEIATALALLTTYQGKVPVGAPTSPILSNFICLEMDEQLIELASRHQLTYSRYADDLTFSSNEFITPEILKEIRSVIEQNQFKLNEKKLRFRNAGKQQIVTGLTVNEKVNVDRKFLKKVRAMAHDLEKNGLEDAAQKHFRRNSPSEEMNATFLNTLAGYVNFIGQVRGKEDGVYLRYKRIFSPIPS

SEQ ID NO: 1551 - protein, 352 aa, unidentified
  source 1..352: note = Related to JAIOZE010000006.1; note = Crocinitomicaceae bacterium
MKLKINSTMKWESILEKRDSHAANIRRLICTSNGVIPSFSHSLREGRVLTFLSVSNWIELSCFLQLSPIKLEQVINCPNYRQFTIPKKKGAPRLIFQPDPDLMKIQRKLNRYLQDVYSFQLPECVHGFVCKSNQVSRSIVTNAQPHINKQRVLSIDLENYFPSISAKRIKVLFCSWGFNEEIATALTLLCTFKGGLPAGAPSSPVLANLCTMELDSKLIEFSKNNELTYTRYADDLTFSSNDYILDDTILRVLEIIKSTDFSINMKKNRCMGRNSKQKITGIVVNEKLTADRKVKKKLRAMLHDLAKNGLEIATQRHYSIVGQPTDLEQNRFLKHVIGVQSFVNMVNNHRFS

SEQ ID NO: 1552 - protein, 342 aa, unidentified
  source 1..342: note = Related to JADJDM010000008.1; note = Bacteroidetes bacterium
MDKIEVNKIVNASKLNQFRTIELLDKLSCFLKVNTEVFSNRLNYPVYTTNRIPKKKGGWRELLVPETELMRIQSKLNVCLQLYFNKIKPDCVHGFLMNERTGEELRSIVSNAQAHVGKSFLLNIDLKNFFPSISAKRINELLHDKLSLFPNEKMANAVTLLCTYKGFLPTGAPTSPVLSNIVCLPLDYELSTYCENNQITYTRYADDLSFSSNRYFSEKCISEIRQIIKEQQFAINEKKFRINSRKSQQRVTGLVVNNKVNVDRTYIKTIRACLHNWKLNGLEHATAKHYFVIAPSTEEQAQFSNKLKGQIEFIGMVRGKKDEIYIKYKGEFKYLIGSSVFP

SEQ ID NO: 1553 - protein, 300 aa, unidentified
  source 1..300: note = Bacteroidetes bacterium; note = Related to JADJDM010000011.1
MVNPTIFEDRLNSPVYTTNRIPKKKGGWRELLVPEKELKYIQKNLNFYLQLYYNDIKPDCVHGFLMNERNGDKTRGIVSNAQAHTGKAFLLNIDLKDFFPSISARRIKHQLFNELDVFANENIANAITLLCTYQGYLPTGAPTSPVISNIICLQLDKSLMAFCKERNITYTRYADDLSFSSDNYFSDECINELKNLIEQHHFKINEKKFRINSSKSKQTVTGLVVNTKVNVDRKYIRNIRACIYNWRMNGLEFATAKHYQVISPDMEKQTEFANKLKGQVEFVGMVRGRKMKFIRDTEEI

SEQ ID NO: 1554 - protein, 397 aa, unidentified
  source 1..397: note = Crocinitomicaceae bacterium; note = Related to SSGS01000121.1
MHAFSTSFHTHAFHLKISTTALFLLLTMTHSDNKRTEKIREAFFAQIQSEAKEERKQNRLKAIQSREKFVGRFLRMQLAGDLCKLVKEDYNSLNEMINRPNYHSFSIPKKRGGKREITAPDKRLLRVQKKLNRYLQFVYLGVRPTAVHGFVMQVSDGSVQANIVENAKVHVGKRAVLSIDLVDFFPSISAKKVKDLLMGSPFNFNEHIAVPLALLMTAERKLPQGAPTSPVISNFICLQLDETLRIWALNHNANYTRYADDLTFSADLAFSEEQQADLRKLIEAYGFVINVKKLRQRLKNRKQTVTGLTVNTKVNVDRRYLKRIRAMLHDLNTNGIEEATIRHFKLVRRASPEQRLLFVNRLEGSIAFIGQVRGQSDPIYQRMRKAFFDMSSSKKEK

SEQ ID NO: 1555 - protein, 370 aa, unidentified
  source 1..370: note = Crocinitomicaceae bacterium; note = Related to JAIOZF010000070.1
MNKPANEFQPSISNGNFKQTLAERRIEVKKNRIKNFQMRENYSNRFLRMQCATDLCLLLNEPFYNLEFLINKPNYNTFSIPKKSGGKRDISAPEKNLLRVQKKLNRYLQFIYLRLRPTNVHGFVLQVGNHEIQANIVENAKHHVGKKAVLNIDLEDFFPSITARKVKELLKSAPFQFNEDLAIAIGLLTTHKGRMPQGAPTSPVISNFICLPLDHAMQQWSIKNKVNYSRYADDLTFSADIVFSPSQILELRAIIESFGFRLNEKKLRQRLNNRKQSVTGITVNTKVNVNRRLLKLVRAMLHDLRVNGIETATRNHFVSPENPYFDRKKFFLNRLEGSIAFIGQVRGLDDPLYTKMKTEFYLLLDSKNTD

SEQ ID NO: 1556 - protein, 359 aa, unidentified
  source 1..359: note = Cryomorphaceae bacterium; note = Related to JAJTDQ010000129.1
MTVYEFVEKQRPELKQSLRTQTMKIKSSPELTKHTISAGLLLSLQNAQDVCAYFQLPRAVLEQLINSPKYRSFSIAKKRGGKRLIQAPELGLMKVQRILNHGLQSLYACNPNPSVFGFVINDEQANPASPIVQNAAPHVGKAYVLNIDLKDFFPSIRAHRVKELFMSQQFRFNEQTATVLTLLTTYQGRLPQGAPTSPIITNFICAKMDAEMRKIANDKGWTYTRYADDLTFSADLFFDAEAVAEIRSMIVSNHFVINEKKIRQKGKGRRKEVTGIVVNTKPNVKRSYIRQVRAMLHDLEKNGRTIASANHFKNSPVVRENDHSVFINRLRGYISFIGQVRGKEDPIFLRFQEKMKALT

SEQ ID NO: 1557 - protein, 373 aa, unidentified
  source 1..373: note = Related to VEQH01000117.1; note = Flavobacteriales bacterium
MNQTELLAYKATYNSVFRQYLNSPRKTFKPPFLLSKSIQYALYFLAIERPLDMCAFFKIHHQELEDIINQPTYVTHFLLKKKQGLRTIKAPIGTLKLLQQKLNRHLQGVYLNLKPTCAKGFVINPPGSSLKANIVENALPHVAKKYVLNMDIRDFFTSISDKQIYHLFKSSPFDFSPQIAAAFTYLVTVDDCLPQGAPTSPILSNFACRSLDEKLMEFANHHQLNYTRYADDLTFSSDIPFTKEQIATIKKTLREEGFEPNEKKFRLRTSNKKQLVTGLVVNEKVNVDRKMLKRVRAILHDLRLNGASKAAQNFFKSESKPNETDILLFFKKLRGMIDFIGQVRGKEDVLFVKMRQDYSSSFAIEEDRMVYYR

SEQ ID NO: 1558 - protein, 383 aa, unidentified
  source 1..383: note = Ignavibacteria bacterium; note = Related to JAFLBV010000001.1
MLTAILDGIRKNYTKATFYTYRQIVVNKKKGGKRIISIPGLLLRKSQRSLLPFFQQLRTHSCAHGFVVGKSIITHASLHLAKESILTLDIQDFFGSITSEHLEKIFRSHGVQKSEDLELLIKLTTINGKLPQGAPTSPILSNAVVFEMDFELNEWATKNNLIYSRYADDMVFSSETRTIEKTCIDEVSQITQKFGFKLNNSKSRIMPRGKRQVVTGLVVNTKLNVKREYLRNTSAILHNISNNPFSALSQVSRGSVFATYQSYEKEYLSRNLSLSSFHYLIRNQKQQQKLINPTKIRLHRKSHFSNYPIFRLLLLLQGVNGRISFISSVIGENQISVQKLRNQFKEIEKELFGNYSINWSTNTTRLYKIILRECPQLRTRIKG

SEQ ID NO: 1559 - protein, 319 aa, unidentified
  source 1..319: note = Ignavibacteriales bacterium CG18_big_fil_WC_8_21_14_2_50_31_20; note = Related to PCUD01000174.1
MDYFYKKIKRLILAWEDGTPNSDNIPSNYDYSRFKIIKKDGGHRIIYSPYGHLKKIQRGISELLYKNVELHGASHGYTINKSIITNAKQHLKKNCIINIDLENFFQTINTVMLNKSLKLFFPDITDELLIKIIAICSFEGSLPQGAPTSPILSNLVCYSLDLKLSELAISHNLDYTRFADDMTFSTNNKIVELQLKNDINGIIQSEGFRLNEKKYRVLKKRHRQSVTGITVNEKINVTRKYIRGIRAALYNWETYGKKEASRRYFESAKTKICRSHNFEVSLRGKIEFVGNVRGKEDEIYSKFKNKFEIINLFEKINQF

SEQ ID NO: 1560 - protein, 630 aa, unidentified
  source 1..630: note = Related to NZ_VYVA01000005.1; note = Flavicella marina
MNINTGILFFVMKKFNYHKIKYKNTELEEFISKELNSHLIKNILKHKSSFYKSFTVLKKNGAKRRIDQPHYKLMDIQKKIANYLLVKRKKNSSSHGFEYYRSIVTNAEKHINKNIVLNLDFKEFFKNISKSQVLSVLRNSFDITNESAYLLTELVTFNNCLPQGAPSSPVISNYVCNNLDNDLKTYCKEYNIIYTRYADDLTFSFNFKKLPRQIVDEIISIIVKHGFKLNDQKFRYFHKNSRQLVTGIVVNDHVNIKREFYKKVRAILHNWKTKGYVVTKQKFDLEYPNKNFRKTLLGWVNYIGYVRGKDNPMYLTLSSSLELLLRTKYPKSEFKTDEKYCDKCKTGILIETKEGGVKNNFKKSNDASYFFECNNEECNFSENIDSKYFFLKSKAYLKNNNLEKVKELLEKSIELDSNNYKAYNNLGVISYNKKEYKVSVEHYSNSIKAYRERAKPYYCRGRAYANLQQFENAILDYLKYIQLSTRKDVLNSVYFHLGQAYFKTHKYEEALNYVNLHIERFEITKAVIALKTACLNNLNNLNKRFELKIYKDASKIYDVIEKNENIWFEYQTIDSDESVKVALVSLIPKGILFNKEINSLSVKGYNLINKKEETYLIDNIANLINVPKEI

SEQ ID NO: 1561 - protein, 442 aa, unidentified
  source 1..442: note = Ignavibacteriales bacterium; note = Related to DPRR01000040.1
MGSSFFNFMSRKFTISQFRKLNNDFLDVESPNKLAEILGIKTSVLIKNIKYQRYTSFTSIHKGKKRIVAEPNFELKQIQRRLNNYLQAIYYFNKHENVHGFVKCVTNEKIRYSILSNALPHVGKSYVINADIFRFFPSITGKMVKDVFLGEPFFFEDNLASALALLCIQKNWLPTGAPTSPVISNLVCMELDEELNVLANKNNYSYTRYADDMTFSGENKPDEKFKDELTSILESFGFKLHKKKYRVLTKHTRQTVTGIVVNEKLNVKREYKRNLRALHHDIKVNGIENALLKNRSVQILTIQGIESFKNSTLSKSLFVDKVAEYSKAISNAGNIDGEVEYLLFADLELDGFIIDVFDNHKQAVKKMHELWHFIASLWTLSHNDIVGKISAISQKRYRLTEETRYETIGLEGCSNGFYTVGVVKLNNKFTQEEYEKKRGRIR

SEQ ID NO: 1562 - protein, 443 aa, unidentified
  source 1..443: note = Leptospiraceae bacterium; note = Related to JAGRNG010001065.1
MAKHYLRELQHIYNLKILSQYLGKDEYELQNLLYRKTYSSFLIPRKNGKHRSINAPSDELKYVLQNLNRFLSAIYNEMQGQEHPAHGFTLGKGILSNAKIHSGKAFVLNLDLKDFFPSISRNRIKEVFSSEPFMLKTEIADYLSELVTYYDTLPQGSPASPIISNLVCWNLDKTLSDFAKKNLLVYTRYADDLSFSSNQKIDTEIIKQIEDYIQKEGFQLNTDKTRIQNRTERQVVTGVTVNVKPNVSRKFIRRIRAILHSWETLGYEEADTIFQSSYKRRKGVFKAPSLKYYLIGNIAYIGHIRGQDDSIYNNFCIKLFRLSDRKVFKGQIERFIQSLQSDIDNQQFSETNLENRIFNLAKKAFEPHQIRYNNILRKYYTLRKKTKINITKGKNYSSLFLASLETSPEFKELLYESGRFGDKEYYSQYIKEAKRLIRNTNLI

SEQ ID NO: 1563 - protein, 342 aa, unidentified
  source 1..342: note = Bacteroidia bacterium; note = Related to JAGPCI010000303.1
MAIKTIAQLCSMLQVTAKEFQHILALPEYVSYSIPKKSGGIRAVEAPQGLLRELQGRLAKYMQPFYTQHKLPCVHGFVKAFNNEPKYGVLTNAKPHLNKPCVLNMDIKNFFDSISAKHVKQALQQYPFMVSDEVSTAIALLCTHNKKLPTGVTTSPLLSNIVFYRVDKALIDLVNEINSTKCKDDVAIYYTRYADDLTFSGEVKLVNEIQARIVEILASYGFEVNTKKTRLQKTYAAQWVTGIKVNNKPNVSRLYVRNLRATIHNLQNNTATDAVKKHLGTTPNKEIDLSDVHTMLASIRSKIAWVGLVRGKTDDVYLKLKRNFKEAEQKILLHEVPEKKRN

SEQ ID NO: 1564 - protein, 333 aa, unidentified
  source 1..333: note = Related to JAJTFA010000003.1; note = Sphingobacteriales bacterium
MRSLEELLKILAISSELLQQLLAAPEYTIYHISKKSGGTRTIQAPQGLLRQTQVLLAKYLQTVYSRHHLPCIHGFVPSAGLLKYGVLSNAVPHLNKPFVLNMDIKNFFESITAKKVKKSLCEFPYYFNEEVATAIALLCTYQKQLPTGAPTSPVLSNMVFYIPDVALLQWITDVNETKQIDETGISYTRYADDLTFSGSANLVLSLQARIISFFATEGFEINAKKTRAQTPHGPQWVTGIKVNERLNISRYYIRNLRAVIHQMRVHAAEAVVCRYLKLPATTQINTAHVKKMLSSVQSKIAWVGMVRGKADPIYLRLQTQFNVAREVMLVKES

SEQ ID NO: 1565 - protein, 348 aa, Flavobacterium sp.
  source 1..348: note = Related to NKJD01000090.1
MNTIILDNNNHWDSLLFINANTLDKMAFSLSCHLSFLQRQVESPKYFQFKVSKKSGGFREINAPNAELKYLQRNLSWKFNKIYSSPDGVHGFVKGTFLETRHIVSNAKLHIGKKWVWNLDIESFFSSITTQMVINRLMEAPFNFDENKAKYISLLIIYKRQLPMGSPCSPVVSNLVCENMDAQINQWVANQNKFQPEINLVYSRYADDITFSTDLAISDEHKLEIYDILNQYGFEVNRKKERIQSNKQSQWVTGIKINEKPNVDRSYIRNIRAALHQIRAKGLQEAATNFFNLKELANTTEIDRFLRILQGRISHVGFVKGKDDSAYLKYWRELGEVMAPIQKEPLIY

SEQ ID NO: 1566 - protein, 333 aa, unidentified
  source 1..333: note = Related to JAFDXR010000008.1; note = Bacteroidetes bacterium
MKSKYKFLDSQLAIEDISSILNIRFTELIKNIEKPNYTTFRIPKKSGGHRVVFAPCSDLMKIHNIVNNKLRSTYHMMQPKVVHGFTYKTAKEKYLDIGIKANAKMHLNKKCILNIDIKDFFPSISISRVRAMFECPPFNYDHNLATGLALLFCYKGQLPAGAPTSPLISNFYCLKLDADVLELSNSENITYSRYADDLTFSSNAIIDTKFVVKVSEILKNFGFEINRKKLRKASNFQAQYVTGIKVNQTLNLNRTYYRNLRAVLHSIEQIGVSASMLKYKGKKRYILGEEHKFLSSVRGRIEYLGYIRGNNDVLYKELKNKFNALIDRAPINY

SEQ ID NO: 1567 - protein, 330 aa, unidentified
  source 1..330: note = Bacteroidetes bacterium; note = Related to RGVD01000053.1
MKEITKNRFLSLQFVDELSMILGMSLGDFTSAIENANYKSFEIPKKSGGTRLISSPDSLTRKLQSKLYVYLKSYYHSVHPKCVHGFIPKFKAKASHHIKANAQVHLGMPYLLNIDIKDFFHSISTTRVRSLFANSPFYFSHEVSTALALLCCYERKLPMGACTSPVISNLICLQMDALFIKWSNEQKIKYTRYADDISFSSMMAFSHKQIEDIRTIIQNERFEINEKKLRIQSRYTSMWVTGIKVNQKLNVNRTYIRNLRAILYDIKTNGWEKACKKHFHLNENTKNEEELKSKFYFKIKGKIQHIGYVKGYSDEVYSKLNNQFLGLQIL

SEQ ID NO: 1568 - protein, 342 aa, unidentified
  source 1..342: note = Related to NZ_CP060007.1; note = Lacibacter sp.
MEIKPFHRKITDLQIQQFLHFNSVHDLSHLINIDTDIIEHVLDEPKRYHEFPIPKRKGGKRLIHSPSRPLKDIQKRLSIYLTRIYHEYAPAYVHGFIRSNKKTSSRNILTNATQHLDRPYVLNIDIENFFPSINAELIKSAFNKLPFQMYSDEGASIISLLLTRNWILPAGSPASPIVSNIIFYETDIALHKYCIKNKLVYTRYADDLTFSGELINDHMTEAIKKIIIYHGFMINDKKVRLQSKQSAQYVTGIKVNNKLNVNRKYIRQLRSILHDWESNGIDIASTRYYAGKLHRYQNRLDMYTSFKASVHGKLAFLQQIKQEEPVLQGLYKRFIALKNTYM

SEQ ID NO: 1569 - protein, 333 aa, unidentified
  source 1..333: note = Related to VEQB01000383.1; note = Bacteroidetes bacterium
MNTHRIEKFIAAKSMRQLELSLLASRNELKQWVQNPDYRTFEIPKKKGGTRQLHAPAPPLKRIQQSINELLQILYVPTQNAYGFMLKQAGEINRNTLQNANCHLQRNFVWNLDIQNFFPSISTKRVKAIFMEGPFYMTDEIASYVALLCCYQKQIPAGAPSSPMLSHFACLQMDNSLQKFIAQAAFKPYQISYTRYADDLTFSLDLLPSDEIKNGIESIILEHGFVLNTSKNRIQHKHQGQWVTGIKVNQKPNLDRKYIRKLRAIIHHVEAKGIIAATARYLTLAEEQIKQKEISFFLNSVRGKINYVGAVRGKEDVVFKKLITTFNSAINGI

SEQ ID NO: 1570 - protein, 376 aa, unidentified
  source 1..376: note = Bacteroidetes bacterium; note = Related to SHWY01000031.1
MYLQSSENVADTNPDFPSENPEEEKRKFACLFLIIKQFKIYMNKNYDNLEQLANIKTPDELLNLLEVSPSSLIAMVENPQYETFHIPKKAGGYRCIDAPSEDLKRVQQKLASHLSYLFINFQTRSVMGFVPHYKGINNPAGIVENAKRHIGQPIVLNIDVADFFPSIKISSIKKMFMQKPFSFNDELAHLLALLTCYKGKLPQGAPTSPILSNFFLLRADLKIERIMKKRELNYTRYADDITLSGFLFPQDKLPDIVQEILTPFGLRLNEKKIRYQTFVGRQEVTGIKVNVKLNLDRRYIRRIRAILHCWDVKGIEHAATVFHKRKINNALEFTSTIRGMIAHVGNVRGKEDVIFLRFHEKFNSLSIFEEMKVVAM

SEQ ID NO: 1571 - protein, 550 aa, unidentified
  source 1..550: note = Related to NZ_QICD01000043.1; note = Paraeggerthella hongkongensis
MVDNKHGALLDIESKEDFAYYLERPIKDLTMLAYAKNGIRYKTFEIGKKRSGEKRTIEAPVGYLKAVQRQLLELFNEAYRPPQCVHGFVSSCSIASNAMSHVKKSAVVNLDLRDFFPSITGDRIHGLFRKDPFSFPEDVANLLTELVCYKGSLPQGAPTSPILSNMICYRLDKQLVSYAAKNKLVYTRYADDITFSSTSRSAINKLFNESELGINSVSPEVRNIIGSNRFEINETKIHIARKSSRQQVTGIIVNEKCNFPRKEYRSLRVLFNNWALVGFEYAGAEYAKRNHSYSSKLFNEAGLISETLLKKHIRGRLEYYTMITGPNKKASQPLAKLWNMYHDVTGEKVPISTPERTVCQTEICYSRQNDQGDPIPLCENGTSFLTDKGYLFTCAHCLCDIHHEYKKIGDERCSFPTLKVLYEPELSDFLIDKTLDVAAIKAPPFMKNEAFALTNGNYFPQIGESVKAYGFAGGDSSIRCIEAAVAETLKAGRVRVDRPFIHGMSGGPVFNTRGEAIGLLTGGSAPDDYSHDGEFVLFSAISEQLPNAFR

SEQ ID NO: 1572 - protein, 549 aa, unidentified
  source 1..549: note = Eggerthellaceae bacterium; note = Related to JAFRJC010000116.1
MRTRADVAAFLGVTPQQLGFLAFSSVPKYTVFNINKKRPGEKREIKAPILVLKRVQRRLADVIASIYESNNPPNSVHGFRLNRSIATNAKCHVHREAVLNIDLENFFPSINGGRIRGLFLHEPFNFPEEVADTLTNLCCDAGGLPQGAPSSPVLSNCICKRMDKRLLSFARENDLVYTRYADDITFSAFNKRRLRHACLSDGSPSLQLSSELLKIIEGNGFSVNTTKTHLSTRSSRQEVTGVIVNEKCNFKRSDYRELRVLLHNWLDVGYKHAGKEYIKHKPEIALAIVDDDDTISERKLRSHIRGRLAFYTMLANQNPGISKPLRRLWTMYAGATKEIVPTVDPESAIWQIVTYYDYVSSKDGSVKNFSKVGTVFKADGECLITAAHCVADLDEVNVCSEAVCEIAYGPVPQFCELGNVDWNPKSDYAVLHEMPEMLNNITGLTCDGTYRAQVGETVWAYGYSDAKPQLRCIEARVSEVHSDGRFYRVDRPFIEGMSGGPIINSRGSVIGIAVHGSAPREYVYDGEFLSIAHVNLGTNYQTNESCSAS

SEQ ID NO: 1573 - protein, 549 aa, unidentified
  source 1..549: note = Related to NFIU01000004.1; note = Olsenella sp.
MASQEISFTSIATNAQLAEYCGVSWDELKMLAYANRIKRYTEWLVPKRNGEGFRRISSPMANLRRVQRAIANGLSEFYSPLKCVYGFVCERNVAMNALQHARKRTVLTLDLKDFFPSISAPRVRGLFMKAMDFPQDVADTLTNLVCYEGSLPQGAPTSPVISNMICFKMDRALLNFAANSGFTYTRYADDLVFSSTSAYSARKMVDQGKNVVDGINRFIIDTIESNGFEINERKVHVANRGSRQIVNGIIVNQKCNIRRSQYREFRALFHRWIREGCSSAAAAYFGNKKNHCYKAKLCDGDELCDEKSFVRHIRGRLDYFSMVVGVNGHPTEPMAKLWTLFHQAAHERVPYLTFEKSAVQLSYVFDSKEKNDAVAAESSGVIVRDILLTCAHGLPEESTDANGDAVPIEIRTAFDERFYIKASSFRKCSGFDFAFVLLDAKLGNMGVRSINTAYLPQAGETIYASGYAGGKMPSHCVQASVLPNRYGNGSIVVDRAFIKGMSGGPVFNTRHEVIGIVLKGSDESSYSRDGEFLPFSAIADLEPFALLKK

SEQ ID NO: 1574 - protein, 558 aa, unidentified
  source 1..558: note = Related to JABZQH010000155.1; note = Mogibacterium diversum
MALNFGKETFSDNVNITNSFLEIQTPEDLAAHIEENVKVLKKYAYPGKRIFYSILIIPKKDHSPRLIEAPCNDLKRILRKITDQLTYIYQPPACVHGFVCSKSVATNAHSHVNKYFVSSFDIKNFFPSISAKRVRGLFKNIFFYANDNLIDLLTNLVTLHKHLPQGYPTSPIISNMICLQMDKQITKYCKEKHLFYSRYADDITISGNSKRLISNIFISSKAEDLTLCPDFSNIIESNGFSLNSQKTHISFKSDRQTVTQIIVNKKCNIPREVYRSLRVLFYNWQKNGWQYAANEYAKFISDHHYISFRNDVNSPMLTDEQLFKKHIRGRLAYYTMIDAQNSIPSTPLTKLWEMYLQCTKEHVPMSLIENNVFQLEITYDYEIDGKSNNFTSSSTGFLTEKGLFTCVHGLKELNQKYDIPENTNVEVACLNKSLSRKFPSQIPIKDFLLCEEDDIAFYRYKNIKPLSNLVINFNYLPQISEHVTGYGIPGGETDVYPIEAIVDSFKLDKSCVRITPTFYKGMSGGPVLNARQEVIGIILEGSSFDDLSRCGLFIRLLS

SEQ ID NO: 1575 - protein, 541 aa, unidentified
  source 1..541: note = Related to NZ_JADNOH010000001.1; note = Collinsella aerofaciens
MLNGFQSKADLAGFLDLSLEKLDLFVNPTSMYQLYRSRLVPKRCGGYRELLIPRSDLKKAQRIIACELEKSYSPLPCVHGFVKGRSIKTNAETHVGSQVIVGLDIKDFFPSISSKRVYGLLISKRLGLTPEVAFCISRLVATPKGLPQGAPSSPVISNMICLGMDKQLMHLFHEYHYQYSRYADDLTFSFRSSFFFYRHFYSGGKLRLPNKLRNAITNFHGIASFELNEDKSFYSFSFSRQLVTGVVCNKKTNIKREQYRRLRSTLHRLSVGDCNGAMGCYYGKSVGEITDAEIRMFEPSLRGSLDYYKSLIKDPWTSGPLMRLGSLYNNSKPEDAPVFPVALHQDSILYLEGVDCEQNPFEGLGFYLTGYGLVTAWHVICDAVSRDMESGEIRIFSSNKTPLARFIYSNDLLQENKRDAAILKDVPSEMIKNTPQLSPNIDLPTKGEKITAYQHHFSESGFSFELHGGELLRLGDPNEEGTLCYTNCSFMHGMSGGPVFNGIGQVIGIVHSATEQGKLGSFLPLRDCFRSTDVYGKWIIF

SEQ ID NO: 1576 - protein, 541 aa, unidentified
  source 1..541: note = Related to QSIL01000003.1; note = Collinsella sp.
MVDELQTKKELADFLNLSLDKLDYFVSADSFYSLYRHRLVPKRNGGFRELLIPRSDLKRVQRIIAKQLEKHYKPLPCVHGFVRGRSIRTNADIHVGSQVIVGLDIKDFFPSISSKRVYGLLKSKKLGLSSEVAFCLSRLISTPKGLPQGAPSSPIISNMICLGMDKQLMHLSREYHYQYSRYADDLTFSFESSYWFYRHFYSDRKLRIPNKIRVAITEFHGNKSFEINENKSFYSCNYSRQVVTGVVCNKKTNIKREQYRRLRSTLHRLSIGDEEGAMGCYYGKSSSDLSEEEKGTFRASLRGSLDFYKSLLKNPWSSGPLMRLGSLYNQSKVEGDSVFPIALHQDSILYLEGINSKDEPFEGLGFYLPSYGLLTAWHVISDAVFDDREKRNIGVKSSAKISLGIFSFGKSTVQTGRHDAAILNDVPPEIIQSFPRVSVSTDLPSKGDKVFAYQLHHSENGFRFDLLDGELLEIGSPSEEGTLCYTNCLFQHGMSGGPVFNGMGKVVGIVHSATEDGKCGSFLPLRDCINSTEVYGIWKTF

SEQ ID NO: 1577 - protein, 570 aa, unidentified
  source 1..570: note = Related to CP024960.1; note = Collinsella aerofaciens
MCCLHIIFCYVSIKYDSTEEPAINFKENLMLNELQSKTDLAGFLGLSIEKLDFFVNSSSMYDLYRNKLIPKRNGGYRELLIPRSDLKKVQRIIAKELEKSYNPLPCVHGFVKGRSIQTNAETHIGSQVIAGIDIKDFFPSISSKRVYGLLVSKKLGLTPEVAFCISRLVATPKGLPQGAPSSPLISNMVCLGMDKQLMHLSHEYHYQYKRYADDLTFSFKSSFYFYRHFCSEEKLRLPNKIRNAITDFHGTESFEINEDKSFYSCSFSRQLVTGVVCNQKTNIKREQYRRLRSTLHRLSNSDIEGAMGCYYGKSIAKLTDAERGIFQAALRGSLNFYKSLIKNPWTSGPLLRLGSLYNKTKPEDTPVFPVALQQDSLLYLEGEDDKETPFEGLGFYLTGYGLVTAWHVICDAVSHDMERREIKVSSSDKTPLAKFKFSKSIVQDNKRDAVILREVPQEILKKIPKLPAVMDLPVKGDKISAYQQHFSESRFSLELHSGDLLRVGDPSEEGTLCYTNCSFQHGMSGGPVFNDLGQVIGIVHTATEQGKLGSFLPLRDCIRSSDVYGEWQVF

SEQ ID NO: 1578 - protein, 570 aa, unidentified
  source 1..570: note = Related to NZ_VOXD01000052.1; note = Lewinella aurantiaca
MKFKKITANRRNFIKFISPSDNEVYDFDTVKKLSQNRHNYYKKVKIPKKNGGFREILIVNGEIKRIQEKILELLQSVYNDSSTPKCVNGFVKGRSIYDNAAIHTNKKHVINFDIKDFFKSVTLEKINTYLSYKPISLPRNQYPNVLISYLCTYDRYLPQGAPTSPILSNIVLKNFDYAMIMLAKKHKLVYSRYADDLTFSGNEDIDFFSFKNTVAQKLNKHGFEMNMNKSRIQYSWQRQIVTGLVVNNKVNIKSEFVATTKSMIYNWENYGIDIAKEKFNQHRKHSDGIHFENVLRGRIDFIGSILNRSGEYKNPVFAQLNLKYWILLNCIDYSFVSEKSVRDKLFNRNYESEKIAYDSSLYESQEYRFISYCFKVYTQMEIIYKYYFYLRFNGDFMKIGMFMYDNSKNIRKQFKRMFSECEDEDKKIKLAKQRISGIKNLKEISTFNIESLFMDQLYRKRNRSLPKFFNFIREIRNYHAHAGEKIVKQTFEEVQSDVKSIIESKNLSEVTLESKTFTGVSHEELRKINHYQFYLWFQSSPFDDVREILKELAFEVKLIENRIKKNAHNT

SEQ ID NO: 1579 - protein, 343 aa, unidentified
  source 1..343: note = Related to DMWN01000144.1; note = Flavobacteriales bacterium
MITENHIQALKASTDADSFVQAMMPGVDYLIDSKRSKLEHSEIVKVVKNFELFTSSASIRRYRTFEIPKKSGGSRKIEAPVLPLKTLQRLILLFLESVYDAPAQVHGFVKDRSIITNAMSHSNKAHVLNIDIEQFFNSVRQTRVRALFNKHLGFSQYSSLMLSKLMCHRGCLPMGAPTSPLVTNLIFQRADKRIFAASKKMNVTYTRYADDLSFSCDSVESLHRTKRLIAVIIRQEGFKVNPKKTRLLHRADCQSVTGLVVNDKVNVLRTYRRTTRAINHRLEISIKEHSGDTNMALIAASEYHAMKTGQNDARPPISHLNFIKGRQAFEYGVLKSSQSPEES

SEQ ID NO: 1580 - protein, 788 aa, Vibrio sp.
  source 1..788: note = Related to JAGDJZ010000001.1; note = Vibrio alginolyticus
MKSLLTPCSKKDTPPEDFSSQLQRWLIFRPEFDIKVLQKQNCWPITGQHYKSFNVQKRNGSTRQLVTVDKKLKSVQRNLLHYFEQYYDVSKHAYGFVGETANFKVNKKNLRTRGVITNALAHTNKKVVISLDLENFFPSITFPRVMGLLKSKPFNFSNKEAAILASLVCLPKAIDDKRGLPQGAPTSPIISNLICKKLDYQVGKMAQKYDLIYTRYADDLTISTNNLKRINANKIISLVRDCVERNGFRINKEKTKVMYRNQRQMVTGIVVNEGLNLPKKNVDALKATLHNLEHVYKNIDEAVDGSNKNNYDSFTPLVYCGVFYKGRYIRTISRGQKSTKPTSDKEFNYIYSRHILGRVLWYGQVVTTGINTPYDLSNRKHISPKQYSRIVKFEEMLSSLYRISIKFNWPIEHIIFRLSNKLSHLQSIVKTNPELSLESTEPNKDEIELKHRFSNLKNTKEDRKQFFDDSPSTLKRALIVENRSHSLFSFKSIKKHVEDGWYIPTVQQEVFKELDTGQLSDLFHRSANAQGHNVLNLILEIVKVVKPRSRYLSEEVKDKIVMVHKELLKLIRSEGEGVCIEYSKESTSTKLAIQAINDLKLSTRLYEDDTDNFYNRIVLDAVKQSGTEHLVNIDRQGMETRLVTDIKAWRDSIVHILFSIKQHADKSEVGIGSPQPKPYTIKFREENPITNIPRAVEIYRLNVDLPFNKKLNIASNIEYGLIDKWLTGRDLLLAIKRFMPIGDIFTHGNYLDCDNFTVNLTEHSFKKENNITHKSYGKLFISLQEINN

SEQ ID NO: 1581 - protein, 786 aa, Vibrio sp.
  source 1..786: note = Related to NZ_MCSL01000005.1; note = Vibrio cyclitrophicus
MRNLLTPLSKKTSPQEDFFSLLQLWLTSRPEFDIKVLQKQNCWPITEQHYKLFTVEKRNGKTRTLVTVDKQLKSVQRNLLQYFEKKYEVSQYAYGFVGGTSNFQANTKHLRTRGVVTNALVHTNKKLVISLDLEDFFPSITFPRVMGLLKSKPFDFSNKQSAILASLICLPKGIDDKRGLPQGAPTSPIISNLICKKLDYQLGKMAKKYDLSYSRYADDLTISTNNLKKINANKVISIVKSHVERNGFRINSEKTKVMYCNQRQMVTGILVNEGLNLPKKQVDSLKATLHNLENVYKNVNESVKGANKNKYDSFSPVGFYKGGYRGRYIRSIGKGKKSNKPTSDKEFNYIYSRHILGRVLWYGQVVTTGINTPYDLSKRKYISPKQYSRIIKFEEMLSSLYRISIKFNWSMEHIIFRFSNRLSHLQSSVKMNPELLIEPIEFNTEEVELNNRFSKLKKNNEECKVFFDNCPASLQRALIVENRSRSRFLYGSIEKYIESGWYIPAMQQEVFKDLDNGQLSDLFHKSSNEKGHNVHRLLLDMVKLVKPRIRYLSEEMKDKILIVHKELLKLMRSEGESVCIEFGKDSEKSKLALQAISDLKLSTRLYEDDTDNFYNRIVLDAVKQSGTENLVNIDRLGMEARIVTDIKAWRDSIVHVLISIKQHSEKTELNLGSSQQKPYTIKLRDENPITHEPRAIEIYRLNVSLPFKKELNINTESGLISKWLTGRDLLLATKKFMPIGDVFSHGNFIDCEDFVVNLTTHNYIKKENIISDDYGKLFISLEEIKN

SEQ ID NO: 1582 - protein, 786 aa, Vibrio sp.
  source 1..786: note = Related to JAHUGE010000005.1; note = Vibrio fluvialis
MKSLQTPLSKKAVSSTDLSSLFQRLLTTRPEFDTKSLREQNCWPITGRHYKEFTVQKRNGSTRRLVTVDKRLKSIQRNLQQYLEQNFEVSQYAYGFIGEATQSHKGRQDLRARGVVSNALAHTNKKVVISIDLEDFFPSITFPRVLGLLKSQPYSFSNKQAAVLASLICLPKSIDDKRGLPQGAPTSPLISNLICKKLDYQVGLLAKKYDLVYTRYADDLTISTNNVNKVPPIKILSLVKSCIERNGFKVNSKKTKVMYPNQRQMVTGLVVNEGLNLPKKQVSSLKATLHNLEFKYKNVDDAVKDSNKNNYDSFNPVGYYSGLHRGRYIKSVAKGRKSTKPTSEKEFNYIYSRHILGRVLWYGQVVTTGINTPYDLSKRQHISPKQYVRIIKFEEMLSSLYRISIKYDWSIEHIILRFSNKLSHLKSSLRLMPNYSLNTIEPPQEEVELKERLLNLKNTQEERKKFFDNAPTSLQRTLTVDNKSRKEISFVSIKNRIDNGWYKPDFQQELFKELDHGRLSDLFHRSSNDKGHSVQELLVEIVNVVRPRLRYLSKEMRERIVTVHRELLKLMLSEGEGAYIEYGKDSSAKPIIQAISSLKLATRLYEDDTDNFYNKIVLDAVKQSGTENYINIDRSDMELRLVTDIKAWRDSLVHILFSIKQHLDKTELDIDSLSHKPYTIVFRDENPISSEPRAVEIYRSNESLPYKKKLEIPLNSDSGFLDKWVTGRDLLLAIEKFMSVGDVFVHGNFKDCDKYKVNLTEHSYIKEDNATSKVYGKLFFTLQENK

SEQ ID NO: 1583 - protein, 786 aa, Vibrio sp.
  source 1..786: note = Related to NZ_MCTZ01000016.1; note = Vibrio lentus
MKSLQTPPPSKNISHVDLSSLFQRWLISRPEFDTKALQQQNCWPITGRHYKEFVVQKRNGNTRRLVTVDKKLKSIQQNLLQYFEKKYEVSQYAYGFVGEVPRVQTNKQNVRTRGVVSNALAHANKKVVISLDLEDFFPSITFPRVIGLLKSQPYGFSNKQSVVLASCLCLPKSIDENRGLPQGSPTSPIISNLICKKLDYQVGRLAKKYDFVYTRYADDLTISTNNINKISAKEIISIIKSCIERNGFRLNKEKTKIMYRNQRQMVTGIIVNEGLNLPKKQVDALKATLHNLEYKYKSVDEAVKGSNKHNYDSFNPVGYYRGLNKGRYIKSISKGRKSTKPTSDKEFNKIYSRHILGRVLWYGQVVTTGINTPYDLSNRKHISPKQYSRIIKFEEMLSSLYKISSKFHWKMEHIIHRFSNKLSHLKSSLRLIPDFSLSSLELNSEDMDLKTRLPTLKSTLEERKDFFDLCPKSLQRTLVIDNKSRKKFKISSLENRINNGWYKPEVQKELFKELDNGRLSDLFHRSSNEQGHSVQDLLFEIIDSVRPRLRYLSEEVKEKIVVVHRELLKLMLLEGENSHIEYGKDSSTKPAIQAINDLKLSTRLYEDDTDNVYNKIVQAAVKQSGTENLINIDRSDMETRLVTDIKAWRDSLVHILFSIEQHADKTELDSAALHQKPYTVVFRDENPITQEPRAIEIYRLNKDLPFKKNLNIAPNSSSGFIDRWLTGRDILLATEKFISIGDVFVHGNFRDCECYTVNLTEHSYIKEQKPNSSNYGKLFISLQEIK

SEQ ID NO: 1584 - protein, 801 aa, Vibrio sp.
  source 1..801: note = Related to NZ_PIEZ01000024.1; note = Vibrio splendidus
MKNLSIPSPKINPTQDSFLSMFFRQFDSNPEFDTTVLKKQKCWPITTEHYRPFTIRKRNGTLRELVTVDKNLKKIQSNLLIYFSKNYEVSKYAHGFVAKEIENQFPNNKEEYLVGGRLRAKGVITNALSHTNKKVVISLDLKDFFPSITFPRVMGLLKSKSFDYSNKQAAILATLTCLPSSVDTKRGLPQGAPTSPIISNLICKKLDYQLGKIASKYDLTYSRYADDLTFSTNNLKRISANKIISRVTECVKRNGFVINNPKTKIMYNNQRQMVTGIIVNDGLNLPKKEVDAIRATIHNLENKYKSVDDAVKGFGKLKNKNPYDSFVPLGYYTGGYKGRYIRNARKGKKANKPTTNKEFDSIYALHILGRILWYGQVVTTGVSTPYDLSKRKNISPKQYSRINKYEEILASFYRVSMRFNWPVEHIILRLANNLPHLQSLVKMSPQFLLEPIFLNSEETYLKNSISKLKKEKSDYIKFFESAPESLQRVLVVENCSHDNFIFNTIKKCVEKGWEVPSIQQELFKDLNTGDLSDLFHKSYDSTGHSVKKLIIDLVRVVKPRLRYLSSSIQNKIILVHKELLDLMRSEGEDVRIEYGNESTKTKQALQAIRDLRLAVRLHDDDTYNFYNKVVLEAVNRSGTSDLVNIDRDDMECRMVSDINAWRDSLTKVLMSIKQHADTTEKELSPSQHKPYTIKFKDENPINGESRRVEIYRLEVTLPFKEKLEIDTDFNEGIISKWKVGGDFNSAIKRFLAIGDIFVHGNFIDCENCTVNFTEHSYKLEKNIVRKNHGKLFISFQEIKSK

SEQ ID NO: 1585 - protein, 795 aa, unidentified
  source 1..795: note = Related to PYMT01000050.1; note = Photobacterium phosphoreum
MTTKFSHPQKRNFNSFIRLNFFSTNAPEFSTTELKKNKCWPITEKHYKSFTITKRNKTERELVTVDKNLKVIQSNLYDFFKQKYNISKYAHGFVAKDPLILSLLKEQDKPLRSKGVITNALSHTNKKVVISLDLKDFFPSITLPRVIGLLKTQPYNFSNKQAAILASLICLPKNIDKKQGLPQGAPTSPIISNLICKKLDYQLGLISKKYDITYTRYADDLTFSTNNLKRISATRIVEKVAECVKRNGFKINDSKTKIMFSNQKQMVTGILVNEGLNLPKKDVDALRATLYNLDKVYTSTDDAVKGFWKLKGKNPYDTFTPVGFYLGGFKGRYIKSPSKGIKSTKPTIEKEFEKIYAQHLLGRITWYGQVVTTAINKPYDLVKKQHISPKQFSRIKKYEEMLATFYRISIKRKWPIEHIVLRRAYNLPHLQSLMKMNPIYLLDATFLDENKEIEQLKNKVSELKTDKEKYTEFFRSAPRSLQRVLRHENRSHNNFSLESIKKFTNFGWQDPIKQKKVFNAIDNGELSDIFHQSINRDGDNIKETIIKFVTVVGPQLIYLSKDVKNKLINVHKELLALLISEGESFNIDFYKENPKTEQALQAVRDLKSAIRLYEGNSENFYTKIVLEALKITETIDMVAIDKRDMAPRMVTDINAWRNALIKVLMSIKQHTDETEKHSNAQKQKPFTIMFREHDDDENITTAIEIYRLNSELPFKKELKIDTEVKNGNVKKWKTGGDLKSAVSNFLSIGDIFIHGKFNDCKDITFNLTEHVYKVNKEIKENEYGKLFITLEELNN

SEQ ID NO: 1586 - protein, 798 aa, Vibrio sp.
  source 1..798: note = Related to RCFZ01000008.1; note = Vibrio vulnificus
MNKTSISSPKAKTVDLKSIFMAFEKWRSNRPEFDTAALRKRKCWPVTAKHYKKFTLKKRNGSMRQLVVVDKNLKEIQSSLAIHFSQNYKASEYAYGFVAKESELTAAKTQPELSLDKLRPKGVITNALAHTNKKLVISMDLKEFFPTITFPRVMGLLKSEPYKFSNKEASILASMICLPKEIDDKRGLPQGAPTSPIISNLLCKKLDFQLGRIAQKYDLNYTRYADDLTFSTNNLKRISANKIIHEATKCVERNGFHVNVDKTKVMYSNQRQMVTGILVNEGLNLPKKQVDAIRATLHNLEKKYKTVDESITSFWKIGKKNSYDSFVPLGYYAGGYKGRFIKSASKGYKGNKPTTEREFNYIYSMHLLGRILWYGQVVTTSINEPYDLKKRKFISPKQHSRIIKFEEMLVSYYRISIKYKWPVEHIILRLANKLPHLQSLIKMNPGFLLDSLLLSVEEHELIERFRKLGRDKEEYTRFFKSSPPDLQRVLRVANRSHNNFSHSTIKECVENGWQFPNKQQFLFNELNTGNLSDLFHKSLDKKGHNVEKLLSDLVLVCRPRLRYLSPNIKSKIVAVHRELLDLIRTEGGDVFIDLENETKKTELALQAIRDLKSEIRLYDGDSDNFYQKIVRVALNRSGDSNIFAIDMDGMASRMVTDIKAWQDALTKVLISIVQHTKSLDDKAQGQALYTIKFRDRNPINCKPRAIEIYRLNYELPFKQKLDIDANSNCGQVMKWLTGGDLTLAIKSFLSVGDIFVHGKFLDCDDVTVNLTEHQYIREKHEPIDKLGKLFITLQEISE

SEQ ID NO: 1587 - protein, 412 aa, Vibrio parahaemolyticus
  source 1..412: note = Related to NZ_NNOA01000433.1
MNNASISSHKPSNRDLDSIFMAFEKWLKNRPEFDTAILRKRKCWPITAKHYKKFTIKKRNGSNRELVVVDKNLKELQSNLAAYFAQNYEVSDYAYGFVPKEPERRIGGKEQSELLVEKLRPKGVITNALSHTNKKLVISMDLKDFFPTITFPRVMGLLKSQPYNFTNKQASILASMVCLPKDVDDKRGLPQGAPTSPMISNLICKKLDFQLGKMAKKYDVSYTRYADDLTFSTNNLKRVSANKIVHEATKCVERNGFRVNVDKTKVMYSNQRQMVTGILVNEGLNLPKKHVDSIRATLNNLEHKYKSVDEAVVGFWKIGKKNSYDSFVPLGYYIGGYKGRYIKAVNKGFKGNKPTSDKEFNKVYALHLLGRILWYGQVVTTSIGEPYALTKRKYISPKQHSRIIKFEEMLAS

SEQ ID NO: 1588 - protein, 807 aa, Vibrio sp.
  source 1..807: note = Related to MCVM01000002.1; note = Vibrio lentus
MAQLLNMNNIQKDPSQDKNTTVDSFLEMFERWLLTRPEFDIAALGKRKCWPITSGHYHRFSIKKRNGSKRELVSVDKNLKALQANLATYFEETFEISKYAHAFVPKESADKATFKQQEGLLVNKLRPKGVVSNALAHKNKKVVISIDLKEFFPTITFPRIMGMLKSKPYNFSNKQAAVLASLICLPKDIDDKRGLPQGAPTSPIMSNLICKKLDYQLAKMASKYDITYTRYADDLTFSTNNLKRIPAKEIVSIVTKYVERNGFQVNTTKTKIMFKNQRQMVTGILVNEGLNLPKKQIDALRATLYNLEHEHNSVEDSVIEFWGLKNKQPYDSFIPVGFYNGGYRGRFIKSNKKGVKAHKPTSKKEFDKIYALHLLGRILWYGQVVTTTIDAPYDLSKRQYISPKQFSRINKYEEMLASFYRISIKFSWPVQHIILRLANKLPHLQSLVKMKSISELDPTILDEVGIELHGQVLKLRTEKEKYTEFFNSAPLSLQRVLRVHNQSHINFDLDIIKKCISSGWEEPFKQQKVFKEINNADLSDLFHKSSNRKGHNAKKLLNEIVRVVQPQTRYLSDNVRIKITKVYSELLTLIRLEGDSVCIDLENENTKTEQALQAIRDLKSEIRLYDNHTDNFYQRVVLPAVKNSETSSLVAIDKKDMNPSIVTDINAWRVALTKVLISIKQHCDKTELMEDTSSHRPFTITFRDDNPVTGAPRVIEIHRLNLDLPFKKKLEVDTTMVEGKVMRWLTNGDLSSAVREFLPIGDIFVHGNFKDCENATVNLTEHFYKINDELKVSDYGKLFFSLQEIKE

SEQ ID NO: 1589 - protein, 807 aa, unidentified
  source 1..807: note = Related to NZ_UGYP01000001.1; note = Shewanella putrefaciens
MAQLFNMQNIQAGSSKPKNTNFSSFLKLFEHWLKTRPEFDIKTLKERKCWPITAGHYHRFSIKKRNGSKRELVSVDKNLKEMQSNLATYFEKTFEISKYAYAFVPKESEKKATIKQQETLLLDKLRPKGVVSNALAHQNKKVVISIDLKDFFPTITFPRIMGMLKTTPYDFSNKQSAVLASLICLPKDIDEKRGLPQGAPTSPIISNLICKKLDYQLAKMARKYDITYTRYADDLTFSTNNLKRISAEEIVSSVTQYVERNGFKVNETKTKIMFKNQRQMVTSILVNEGLNLPKKQIDALRATLHNLEHEYNSVEEAVNEFWSLKNKQPFDSFIPVAFYPGGYRGRFIKSNKKGLKANKPTPKKEFDKIYALHLLGRILWYGQVVSTTISVPYDLSKRQYISPKQYSRIKKYEQMLASFYRISIKFNWSVEHIVFRLANKLPHLQSLIKVKSKSELDPTILDKIGKELQGKVSRLRSEKEEYTEFFNSAPRSLQRVLRVQNQSHISFDLDTLKKCVEFGWNEPLKQKKLFKEINTSMLSDLFHKSSNGKGHNAEKLLNEIVRVVKPQVRYLSDNVRVKLTKVHSELLTLVQLEGKNVCIDLENENIKTEKALQAIRDFKSEVRLYDNDTDNFYQKVVLPAVKSSETSGLVTIDKKDMDPSIVTDINAWREALTKVLISIKQHCDKTELMEDASSHMPFTIKFRDENPVNGAPRTVEIYRLNSKLPFKKKLEVDTAIVEGKVMRWLFNGDLSSAVREFLPVGDIFVHGKFKDCEDVTVNLTEHFYKVDKTLKVNPYGKLFFTLQEMKE

SEQ ID NO: 1590 - protein, 791 aa, unidentified
  source 1..791: note = Related to PYMW01000008.1; note = Photobacterium phosphoreum
MNNKRTAKNNNFLAYWLGIKSPELDIKVLKNIKCWPITANHYNRFTIKKRNGSKRELVSVNKSLKTVQSDLAEYFAVTYGISKYAHAFISKEPETLSVFSQEAILVDKLRPKGIVSNALPHTNKRVVISLDLKDFFPTITFPRVMGMLKGEPYNFSNKQAAVISSLICLPKDIDENQGLPQGAPTSPVISNLICNKLDYQLGKMSKKYDITYTRYADDLTFSTNNLKRISAEEIVSLATQYVDRNGFKVNEAKTKIMFKNQRQMVTSILVNEGLNLPKKQVDALRATLYNLENTYNNVEDAVDKFWNMKNKKAYDSLVPVGFYKGGYRGRFIKSKNKGLKGNKPVSKKEFDKIYALHLLGRILWYGQITTTAINTPYDLSKRQYISPKQHSRINKYEEMLAAFYRISMKFNWSVEHIVLRLANKLPHLQSLVKMNPNFLLEHILLDDLELELRDKVSKLRIEKEKYTEFFDSAPRSLQRVLRVFNRSHNSFALNKIKSCVESGWPVPLKQQILFEKLATEELSDLFHKSTNIKGHNVKTLLEDIVKVVRPELIYLSDNVRVKITRVHRELLSLMRTEGDGVCIDFENETAKTEQAVQAIRDLKSEVRLYESDIDNFYLKIVLPAVKNSRTLNIVDIDKDDMNPSIVTDIYAWREALTKVLISIKQHIDKSESIGNSSGKKPFLIKLRDEHPTSSLPRAIEIYRRDVELPFNKKLDIDVNSAEGKVMKWLTGGDLSSAVKAFLPIGDIFVHGNFKDCENVTVNLTEHFYKVEDNLEISGNGKLFFSLQEIKE

SEQ ID NO: 1591 - protein, 791 aa, unidentified
  source 1..791: note = Related to NQLU01000007.1; note = Photobacterium phosphoreum
MNNKRNVKNINFFSFWLGIKDPEFDIKKLKDIKCWPITKNHYNPFTIKKRNGSKRNLVSVNKNLKTVQSDLAEYFTKNYKSSKYAHAFICKEPESLSILKQEALLIDKLRPKGIISNALAHTNKQVVISLDLKDFFPSITFPRVMGMLKGQPYNFSNKQAAIIASLICLPKGIDENQGLPQGAPTSPVISNLICNKLDYQLGKMSKKYDITYTRYADDLTFSTNNLKRISADKIVSLATQYVDRNGFKINEAKTKIMYKNQCQMVTGILVNEGLNLPKKQNDALRATLYNLENKNNKVEEAVAKFWGIKSKQAYDSLVPVGFYKWGYRGRFIKSKNKGLKTTKPALKNEFDKIYALHLLGRILWYGQVATTGINTPYDLSKKQYISPKQHSRINKYEEMLAAFYRISMKFNWSVEHIVLRLANKLPHLQSLVKMNPNFSLEHILLDKLELDLRDKVSKLRNEKEKYTEFFFSAPRSLQRVLKVSNRSHHNFTLIKIKSYVESGWPVPLKQKAVFDEIATGDLSNLFHKSTNINGHSVKNLLKDIVRIVRPELIYLSDNFRTKITRVHRELLNLMRTEGDGVYIDIENVTPKTEQAVQAIVDLKSDIRLFENDIDNFYLKIVLPAVKNSGTLNMVDIDKDDMNPNIVTDIYAWREALTKVLISIKQHSDKSESIGNIQGKRPFIIKFIDENPVNGSPRAIEIYRRNIQLPFNKKLEIDINSSEGKVDKWLTGGDLSFAVKEFLPIGDIFAHGNFNDCNNATVNLTENLYKIDGKLKLNDSGKLFFSLQEIKE

SEQ ID NO: 1592 - protein, 796 aa, unidentified
  source 1..796: note = Related to NZ_CP068228.1; note = Shewanella algae
MKTTPILSSKVDSDDKFPFFSILESWGVNSPEFDTVVLKKLKCWPVSKKHYKPFTIEKRNGTERHLVAVDKNLKLMQQRLAVYFERAYPVSKYAHAFIPKRSKFAYELNSSPQIRPTGVITNALAHTNKKVVISIDIKDFFPNITFPRVLGLLKSKPYDLSNRQAAILASLICLPKGIDENRGLPQGAPTSPIISNLLCKKLDNQLGAFSKKNGITYTRYADDLTFSTNNLKHISTSKIVEHVTNFVERNGFNINTLKTKVMYKNQRQMVTGIVVNDGLNLPKKQVDAIRATLHNLEHNYKSVSEAVYDFWLVKGKNAYDQFVPLDFYPGGYKGRYIKSKNNGEKRNKPTSDIEFNKIYALHILGRILWYGQVVTTAVNEPYDLSKRKYISPKQHLRINKYEEMLATFYRISMKFNWPIEHIILRLANKFPNLQSLVKMNPMFLLEPVTLDANELAIKDKVNSLRSDKLEYTAFFESAPDSLKRVLRVENRSHTNFDLKNIKQCVEYGWETPTKLREVFNEFDNGKLADLFHKSSDRKGHKVVDLLKELVSFVKPRIRYFPARVKRKIIVVQKELLHLIRAEGEEVYIDLENETTVTKKASQAIRDLKFAIRLYDSDTDNLYNRVVLEAIKSSDTLELINIDKDNMNPRIYTDIDAWRESLTKVLISIKQHTHDDERVIDQKQLKPFTICFREENPLTGSPIAIEIYKANSKIPFKKKLNISEKSNSGLVNKWITGGDLQRAVRDFMPVGDIFVHGDFIDCKNITVNLTEHSYKKEKTVYHNKYGTLFISLQELRA

SEQ ID NO: 1593 - protein, 802 aa, unidentified
  source 1..802: note = Related to JABXHM010000094.1; note = Alteromonadaceae bacterium
MKKNNQKKVKEESATDFFDFIKDLLARRPEFDTKKLADKGCWPISKSHYHHFSIKKRNGSYRQLVTVDYRLKEFQSNLRRYFEKYFTISKHAHGFVSTSTSQVGATDLEKEFLSELNRPKGVVTNALAHTGKKVVISIDLKDFFPSITFPRVLGMLRKSPYDLSNKQAAVIASLVCLPKDMDEDRGLPQGAPTSPIISNLICNKLDYQLGRFAKKYDLKYTRYADDLTLSTNNLKRITPKKIIDEVTRHVERNGFQINDAKTKVMYQNSRQMVTGILVNDGLNLHKKHVDALRATLHNLENKYDSVERAINEFWTLKDKQPFDAFVPLGYYNSGIRGRYISSSKKGIKRPMPITKQEMHKIYALHLLGRILWYGQVVTTAVQSPYDLYKRPHISPKQYSRIKNYEEMLASFYRVSIKFKWPVEHIILRLSNRFKHLQSLVAMQPNLLVEPIVLNDAEQKLKVDVLKLRKKEDYLEFFRTSPESLKRAIWSISSSPSNHSLEDIKQYVNHGWPVPEIQREVFKQLDTGTLSNLFHKSYESGGHSVNELLEEIVKVVKTRLRYLSPVVRRKILSVHKELLAIFRLEGNDVRIDLEKKVKSHESALQAIRDLKAAVRLYEDDTENFYNKIVLPAVKESGMSNFVKIDNNDMEVRLITDIAAWKNALIKVLDSVKEHMESSERVRKASEQFPFTLKFREANPETEEPMALELYRTNAEIGFKKIPDLETNKSHGLVKKRLTGGDLSLAVKEFLPIGDIYVLGKFERKGECIKDISINLTDFSFVKCKSVKHSKYGQLMFSLVEKES

SEQ ID NO: 1594 - protein, 726 aa, unidentified
  source 1..726: note = Related to JACGVB010000087.1; note = Colwellia sp.
MVSVDSKLKSIQTSIKEELEEKYPTSKFAHAFISNNLDTLDDIVRPKGVISNALAHTNKKVVISIDLKDFFPTISFPRVLGMFKQQPYFFSNKQASILASLVCLPKGVDANRGLPQGAPSSPLISNLICNKIDKQLGQLAKKLDCIYTRYADDITFSTNNINRVKPSALVNEIRKHVVRNGFEVNEEKTKIMFSNQRQMVTGIVVNDGLNLHKRHVDALRATLYNLEFKYKTTSQGIKAFWKLGSLRSFDSLVPVGFIKGETPIRFVKSASKEDGKKRLIKTTGKYQVKTYALHILGRILWYGQVVTTAISDPYSLSKNSYISPKQERRIKKFEEMLAAYYRIADKLNWPVKHIILRLANKYPHLQSLIHFDPRYTLKNIALLVAESDLITKVNKLGKDNQEYLDFYKESPETFQRHLLLRSRFKQSFKIHDIRTLAENGWVDPKLQNELFEELNTRKLADLFHKSDDGKGHKVEEILLELVKVVAPKLRYLSSNVRTKVLQVHKEFVGLIGAEGKDVKLDLEIETDLTKSAIQAIRDLKNATRLYEHNNDTFYSRIVLPSINDSDTTKLVDINTSGMAPRLITEIGAWKKALTKVLQSIKESASKVNLDSKQKPFKIKFKDANPVTGEPVTLEIFKVGHDNPFGKNLNLPENSSSGFIQKNLLGRDLTNAIEQFLPVGDIYVQGNFKDVDNAKINLTRHKFERIEEMSKDNKESLFFVLKEYQSK

SEQ ID NO: 1595 - protein, 898 aa, unidentified
  source 1..898: note = Related to JAIPFF010000020.1; note = Thiohalocapsa sp.
MSDTTEPKEPAALTLAALIDRDEQSAAGDEQRKIDSRRDLARYIGIPLRHLADVLYEADRSRFYTVKTIPKASGGTRTLHAVSGKLKDVQRKALDKLQRKFPPSDRAHGFVPGRSIITNAIPHRRKKLVVKLDIVDFFPSIRVARVFGMFQAPPFRFGREAAMTLAQLACVPEHNGPLPQGGVLSPYVANVICRRMDQRLASIARQHRCNFTRYADDLTFSTNDANRLDADRLIAKVREVVEGEGFAINDAKTRVLRQSDRQIVTGIVVNDGLNVTRRYLRSLRAILHNMEKEGIEAQLIKGSGLKDRRASRLELVPDGDGYRLGNHKLTKEQAVERFLQHLVGRFAFVGQVVNAEGQDNQQIRYRRVVLYKRLLNRFRRSVRSAVHAGLGDGPKHCERAIRSLMERYASVEQESEWYRRAKERRESELERWRESKEGRRISAALARTTNASELCRFVQKEAKSDVRYWPVNCGDNPEALRVRVEENARYPSLNRGTTRQVVNGFKDTSDLGGLTHRGDATPASLLQILLDRYEPHYYELPNALRKLVDPMSAALRDIVLQDGEDVSLDLFKDPRLDRHVKQLKEGTRLIAPGSKKDEGKPITELLTDAYEKGLERAEKKPGTSVPWKDRFISPHQAIYTVVPALWISLVDIFHSIGIHSEHREIEVETYITEQGCFQIRISDANSSGLEIPPARDFAHGKIRHAAFELFAIAGYWIFTRFEDGAVHRVDMLTGKTARATDARYPGFTHLIVLPNEKGFIEEPSVGDAATGSDSAATPRRTVRVLIIDNNEQRRNDNVQCWSSLPDVELDAVAQIDRESYRCRELDLVLVHESNPESEWIHQDVEDRWPVVFFSGNNTLDCEVHEGRWFVSPVFLREHFGKLVDKIVHEGGKDCVGLS

SEQ ID NO: 1596 - protein, 877 aa, unidentified
  source 1..877: note = Related to NZ_WNKT01000028.1; note = Allochromatium sp.
MEKMTTRTKIYWRRDLAQYIGVPLQDLLEILYKENRRDYYRIRSIPKASGGTRTIHAVSGKLKDIQRKVLDKLQADFPPSSRAHGFVPKRSIITNAIPHRRKKVLVKLDIRDFFPSIRFARVMGLFQSAPFHFGREAAITLAQIICVPGDNGPLPQGGVLSPYVANVICRRLDQKLAAIAREHRCHFTRYADDLTFSTNDVKCLNREQFIARVEAAVANEGFTINSKKTRVLRQSDRQIVTGIVVNDGLNVTRKYIRNLRAILHNIEKNGLETQLIKDGGFHDRRASRLELKRDGDGYRLGTRQLTKEESIERFLQHLVGRFAFVGQVVNAEGQENRQIRYRRVVLYKRLLKRFYICICRIEKNENLGKGPEKCKSTLEKLMKKYSSFDQQSEWYNRAKECRQSKLEQWQNSKEAQTIRDELACITTLEDARRFLTAQACSDVRYWIECSGNFEDIKIKLAKFAQYPAFNFFDTRQVLHGFKDTQDLGALTHHGSTPAHLLNILLKRYEPHYYKLPDYEPPYSLRGLVDPMSDALRNIVLEDGEDVFLDFNDPRIESKVAKLKQGTRLSARQGQAHIGTMIEEMLQSAYEEGLKRANQTPKKSVPWKGRLQNPREDIYTVIPALQGSLVDIFESMYRNRKSGQIEVETSVTESGCFQIRIADVDGASLRVPPGRDFAHGKLRRATRSLFVIAGYWIFARFNDGSVHRVNMLTGETVKVADDRYSGFTHVLVLPNNEGRIDPPSVGKSSLDVSVAKTSRRTLRVLVIDNNDQERYDNELRWQTLPDLELKTVAAIDRETCASYAPDIVFVHFNNDERKWITQENTNLCPIVLFSGEFMSECMIHEGCWCVSRTFLKERFGDLIDQIVRKERKDCVGLS

SEQ ID NO: 1597 - protein, 881 aa, unidentified
  source 1..881: note = Related to NZ_NRRY01000013.1; note = Lamprobacter modestohalophilus
MEFTTTPSSLNSRKDLADYIGLPLGELNNILYAGNRSRFYKVKMIPKASGGERKLHAISGELKSLQRMALDKLQTDYPPSPRAHGFVPERSIITNARHHTNKKLVIKLDLLDFFPTIHYGRVVGMFQKPPFSFGYEVAKTLAQISCLSQEEAGILPQGGAMGPYIANVICRRMDKRLASVARNHRCNFTRYADDLTFSTNDVRRLEIPQLITEVSGIVESEGFKVNSEKTRVLRPSDRQIVTGIVVNDGLNVPRKYINSLRAILHNMEKEGIEKQLVKGKLFGANNPKISRLEFELVGEGYRLGSRAYSKDEAVDLFLRHLLGRFAFVGQVVNANGQQERQIKFKRVILYKRLLKRFHSCVIDPRNNGLGNGPKKCARAIVRMMKQYSSFDQESKWDRRIKEVRKSKLESWQQSGDGRKVCKALDRINNLSDLKVFLENESKRDIRYWWVCGRDFVTDKEQALKYASYPPVDYRWTRQVLCGIKNTQGKNLGILTHYGDDGHANTPAKLLEVLAENYEPYYYWLPIRLRKIIDPVSDALRNIVLQDGENASLDNFGDIRLEPVIKTFKLETRLSNSDRAADGTYIFQLLKDAHEAGQRQANRKEIKSLSLVMHQKMPSKQYTVVPSLRIALIDIFHSMYVNSESDGISVDTRITHRRCFQIRVTGPLHHPLLCRPSRNFAHGKLSRAARELFGIAGYWICSTFEDGREYRIDMLTGKAALISNEHKLSFSHIIVFPNDNDEIDESIHGVEVIDSVPENAPQQKIRVLLIDNNDRRRDENVKRWRALKNVDIKAVARIDRASYEKLDLDLVLIHESNPEVETNELVFDDQTRIIVFSSGNKTEDCVTDEGLFYVSSIFLQKNLAKLIDKIVVEGQKDCVDLS

SEQ ID NO: 1598 - protein, 634 aa, unidentified
  source 1..634: note = Related to JABJEJ010000239.1; note = Deltaproteobacteria bacterium
MEIPLKRLTYCLYKTSRESAYTRKDLPKSNGGVRTIHAVSGPIKGLQRTALDKLQEDFKPTAYAHGFTPEKSILTNAYVHQGSKIILRIDLKDFFPSINFGRVRGMFMSPPFKFGEQAATAMAQMSCLAGSEDVLPQGGVLSPYIANMLCRRLDARLAGLSRTWKCRFTRYADDCVFSTNDTKRLNAEKFVAQVEEIIREEGFQINPDKTRVMYPHERQMVTGVVVNDGININRRYYRSLRALLHNWKKYGISSQLVKSGGFKDERNPGPRFERDGDIFRLNGWEFSKEQAEEKFARHVLGRILFLLQATNFVPPSTEGYLEGEKDETAKKMVAKRKEALAEKPRSQAAQKLLLKYFHLVSKRKHLDDLKNAAYRQLQRYPIRELVARHPHLKIELRSGISRYQIRAQALQEYQKRPETRKCVERIHECDDLAEAGGLLDELANTDVRFAGLPRGDLRVLLKEMTKFASYPAFGANHARSFFASLRDSETGLGQILHHPEHSMSDLNESMGKFVDPVFWWLPFGLREDIDKIDDLLEGVSRQLGDDAKIDWLAHELTEKETLKLKKDTRFHRKEGTRLHEAVNEVVKRVAKTYDRELPEICNELSDKSTAYTHVRSVRLALDEIILSMITHSDK

SEQ ID NO: 1599 - protein, 916 aa, unidentified
  source 1..916: note = Gammaproteobacteria bacterium; note = Related to QNFE01000008.1
MPKIFLKKHQTEYIIKNRATNRKSIVAIMAGKKMKNMLSGDKIKKAYKKFTIAKAKKGTRTLHAPSTELKDLQRTILDKLQKPFRPSIYAHGFVKSTSNKARSIITNASYHKSKKYIIKTDIKNFFPSIKKEQITQMLVNEPFEFTIKTAEKISSLACLDGKKKVLPQGGVLSPYLSNMLCCNLDDKLSGLATKNHCNFTRYADDITFSTNDKKIKFKPLIQQIYKIVESYGFVVNRGKTKVLTPADRQVVTGIITNDGINVNRKYYRNLRAIIHNCEDESLNIFNIDTIAGQIGRFIKYKIQKRNKNNAIELKYSWSFKDSRCSRPNIFSDSVMRSEYILLNKKVGVQDVKLMRDYGGVNLQVPFLKGEFLNQLFGTDKFKNNEKYAMRLYKYNSDIESLSTGRLYLKNKKYAEILLDGKWIGCEKYTEKNPKIYNILENKFKVLQEKHKDNDRFFYKSVIYNKGFEEKEYMLENFALTKINTQQQTIQYENYNKVDKNHTGDYHIAVKKNYAVHSFFKHLLGRFVFYGSVVLSNNQDKNYDRYKRVGAYEKLLYRFYKLVEKHCNKSLQKQTLNLIKKTPKLKDDFNVLKKMTDDYKKQKEKSLEKFHYDSKYATEIDNTESIEALDDIAKKLSKKDVRFFRIDKYHKDEPKDYQNYLMAILKKPAIDLKKTMGVLLSFKGSQDGLGVITHDTEKLNSKQIFETVNKCFTQYYYYLPQGIREEFDNYIDALNNQDGRQSQRFQSQAEKLKKNTRFGNNSDEEFLLKDSVDEAILNAKKEVKKSDIKIHNEIKRASFYTHVPTIKQVFEKIIHSLYKNSKGSEITISCDHKDDEKKYQVIITDNSDANITNNGREFVNGKLSSVMGLTFGLCDYFIETEFNKKRKTINMHNGEFLKTLPTHKKGFTHILQFATKI

SEQ ID NO: 1600 - protein, 490 aa, unidentified
  source 1..490: note = Candidatus Woesearchaeota archaeon; note = Related to JABHVJ010000179.1
MTNDIIQEILRKRKINRSTPLMQKINNKKDLLSFFGDEIGQENFDNVLYGEEKEQYKKFVINKATGKPRTLHAVPPKLKHIQRIALDKLQSVKQYQPSSYAHGFVLKRSIITNAIPHRRKKRIIKMDLKDFFPSIHEDRVRDMFMGKPFSFGKEAATIMAHLSCLNDGSGILPQGGVLSPYVANMLCLKLDKKLAKVAIKNHCNFTRYADDITFSTNDVSEDSISNLIKETSNIIESEGFVVNTEKTKVLTPNRRQVVTGIIVNDGVNVNRRYIRNLRAAIKNCEEQGIGSQMQRFVFKDHRCSGPDKFDGTNGEIRNYFLHHLFGKITFFGNVVLSNNQDLKNKKNSDTYRRVQTYEEILYRFYDLIKNVKTSRRFKKSVVAAVNNRPNLSKRLSFAQQGVSIRGKALKKYRSTYKAKKLKDDLELVTNINQLRSFIGDVAETNPSFFNTAIPVDLDEAKEKLGTRLSFPPVNLDIATGVLQSLVEDEG

SEQ ID NO: 1601 - protein, 830 aa, unidentified
  source 1..830: note = Related to JABHPQ010000081.1; note = Candidatus Marinimicrobia bacterium
MPKESKNNKMTVSSRSDLADFFGVKNKYINWVLYADKSASGYKKFTINKASGKIRTLHAVTKKLKKLQRIALDHLQADKRFQPTAYSHGFTQQKSIITNAAYHKRSKRIIKMDIKDFFPTIHFGRVQGMFMAPPFKFGKEAATVMAQMSCLDDGSGALPQGGVLSPYIANMMCRRMDKRLAAVARNHSCRFTRYADDLTFSTNCISDENIGKLVQEASAIVEAEHFIVNKEKTKVLTPKDRQVVTGIVVNDGLNVNRKYIRNLRAIIRNCEQFGIKSQIVKLGGFKDNRNSRISIKGEENLSEERFLRHILGKLNFMGDVVFANLNDKDGKKIDDNSVNMNRMVRIKTHADLLTRFYKLVANESGVDGVYDKIEISIVNNGKKNPYCKIMDLISEINNQARKYLDEFERLEGVTRIVDEKKYPLVDKKQTRVFLDSFRNSINGMGAFTHAHGEEFTIHKAMGILLKKCHPAIYYLPEAFKKEIYSYIHYITNIGIKNGANYSWNVMSDTKSVALKRATRFDSMENSLSSTVDSCIRYVKKQNNISSDLNVINCIKNNQLLQIYTFVPGIESALNNIIHSMLKNTEAQINKYILIDVNQATDLIEIIVRSEDIMISSFVPEDKHGKLTLATKSTKGLCDYWVEVDSVSLDLTNKRVCFDMHTGKIIDGIIPSFSSGFVHKLRFDTADKIRDTDVENREISAITPIENKIDYLYKVLLLDHNIDDRREIKRNLLEIDGVSEQSLTILKNISQVDFESMKLDIAFIHKNNKETSNIALWETSGIKVIFFSGEIRQNSTINAEKSQFMVKEETMKSAARLKSYFEKKLSGKITT

SEQ ID NO: 1602 - protein, 730 aa, unidentified
  source 1..730: note = Bacteroidetes bacterium; note = Related to JABHLS010000018.1
MEIIFGSKTPGPTTVLAKQIGFPANKLRDILYGPNNRSAHYKRIAIPKNSSTPANPKIRVLHAVSKDLKNLQRATYDYLAAIYSPTKYAKGFVIGESILTNAWPHRRQAVLLKFDIKDFFPSINFYRVRGMFMAWPFNFSPATATIYAQICCMDNGPIAQGAVTSPYISNMICRRLDKRLSQFAQKHHLVFTRYADDITLSSNSKHLAIKKVQQEVVEMIESEKFIVNKEKSKVLFPSQRQMVTGIVVNDGVNVPRKYIKQVRAILYKCETLGVARVVSEHLTHVKPGQPCAPIHRELKPTGEYLDVDVPINRDVYMRNGTDKEISFYQVTLIFLSHLRGRILYIGQVAKANHESIWEVSYASANSPRGYPERTVYLKRYKIYRELLDRYNSIVNFEDYGKELSIKVKSLESRYMEEEEIDFFMARDIEQIKSDMSERAETEARFFYSISPAMLENDIKDKLLIMLNRFPPDIITTRAVLQSAQDTGSMIMRLLHNEVIQREEFDDYFNEYLTVKEKLPYRLEKEITAFLKEASYLFRRENIDEYNFYLDEQFNRDRVIPFKNNSRFVLNPRKTSGGTDAYEMIKGIVHSRAVRDKMNENSVRIMIPEDQNEWRIDLYTHVSSVKWSLHRIIESMVVNSQDTIIHITFEFQREGFSTLRVYNEDVTEIANTPSRALAHGKLKKAMEYLDGLAEYYIEANFAGTGWSSVNMYTNQSQEIESLIGFTHRIVF

SEQ ID NO: 1603 - protein, 679 aa, unidentified
  source 1..679: note = Candidatus Marinimicrobia bacterium; note = Related to JABGYV010000129.1
MKAHIFEVAQELNVKPGVIRTALYVGNRGDYYTLNEIPKRNGGVRTIHAVNGRLRVLQKVAYNWLSNNYSPRHEAKGFVIGGGIIENAKIHRNKKLVICYDLKDFFPSITFARVQGMFMSFPFEFAKPKATLFAQICCLPDENGPIPQGGVTSPFVSNMICRRLDTRLHKLAIKKRMHYSRYADDLTFSTDDNVGYEKFTKIVREIIEDEHFELNEEKSRIRTKSTRQVVTGIVVNEGLNVNRKYIRSLRAALHNCYVHGVLSQIDKKTKYKDPWNTCPPIKKIANKNYVLYKNGASIEIKDAKYKFLEHLFGRIQFIGHVAKSNEHLNPVHHNKRVEIYNNLLEMFEKVRENEKITGKLKIQAKKALYQQQDNALLESIKRYTLDELNEFVDEQKQTDPRYFTYSFSEGDIMEYRDEVGNLAQYPSPTNEMVMQYLNSLKDSENKILGKLVHDTTISFGEFNNFRMQFEKDKIELPKLLRDRLDGFINTDIMNFIKDKDVNFNIFSDITFVEKSINKLKKATRFFNGTGNIGDDETDLVKMIESVFKNARNPNNLNLKIDRLNTFGAYTDVQSVKYALSLIIDSMIDNSNGSTVFCKTDKQNKVIELFDDNSEPLDILPNRDFVNGKLRKTIFTLTALCEYSIIANFKKGGWKNINMMKGEVIESEEYPGFTHQLTFR

SEQ ID NO: 1604 - protein, 382 aa, unidentified
  source 1..382: note = Related to PDTW01000019.1; note = Candidatus Gracilibacteria bacterium
MKDLNLNLITIIIIFIVIIITIFKGKLSVFNKKKRNFNLKFLNKIPILNPDYNTFYIPKRDGSERQIDAPNTQLKNIQKNILRELNKTYLFPSFVSGFKKNASIKNNASKHTNKKIIINIDIEDFFHSITENKIRKTLRAYKELQNEEIEKLINLVTYRGRLAQGAPTSPFIANLVFLGIDNIIIKLLKKYDKKVSYTRYADDITFSSNNTKIKNAIRIIVDSILPKYGYVAKKKKTTIYRAHTKQIVTGLVVNKRVSYPRNKYMKLRAMVFNFLSKGDGNINIIKGHLSFLKSVDRKKYLKLKFYYRRNFKENNNYKVLFNKQKKKHKKASFTNPHTGKREVKFDYSGKKIEKNDYKYESAFENIKKSKKNNDDDKNDLII

SEQ ID NO: 1605 - protein, 341 aa, unidentified
  source 1..341: note = Related to AMFJ01000004.1; note = bacterium (gcode 4)
MLITIIVIISIIVFFITSKIWIGAKKKWIMKMSDLFKRVLEFDAPDLSYTTFTIPKKDWTSRQIEAPNAQLKKTQQTLLHLLSNNIILPWYVTGFRKKFSIKTNAKKHVGREVVINLDIKDFFTNVTTQKLRQRLEYLKVDNEIISRFEKLCFNNWHLPQWAPTSPFLANFIFVPIDEAIIKTAKKYDKNIIYSRYADNITLSSNVKNISNLIRIISEWIMPKFGYTINSKVNLSRKHTRQTVTWITVNEKISMPRHKYMLLRAQVHAYLTKWTWNTLEIAWRLAFLYLLDKKKYWKLQKYYKKKFWETQELSAVFRRNPKKVKLDIYKKWFINPRTWQKF

SEQ ID NO: 1606 - protein, 445 aa, unidentified
  source 1..445: note = Related to NZ_QEKT01000010.1; note = Convivina intestini
MKKDFTNISTYQEFIEYIKSFSEYQYLTRTLSKDFLQRINETQNMGDFYTTKMISKKAGGNRELAIPIEELKHLQKALLGVLKKYQRLSIRKSKWSSNYDYISPAFKSIKIGSHNKFYVNKLDLKNRHTKGIPSHVVHASHHTNKKLVITFDFENFFTTIRPNRIRGIFKGYFKFSDFVCTLLTSITTHFKVGLPQGAPTSPYLSNLATYEFDKAFHKECKKLGIYYSRYADDVALSTNNYSVLYNNSIFSEKPKNGKRLQFCDYLNNLLEQNHLTIKGSKTRVMSYWNRQVVTGIVVNKKISIGKDELVRARSVLINIGKTLTILDYRMGIIAVDKQIKKFYDEYQLRNSHEEELQTIRDDNERSLCMLCIALLTIHSLIEYYSQVMPTNSKLIKIKELYNSIQYNLFYNKNYRHIIIKNNHLFKFNLHSFPIFLIEKLNFQSH

SEQ ID NO: 1607 - protein, 320 aa, unidentified
  source 1..320: note = Related to JAFRDY010000085.1; note = Leuconostoc mesenteroides
MSKLSSINNVASLVKVINHKLYIKKYEPITIDFLKKNIHKYVDRNIPKKRGGFRTLNIPNDQLLHVQEILLELFYESQDRIVRENKWISQIDRSAPAYKPSNYYLNKPAHWIHAQNHVNKAIIVSFDFHDFFGSLYSGRIYSVFIKYFKCNKAVATILTNLTTFNHSLPQGAPTSPFLSNLVMYYFDKTMIKISRENSVRYSRYADDVILSSNDSQFLDNTNFFEKSFNNGQNIEFSEQISKLLLGYHLSLNPNKTRVYNYWNQQKITGIVVNHHTNISRRKLVVHRSILINLIKAIDTKDFDNIKGYEQLKININKALS

SEQ ID NO: 1608 - protein, 837 aa, unidentified
  source 1..837: note = Related to JADJNF010000001.1; note = Saprospiraceae bacterium
MNLFKITSSEFLNFIFANLESSKGIDKDFITLVKNIINYQYKFYQIFLIRKANGKLRPIAAPYPELKSIQKSIVKYLDLNFIPHPNSFGFQKNKDIKGNAKMHLNNKFVFNADIKDFFVSIKFSHFRKKMLPNENIFSDDSNPLSILRVFCFISDAENKQLSKEDTHYFLPQGAPTSPILSNIYFYDLDEKIFDLCKQLNINYSRYVDDLTFSSNENYFENNSDFRNKLVSILNSDGLSLNESKNKLYYKYNTQIVTGLIVNQKLNVHQRVIKDLRKWIYIYERYGIEKLNLIFENDYHSKNRNSRNFKINTFSALESKVAYVGYIKGYRDSTYLILKEKIGNILKHKVIESNEEKSLIILDSSFFIHGKKSYRLKFYDGLNIPIDEITVTKNYFKKNKWKFKKILSDWGISNQSVYFRIVINNPINIDLNTALVVKKGDTIYYEYEDTEFNNSSKRTDDNFEIQVVAYNITDENGYITIVSIDTPNAIKSVVATIPTVNVNQTSEQQKHLKDLRARFLKDKTFIPVKVSNTSSITDYRYGLFSEEKSTHRQVTEEDLLNPKAIVGILSTPWNSEKGEQATVFIKKEQVQLPYPAPIAQTGSVVLLIDNQIHVLHTKKIKDVPVKYKQLTKLLKQFASEANADVRNGIWKQLIGRGSTDGIVIYRTENSNIDVERQGEVVNNRGIGPQLFYNPDTNTIIYEGKRYNVNEENINDIIDDLAERRVHIEEALVETSKDYKKDIVEYLTTDLAELNTKTGTYQIAPTIYTEIGNVEVQDNTKTEVKLTPQEEQAALFDFLPSVAKETKEVVNPKTEEASETTIAKRILPKADGEDMSDIL

SEQ ID NO: 1609 - protein, 422 aa, unidentified
  source 1..422: note = Related to JACSSC010000036.1; note = Candidatus Competibacteraceae bacterium
MKNLMIKDKENILIQPGIFFYTHGYYSATHALDFIHSADSYKKISIPKRNGKIRTVYQPHPKLHAMQSTIKPFLHKVYFKICQKHGMISYEKRSHMSKQAWNRHIELRRRFPTIEDFADHIDELFDEYSDEADKRYGKENPNDKLHMSSMLLDFDYDFFCYKGIDPELSYKKTFKYYGSVVQHARNAVRKPYLFKCDIKDFYPSITDKKLYRILSSEPYNTYISPEIAALIVSVCTHRSRLVQGACTSPILANMFMIHADNFFSKNLKKSCTYNRYSRYVDDLIFASDQPIDAAEISKQISGYLSSMGLQLHPKKTRYLLPHQKKIVTGVVVNQKINIDRRYIRCIRAMLHDAEAQGIEHAALRHASGKHGKIEAIDPQYFLKRLQGMISWVQYVRSPHENNCQQLINRFNNLQKKWEQSKY

SEQ ID NO: 1610 - protein, 544 aa, unidentified
  source 1..544: note = Related to JAEINT010000042.1; note = Labilibaculum sp.
MKKERINTVNDWNKLNKLSGNKEILSHLYKILSRFADTLKNEIIAEIEKKNKPKAEQIKLSKWSISIDRLLYLSGQDNLKKQYHKVEIPKKRGGVRILNIPSKKLRFVQRLLLDFLSENFETHKCAYGFVKGKSIVDNAKLHVNKKHVVCYDIKDFFPSITGRRIYGMLQQYPFNANKDVARIIANIATYYDDEKSEKILPQGSPTSPYLANMICRKMDSRIFNFFKEKNIHYTRYADDLTFSTNDSKKIELILKNVPRFIKEEGFELNNSKTRVQNYYKRQIVTGIIVNKKISLPREYIRGLRALLHNVEKYGWESQVNRKIISFESDDYLKFINFQKETNNEEENKKLQKLTKSKFDEYNKTQNNEHKLIHGKNYIDLRLKSQKYPSQRYTQVDMMKEIIKGKIEFWGMVRNIRDKEGKIIKTDNTYKNLKDEFELLNLMQRKEDVQYIKVSRKFENIIKSYENNKSIDEKTKKEIIDNINSLKKLKNENLSEIVKNMVSPILHNPKRTSEILIKFHKDDNVLKYTNHDWDKEDDNMKFLTN

SEQ ID NO: 1611 - protein, 716 aa, unidentified
  source 1..716: note = Rhodothermaceae bacterium RA; note = Related to CP020382.1
MRLPDWDKATVKAYETRWSALKASGPTDVYSAVATLLSTQSDNPVPEDLIRHLVGSKNRKRHYHTVEIPKRRGGVRTLTVPSDTMKWVQRGLLQVLTHLFPRHRCAVGFERGESPLTHARHHVRKRFVYVVDIEDFFPSITWARIYGMLQAYPFELPPHAARVLANLATYDGALPQGAPSSPILANLLCRKLDSRLFKWARTNGYQYSRYADDLAFSTNKNEFPVSDRKFIEQVIQEEGFSINAEKSRLMPYSRRQMVTGLIVNKKPNLPRSYVRGLRALLHNVERHGWESQVGRTPVFKRAYEWTLYRDKKMSPEKLLGIQLDQIFYDHLVHPTAVLHKARDVASLQRVVQGRIAYLGLVRGKDCPIYQRMRDQYLALVRQESEMARGRAIYQEKAREVESTPDEPKGPNRYAEIKKYEQLPEPEYRSKLQELGVRTLEYLFLLRTNQSFEDLKKVAARIAYSTTTSPEETARFFAEFDDDKTFRGLLHEPIGLELSPGELVGACEEALSRYKLPNKLRKRTEELLEECRVLLHANPDVYPWKNDNLRDKVLLPYKKDTRFDVAHGLTLKERLEEHIQILEKRYDKFFEVDADLMLRTFVPDVLNAIKILLISMAQHTSAGKIHIQVPEVLGQGPIEIHIFDEDSVMQCAPDLLKGVLKGESAGALRRLRGYAYWTITAPFSDGSSYTFNVMTNEKFKAPEPASGVRHTLTFPQV

SEQ ID NO: 1612 - protein, 360 aa, unidentified
  source 1..360: note = Related to NZ_KB907919.1; note = Kushneria aurantia
MVTLGRRITSRHRNIKPVFTLKHLSALSGVDYGFLRHTVGRNTDAYTEFKIKKRSSSDVKKNYRTICVPSPALMKVQRWIAGNILSHVSAHPCSVAFSVGDRLFDAVAPHCPSKWLVKLDVRNFFESIKEVSVYHVFLQLGFEPLIAFEMTRLCTYVASNASNNNDRWHDSFFLPEHVITLYQYPEQGHLPQGAPTSPMLANLASRSLDERLAALADENLVRYTRYADDMTFSSDDVDFGRKRAGLLIKRVYQQLDRQSLSPNTAKTTVIPPGARKLVLGLSVEETVPRLTRQFKNSFRQHIHYLLRDDVGPTKHAAARKFASTTGLRHHLEGLLAFAAQIEPMWAAAQRNRLQAVSWPY

SEQ ID NO: 1613 - protein, 383 aa, Pseudomonas sp.
  source 1..383: note = Related to DAFSJF010000019.1; note = Pseudomonas aeruginosa
MEHWNPQLFRNQAAGVPPELVAHMVTVGRRITSCHRAVQPVFTLKHLAVLSGVDYGFLRHTVGRRTDVYTEFRIRKRPSANGQNRYRTICVPSPALMKVQRWIARNILSHVPAHPCSVAFSAGDSLFKAVAPHCPSKWLVKLDIRNFFESIEETSVYNVFHQLGFEPLIAFEMTRLCTYARSDPSLGPNHRTDGLFLPERIITLYQHPAQGYLPQGAPTSPMLANLVCRTLDDRLSTLADEHSVRYTRYADDMTFSTDKVDFGRESAGVLIKLVYQQLARQALSPNTAKTTVVPPGARKLVLGLGVEEAAPRLTRQFKDLLRQHIHYLLHDDVGPIKHAAARKFASTTGLRHHLEGLLAFAAQIEPSWAATQRSRFNTVSWPY

SEQ ID NO: 1614 - protein, 383 aa, Citrobacter sp.
  source 1..383: note = Related to NZ_RHWV01000005.1; note = Citrobacter farmeri
MERWNSQIFRNNAVGVPPELVVHMTAVGKRITSYNREVQPVFTLKHLAVLSGVDYGFLRHTVSRDTNAYTEFRIRKRSSVHGQTHYRTICVPSPSLMKVQRWIARNILSHVPAHPCSVAFSTGDSLFKAVAPHCPSKWLVKLDIRSFFESIDEISVYHVFKQLGFESLIAFEMARLCTHVGAEPSHEPDMGHDSHVLPERIIKLYQHSRQGHLPQGAPTSPMLANLVCRSLDERLSTIADKHSVRYTRYADDMTFSSNEVDFGRERAGRLIQLVYQQLNRQALRPNTAKTTVVSPGARKLVLGLSVEEDVPRLTRQFKESLRQHIYYLLHDDIGPAKHAATRKFASTIGLRNHIEGLLAFASQIEPTWAALQISRFQTVSWPH

SEQ ID NO: 1615 - protein, 382 aa, unidentified
  source 1..382: note = Related to NZ_CADEYZ010000005.1; note = Burkholderia gladioli
MQRWNPQLFRKQASGVKPELLAHLVKVGRRITQAHRDVQPVFTLRHLAALSEVDYGFLRQTVARRTEAYAEFKIKKRGSEHLSPQYRTICAPSPSLMKVQRWITQNILAHVPAHNCSVAFSKGDSLYKAVEPHCLAKWLVKIDVQSFFESISESTVYRLFNNLGFEPLVAFEMARLCTRDQHDAQHKKEQWKDYSPASLYVIEQYMHSVQGHLPQGAPTSPMLANLVCRALDERLAAIAEEQNLNYTRYADDITFSSLDPNFEREMAKALIQRVYRELARQGLKPNTAKTTVVPPSARKIVLGLSVEEETPRLARHFKDLLRQHIHYLTHPEVGPIKHATARKFASVVGLRHHVGGLLTYAAQIEPDWAAKQRMRFLEVKWP

SEQ ID NO: 1616 - protein, 384 aa, Pseudomonas sp.
  source 1..384: note = Related to JABEMH010000060.1; note = Pseudomonas fragi
MERWNPQLFRKQASVVAPDVLAQCIAVGRRITALHRDVQPVFTLKHLAVLSEVDFGFIRQTVARRTDAYTEFRVKKRSTQNGDPRYRTICVPSPGLMKVQRWIAQNILAHVPAHACSVAFSKGDSLYKAVEPHCSAKWLVKLDIRNFFESISEASIYLTLQSLGFEPLIAFEIARLCTRVVDDGMHRNDRWLNNFKHLSPYVIAQYTQTQQGHLPQGAPTSPMLANLVCRALDERLLAVAERADVRYTRYADDMTFSSDDASFGRDRAQKLIQAVYKQLACQSLSPNMAKTTIVPPAARKVVLGLSVEEAEPRLTRQFKALLRQHIYYLSRRDVGVIKHASARGFTSVTGLRHHLEGLLAFAAQIEPKWAAIQRSHFQAIKWPY

SEQ ID NO: 1617 - protein, 383 aa, unidentified
  source 1..383: note = Related to SEFB01000022.1; note = Rubrivivax sp.
MERWSPRQFRKEAKDVDPDVLQRAIAVGNRIVELNREVQPVFTLKHLSVLSGVGYGFLRQTVARRTESYTAFRIQKRPTPDGERRYRTICVPTPALMKVQRWIAQNILKHVPAHDASVAFSKDDTLYKAVEPHCSAKWLVKLDIRKFFESISEASVYLVFRSLGFEPLISFELARLCTRVVDAPMYRSDAWLNAHWNDEYVIEQYRQVWQGHLPQGAPTSPMLANLVCRKLDERLASISESFSVQYTRYADDMTFSSVDRSFDRARAMKLIGKAYEQLSLQGLGPNKTKTSVTPPGGRKVVLGLLVEEEKPRLTREFKAMLRQHFYYMLREDVGVVRHASSRGFISITGLRNHLQGLLGFAAQIEPEYAARQREKFSRVSWPL

SEQ ID NO: 1618 - protein, 386 aa, unidentified
  source 1..386: note = Related to JAHNIZ010000026.1; note = Paraburkholderia fungorum
MERWSSHQYKKVAHERGVPSAVVENAVAIGREIVRKNPNVQPVFTLRHLAELCEVDYALLRQYVSRGFDPYESFRVRKRPGPNGERRYRIICVPNPPLMKAQRWITQNVLQYGVVHNASVAFAPKSKLLHATEPHCNARWLIKLDIKRFFESIPERFVYRVFRDFGYQALVAFEMARLCTRLYPGPLFDSRKWTSSGLRESPYKIHAYDQSWQGHLPQGAPTSPMLANLVCYKLDELLADLADSDGLQYTRYADDLTFSTNSKEFSREQAAAVVGKVFQHLAQMGFSPNRSKTSVIPPRGRKVVLGLLVDGSRPRLSREFKASLRQHLYYLTLDGWGPVKHAKVRGFASLVGLRDHVLGLIGYAGQIEPAYALARRREFETIKWPI

SEQ ID NO: 1619 - protein, 395 aa, unidentified
  source 1..395: note = Related to CP000050.1; note = Xanthomonas campestris
MSDWRPQHYRKNAPAGSPASTIDAALEVASITSTANSRLPPIFSLRHLAHYTSINYNILRAAISRSGPEPYRSFRIRKRTEKSSERYRHISVPSHALMCVQRWINQRILQQCQVDDASTAFAKDSKLIEAATIHCKSRWLVKIDVRNFFDSINEISIYRVFNSLGYQPLVAFELARLCTRKSARHSKNWLNFRPETRDVWAAPDDEGKAWSSDMVIKSYDALHQGYLPQGAPTSPMLSNLAMRSFDEKVRDLALKRGFFYTRYADDISLSTERTSSRVTCVELIRDVHQLLHEEGLSPNFAKTKIVPPGAKKIVLGLLVNGEKPRLTREFRLRLRQHLHFLEKPNGPVEHAAKRKFASVSGLRHHLLGLAAYAAQIEPEYGQDIQQRLRNIPWPS

SEQ ID NO: 1620 - protein, 396 aa, unidentified
  source 1..396: note = Related to JAIOAG010000002.1; note = Stenotrophomonas maltophilia
MSDWRPQHYRKHAPCGLGSGVLDAAIKVAAGTRQANAKLPPIFSLRHLAHYSGINYYVLRAAVSRSGVEPYRSFRIHKRPPSHVRRYRHISIPSPALMQVQRWINQRILQQCEVDEASVAFAENCKIFDAAKLHSQSRWLIKIDVRDFFDSINEISVFHVFNRLGYQPLVAFELARLCTRESHHRKGKNWKNFRLKDNEIPSLWDESEPRWKSNMVIKSYDSQHQGYLPQGAPTSPMLSNLVMKDFDEKVGALASENGFFYTRYADDITLSTADQSSRTDCVQLMRAVYQLLHEKGLSPNVAKAKIVPPGAKKIVLGLLVNGDKPRLTREFRLRLRQHLFFLEKENGPVEHAKRRKFASVSGLRHHLMGLAAYAAQIEPAYGLKIQQRLMTISWPS

SEQ ID NO: 1621 - protein, 396 aa, unidentified
  source 1..396: note = Related to NZ_RWJW01000004.1; note = Xanthomonas axonopodis
MSDWHSQRYRKAAPAGQSSAVIDAAIQTASITKQVNAKLPPIFSLRHLSHYTSINYNILRAVVSRSRRESYRSFQIQKRSGRGASRFRSISVPSPALMQVQRWINQRILQQCKVDEASVAFAKHATLTEAAKIHCQSRWLIKIDVRNFFHSINEISVYRVFKSLGYQPLVAFELARLCTRQSLIGPGKQWENFRSTKDDIQAALDDKPVMWSSDMVIKSYDSPRQGYLPQGAPTSPMLSNLVMRSFDQKLRDLASESQFYYTRYADDITLSTTEPSSRATCLALMRKVYQLLHDEGLSPNAAKVQIVPPGAKKIVLGLLVNGDTPRLTREFRLRLRHHLYYLEKPNGPVEHAAKRDFASVSGLRHHLFGLAAYASQIEPAYGAQIQQRLRSIPWPA

SEQ ID NO: 1622 - protein, 397 aa, unidentified
  source 1..397: note = Related to MTCS02000083.1; note = Haliangium sp.
MTRWRPQRYRAGAVAKGISPQIVEHALRTAEITHAVNGKLPPILTLRHLAEYTGVDYGTLRSVARRSDEVSYRVFRIRKRPAHKGERRFRVIAVPSAPLMQIQRWINKRVLMHADVHPASVAFAEDDNIREAAAVHCQCKWLIKLDVLNFFESISEISIYKVFRSLGYQPLISFELSRICTRISKSTANRSSERWINFRPGSAVDTDGVSSISGMTIRAYDEYRIGHLPQGAPTSPMLANLAMRELDQNLTEVAKVHGLFYTRYADDLTFSTREDSDRRKCQHIIGQIYRALANVGLSPNRCKTRIIPPGGRKIVLGLLVTGPEPRLMRDFKARLRQHFYYLERPNFGPSQHARKLGFSSVIGFRHHLAGLVSYAAQIEPEYGQRMRNRLKNIKWPI

SEQ ID NO: 1623 - protein, 392 aa, unidentified
  source 1..392: note = Related to JAAXRA010000003.1; note = Rhizobium laguerreae
MTTWRPQHFRSAATAAGRDPSTIRNALAVAENIRRHNPALPPIFSLKHMAELTGNDYGVLRSIVKRDEPDPYRIFTIRKRPSFDGERRFRLITVPRPALLRTQKWICQQILAKATPHGSSVAFSKGNTLFDAARPHCESRWLIKMDVRNFFESINEIAVYRVFRSLGYQPLVSFELARVCTRLGGPTPLRSTPRWHYDPKNWPSISAYQVYRYGYGPRMGHLPQGAPTSPMLANLAMREFDHAVDEIAARHGLRYTRYADDLTFSTDSDDFDRGKAGHFIGLVYKEMGKVGLSPNITKTRVASPGARKVVLGLLVDGKRPKLPREFKQNMRRHIFCLTHEGLGPVRHAQERGFSSVRGFRRHIQGLLAFANQIEPEYAAGCRQQLRGVVWPL

SEQ ID NO: 1624 - protein, 392 aa, unidentified
  source 1..392: note = Related to NZ_NWSJ01000022.1; note = Rhizobium anhuiense
MTSWRPQHFRSAAAAAGRDPSTIQNALAIAQGIRQHNAILPPIFTLKHLAELTGTEYAALRSIVKRDEPDPYRIFTIRKRPSYDGERRFRLITVPRPSLLRTQKWICQQILANIVPHSSSVAFSKGDTVYDAANPHCESRWLIKMDVRNFFESINEISVYRIFRSVGYQPLLSFELARICTRLGGATPLRMTPRWNYNSRQWSAISSYQVYRYGHGPRVGHLPQGAPTSPMLANLAMREFDRRVDHLATHHGLRYTRYADDLTFSTVSDDFDRGLASHFIGLVYAEMGKVGLSPNVTKTRVASPGARKIVLGLLVDGKAPKLTREFKQNMRRHIFCLTHEGLGPTRHAEERGFSSVRGLRRHIQGLLAYAKQIEPDYAANCRRQLQSVVWPL

SEQ ID NO: 1625 - protein, 390 aa, unidentified
  source 1..390: note = Related to NZ_BCYZ01000072.1; note = Sphingomonas pruni
MTSWSPQHFQTVADSAERDPKVIQNALTAARVIRSTNPALPPVFTLGHLAHLTGSEFFQLRSVARRDEPDPYRLFRIRKRPSFEGERRFRIITVPQPHLLRVQRWITQAILANALPHQASVAFSKGNRLRDAAAVHCNSSWLIKLDVTNFFESISEISVYRIFRSLGYQPLISFEMARICTRLGGPTTRKRGERWRVHFKPREIKSYDVYRPFGGARVGHLPQGAPTSPMLANLAMRSFDTEVDKLAVEHGLRYTRYADDLTFSTKGEFSRDQAAHVIGLAYKAMGRVGLSPNATKSRVAPPGSRKMVLGLLVDGAEPRLPREFKESMRRHLYYLCRTDIGPVAHARARGFASTIGMRHHIEGLLSFAKQIEPSYAAECKRKFANIDWPI

SEQ ID NO: 1626 - protein, 372 aa, unidentified
  source 1..372: note = Related to NZ_CP021467.1; note = Komagataeibacter europaeus
MANALATASQLKIPSLPPVFTLAHLAQQAGVDYGVLRRVAQRSPNEGYRVFRIRKRPAYTGERRYRQIAVPSPQLMKVQRWITQAILSKAAAHSASVAFSKGDKLADAAAPHCGCKWLIKMDVRNFFESINEIAAYRVFRSLGYQPLVSLEMARISTRLAGWSPRRATNRWRVEDWRHMERRWSEIEAYQAYRDDSGPLLGHLPQGAPTSPMLANLAMREFDAQAAAIAEQNGMIYTRYADDLSFSTDQPITKADCRRLIGTIYNLMGTIGLSPNVTKTRVSPPGARKIVLGLLVDGKKPRLSREFRALMRQHLHYLMKDGVGPVRHARARGFVSVAGFRNHLRGLATYARQIDVVYGDGLLRELDKVSWPV

SEQ ID NO: 1627 - protein, 383 aa, unidentified
  source 1..383: note = Related to SADI02000018.1; note = Mesorhizobium sp.
MSRWSPQQYRSNAQNIDPDIVAHAIETARLIHEVNAEITPVFTLRHLAYATDVDYGLLRAIASRAHGEPYRLFVIKKRPSRSGEKRFRVIAVPSPGLMKVQRWITHRILGHIRPHPASVAFSKGDKIVSAVRPHCGARWVIKMDVRNFFESINEISIYRVFRSLGFQRLISLEMARICTRLGTPTISRLHQRWKSNYQRETIHVYGAGRMGHLPQGAPTSPMLANLAVRKLDELIEEIATKCGMIYTRYADDLTLSTKDMTFNRDQAGIVIGKIYAAMGLYGLSPNITKTNILSPGSRKIVLGLLVDGEKPRLSRDFRNLMRQHLHYLGSLKHGPAEHASKRGFSSIRGMKHHIYGLATYARQIEESYGIECIAALNKIEWPI

SEQ ID NO: 1628 - protein, 383 aa, unidentified
  source 1..383: note = Related to RZQP01000036.1; note = Mesorhizobium sp.
MSRWSPQQYRRSAKDTDPGIVANAIETAKLIHAVNADVAPVFTLRHLAHAADVDYGLLRAITSRADGEPYRLFLIRKRPSHTGEKRFRVIAVPSPALMKVQRWITHRILGHVRPHSASVAFSKGDTLVAAAEPHCGARWIVKMDVRNFFESINEISVYRVFQSLGFQRLISLELARICTRLGSLTTSRKNPRWWSNRERETIKVYGARRMGHLPQGAPTSPMLANLAVRKLDELIEEIAAKHGMIYTRYADDLTVSTKDKTFNRDKCRAVIGEIYAAMAKHGLSPNTAKTIILSPGSRKIVLGLLVDGEEPRLQRDFRILMRQHLYYLTSPKHGPADHARIRGFSSIRGMRHHIHGLATFARQVEKPYGEECLSALNKVNWPV

SEQ ID NO: 1629 - protein, 385 aa, unidentified
  source 1..385: note = Related to LMHK01000002.1; note = Devosia sp.
MTRWNPQQFKRDAERAGLDPAVTANAIRTARLVTSVDPDLPPVLTLRHLAALTRSDYLMMRGIAMRSQNEHYRLFRIRKKPAHDGEKRFRVIAVPEPGLMRAQRWIAQRILARIRPHGASVAFSKGDKLVEAARPHCGARWLIKLDVSNFFESINETAVYRVFRSLGYQPLVCMEMARLCTRLGTTTHYRSRPRWLLTRERSTIEVYSRRRMGHLPQGAPTSPMLANLAVRLFDEAIQELADANDLAFTRYADDIALSSQDAKFGRDRCAAVIGKVYAKMGEFGLSPNATKTRVASPGARKVVLGLLVDGDEPRLPRDFRANMRRHLHYLCVPGADIAVHAAARGFDSISGMKNHVFGLAMFARQIERDYGDECLSKLNAVAWPR

SEQ ID NO: 1630 - protein, 384 aa, unidentified
  source 1..384: note = Related to JAAOYS010000006.1; note = Dyella sp.
MEDWLPQLYQKQGTEAGIAPRVLANANLTAKSIRAVNRHVPILFSLNHLAVRCGVPYSFLRAVVERHDFQFYRSFRIRKRPLKGRVRFRLISAPVPFLMRVQRWIAQEILSNGYPHETSTAYAKRSSPLKAAALHCDARWLIKIDVMNFFESITEVSAYRAFRRLGYQPLLSFEMARLSTRVRSALRQLPSPYWHTQAHRWPKIESYQCWRKGGLPQGAPTSPMLANLASIALDECLAEVARKYRLTYSRYADDLCFSTSGDFSRKDCAGVISEVYAGLRKFGLRPQTMKTTVSPPGARKVVLGLLVDRNTPHLTREFKARLRQHLHYLRKADVGPARHAERRGFSSVIGLRHHVEGLVEYASSVDAVYGESRRRELAEVSWPF

SEQ ID NO: 1631 - protein, 383 aa, Bacillus sp.
  source 1..383: note = Related to NADW01000002.1
MENWLSQRYRMDANKQGVDPEVVEHAVATAENIRSINPNVPLLFSLKHLALRAGVPYEFLRAVVERQERHFYRTFRIRKRPLEGRIRFRLIAAPVPPLMSVQRWIATQILSEGHPHEASVAYARHSSPLKAASFHCNARWLIKIDVMNFFESITEVAAYRAFRRFGYQPLLSFEMGRLCTRVRSWRRQAPPYWQSKSWRWGKIDSYKFSTKGALPQGAPTSPMLANLTALELDALVTRLANKHGLVYTRYADDLCFSTPGEFSRAQCSQLVGEVYKALRRFGLRPQTMKTVIAPPGARKVVLGLLVDGQKPRLPREFKARLRQHLHFLTHPSVGPALHAARRGFASIIGLRHHVSGLIEYAASVEPAYGARCRSQFANVQWPF

SEQ ID NO: 1632 - protein, 385 aa, unidentified
  source 1..385: note = Related to QQSY01000005.1; note = Dyella solisilvae
MTHWSPQRYRSLGQRRGIDPSVLENAVRTGNITCAANPHVPTLFSLKHLAYRSGVDYSLLRAIVERRDPEPYRTFKVRKRSSSPQHARYRVIAVPSPALMRVQKWIAQRILAVAPAHSASTAYGKNCNISDAVLPHCSSRWLIKLDVRSFFESISESAAYGVFRKLGYQPLISFELARICTRVYSKTRLRSYKYWDVEPARWSAIPSYQYFRKGSLPQGAPTSPMLANLAVRQFDANITAIAEKYGLIYTRYADDLALSTSGEFSRQKCHSVIQKVYGEMRAFGLSPNATKTAISPPGARKLLLGLLVDTDRPKLTREFRAKLRQHVFFLQSPKAGPVKHARHLGFQSLIGFRHHIHGLVNYAYEIEPAFGERYKEALKAVEWPL

SEQ ID NO: 1633 - protein, 383 aa, unidentified
  source 1..383: note = Related to JACRPC010000021.1; note = Rhodospirillales bacterium
MTMWRPQSYQRRGKELGIEETLLARACAIGSAVIAVNPALPPVFTLRHLAYQVDADYGLLRAIISRSLRDPYKVFRIRKRPSTVGEKRFRVICVPDPELMRVQRWISQRILSHANPHSASVAYAKGSTILAGAEPHCGCRWLIKLDVRNFFETISEIAVYRVFRSLGYQALVAFELTRLCTRLGTKTPLRIGQRWQVHFGRHMVIGDYSASRMGHLPQGAPTSPMLANLAVLAFDGEVNEIANKHGLIYTRYADDIALSTTDKTFSRTVAAKVIGEVYAAMGRYGLSPNVTKTRVSSPASRKVVLGLLVDGNAPRLTREFKANLRRHLHYLGRPDVGPAKHAAARGFAAIAGLRHHVEGLVAFARQIEPEYGERSAKLLVDRL

SEQ ID NO: 1634 - protein, 388 aa, Pseudomonas sp.
  source 1..388: note = Related to CP032456.1; note = Pseudomonas savastanoi
MKDWTPQHYRRAPGAANLPASVMEAAIAASGKTVAVHSSLPPILTLNHLAHLTQVPYKHLRDYVTREIESYKIFRVRKRARPGKPTTFRVICVPPPSLATAQRWIAQHVLSKARPNAASTAFAPGSKLVDATAPHCASRWLIKVDVQRFFESISEVDCYRVFRSLGYQPLVAFELSRLCTRTGNFSRLHRAIKWRRKISLSKSKIPGYASRDIGHVPQGAATSPMLANLVMREADTLMTSLADRLGLTYTRYADDLTFSTSDPKFDRQTAIKTVNEAYAILRRFGFTPNIAKTTIASPRSRKIVLGLQVDQDKPRLTRAFKMKMRMHMYYLERRDIGPLVHAERRGFSAVAGMRNHLMGLAAYAIQIEPEYGRNLRERLEALDWPVLY

SEQ ID NO: 1635 - protein, 388 aa, Pseudomonas sp.
  source 1..388: note = Related to NZ_CP018420.1; note = Pseudomonas veronii
MKDWTPQHYRRAQGASSIAPLVMDAAIVTSQKTVAVHPSLPPILTLKHLAHLTQVPYKHLRDYVTREVESYKVFRVRKRGRLGQPTSFRVICVPPPSLSVAQQWIAQHVLAKAKPHAASTAFAPNCRLIDAASPHCTSRWLIKVDVKRFFESISEIDCYRVFRSLGYQPLVSFELSRLCTRTGNFSRIRRTVKWRRKVSLSKSKIPNYASRDIGHLPQGAATSPMLANLAMREADILLTELAERLGLTYTRYADDLTLSTTDVTFDREQARRTVNEVYRILQRFGLNPNLAKTTIASPRSRKIVLGLHVHQETPRLTRAFRMKIRMHLHYLERKDVGPLKHAERRGFSAVAGMRNHLMGLAAYAIQIEPDYGREVKARLEAVEWPVLY

SEQ ID NO: 1636 - protein, 388 aa, Pseudomonas sp.
  source 1..388: note = Related to PPEF01000002.1; note = Pseudomonas protegens
MKDWTPQHYRRSKGASNVPTAVMNAAIATSQKTVAINPSLPPILTLNHLAHMTQVPYKHLRDYVARDVESYKTFRVRKRARPGRPTSFRVICVPPPSLAVAQRWIAQHVLAKARPHAASTAFAPKCKLIEAAAPHCSSRWLIKVDVQRFFESISEIDCYRVFRSLGYQPLVSLELSRLCTRVGHFSRMRRAIKWRRKAPLAKSKILKYASRALGHLPQGAATSPMLANLVMREADTLLTSLADRFGLTYTRYADDLTFSTADTAFDRKSARNAVNEVYGILRRFGLTPNLFKTNIVSPRSRKIVLGLQVGQDVPRLTRAFKMKMRMHLYYLEREDVGPLAHAERRGFSAVAGMRNHLMGLAAYAIQIEPEYGMGVKARLEAVQWPILY

SEQ ID NO: 1637 - protein, 388 aa, Pseudomonas sp.
  source 1..388: note = Related to CP077977.1; note = Pseudomonas aeruginosa
MKDWKPQHYRRAPGASKVSVPVLAAAIATSEKTVAVHPSLPPILTLKHLAHLTGVPYKHLRDYVSRDTEAYKIFRVRKRARPGTLTSFRVICVPPPSLAIAQKWIAQHVLAKAKPHSASTAFAPNCRLVDAAKPHCASRWLIKVDVQRFFESISEIDCYRVFRSLGYQPLVSLELSRLCTRVGRFNGMRHGIKWRRKASIKKSKIVRYALLRLGHLPQGAATSPMLANLVMRDADELLTSMADQLGMTYTRYADDLTFSTASPVFERQTARRVINEIYQVLRRYGLTPNLAKTTIVPPRSRKIVLGLQVDQDEPRLTRAFKMKMRMHLHYLEREDVGPLKHAERRGFSAVAGMRNHLMGLAAYASQIEPTYGRDLKDRLEKLDWPVLY

SEQ ID NO: 1638 - protein, 388 aa, Pseudomonas sp.
  source 1..388: note = Related to NZ_LT629756.1
MKDWKPQHYRRAPGAADVPASVMAAAIATGAKIVAVQRSLPPIFTLKHLALLTQVPYPHLRDYITRKTDAYKIFRVRKRARPGQPTSFRVICVPPHSLAVAQHWIAKHVLAKGVPHSASTAFAPDCRLIDAAAPHCASRWLIKVDVQRFFESISEVDCYRVFRSLGYQPLVSLELSRICTRIGPLNSLRRSAKWFRKAPLAKSKIRSYAVPRIGHLPQGAATSPMLANLAMKEADVLLTALANRYSLNYTRYADDLTFSTADHSFKRNDARMAVHEIYGVLRRFGLAPNLTKTAIVSPRSRKIVLGLQVNQDVPRLTRDFKMKIRMHLHYLEREDVGPLKHAERRGFSAVAGMRNHLMGLAAYAAQIEPAYGQAIKARFERIAWPVLY

SEQ ID NO: 1639 - protein, 388 aa, Pseudomonas fluorescens
  source 1..388: note = Related to NZ_CABVIT010000001.1
MKDWKPQHYRRAAGAVGVPAPVMAAAIATGQKTVAIHPSLPPILTLKHLAHLTQVPYLHLRDYIAREIDAYKIFRVRKRARPGQPTSFRVICVPPHSLAVAQQWISQNVLAKGKPHHASTAFAPNCRLVDATAPHCSSRWLIKVDVQRFFESISEVDCYRVFRSLGYQPLVSLELSRLCTRVGPFNGLRRSRKWFRKAPIEKSKIRPYAVSRLGHLPQGASTSPMLANLAMREVDGLMTAMADRYGLTYTRYADDLTLSTSDPEFQRKDARKAIYEIYGILRRFGLNPNLTKTAIVSPRSRKIVLGLQVDRDEPRLTRAFKMKLRMHLHYLEHEDIGPLKHAERRGFSAVVGMRNHLMGLAAYAIQIEPDYGKDIKMRLERVKWPVLY

SEQ ID NO: 1640 - protein, 388 aa, Pseudomonas sp.
  source 1..388: note = Related to FNJJ01000006.1; note = Pseudomonas guguanensis
MKDWKPQHYRRSPGASAVSSSVMAAAIATAQKTVAVHSSLPPILTLKHLAHLTQVPYLHLRDYVSREVEAYKIFRVRKRARPDQPTSFRVICVPPQSLAVAQRWIAQHVLAKGKTHPASTAFAPNCRLVDAAAPHCASRWLIKVDVQRFFESISEVDCYRVFRSLGYQPLMSLELSRLCTRVGPFNGMRRSRKWFRKPPLSRSKIKSYAVWRLGHLPQGAATSPMLANLAMRDVDVLMTGLADRYGLTYTRYADDLTFSTADPGFEREDARKAIYEVYGVLRRFGLTPNLAKTTVASPRSRKIVLGLQVDQDAPRLPRAFKLKMRMHLYYLERDDVGPLKHAERRGFSAVTGMRNHLMGLAAYAIQIEPAYGKDIKARLERVKWPVLY

SEQ ID NO: 1641 - protein, 389 aa, unidentified
  source 1..389: note = Related to JAESND010000005.1; note = Jeongeupia naejangsanensis
MTDWKPQPYRRAAEDLGISKAVLDASIAASLAVVDVNPSLPPILTLKHLSHLSGVPYQDLRLIVSRENADPYKIFRIRKRPRRDGLTQFRVICIPEVKLAEVQQWIARKVLAHGRPHSASTAFAPGSRLVDAVQPHCGSRWIIKVDVRRFFESVSEIAAYRVFRRLGYQPLMSLELARLCTRVGPITKLRRTRHWTRVAPLDAATIRSYAVRHLGHLPQGASTSPMLANLVMCDADAELTKAAESFHLIYTRYADDLTFSTRNAAFDRSAAVTLIKQVYRVLGRFGLEPNLAKTQVVPPRARKIVLGLLADQDVPRLTREFKKKMRMHLYYLERADVGPVRHAQQRGFSAVAGLRNHLLGLAAYASQVEPMYGAELRKRLMAVSWPIVY

SEQ ID NO: 1642 - protein, 389 aa, Chromobacterium sp.
  source 1..389: note = Related to CP029554.1; note = Chromobacterium phragmitis
MTDWKPQPYRRAAQSLGISEAVLDASVAASQAVVAINPSLPPILTLKHLSYLTGTPYQYLRQVVSRDELNPYRVFRVRKRPTPCGRVQFRVICVPDIKLAIVQRWIARKVLALGRPHSANTAFAPGSRLVDAVEPHCGSRWIVKVDVRRFFESISEISAYHAFRLLGYQPLMSLELARLCTRVGNFSKLRRQRRWIRLAPRHVAKISSYAVPRLGHLPQGAPTSPMLANLTMCEADAVLTKAAESFGMVYTRYADDLTFSTSKDSFDRKDAKVLIKQIYQILGRFGLVPNLAKTQVVPPRARKIVLGLLVDQSTPRLTREFKNKMRMHLYYLERADIGPIQHAQKRGFSAVVGLRNHLMGLAAYACQVEPKYGDELKKRLKAVPWPVVY

SEQ ID NO: 1643 - protein, 389 aa, unidentified
  source 1..389: note = Related to FOZE01000001.1; note = Mitsuaria sp.
MDDWKPQPYIRQAQQLGVAQSILDAAVAASEAVVAAHPSLPPILTLRHLAHLTDTSYLKLRDWVSREIEDPYRVFRIKKRPVAPNCTAFRTICVPDVELAFLQRWLSRNVLSWGRPHSASTAFAPGSTLLAAVEPHCGSRWLVKLDVRRFFESISEVSVYKAFRRLGYQPLVSLELARLCTRVGPASRLYANARWTRRAPRYVAAIRKYAVVRFGHLPQGAPTSPMLANLVMRDVDEELTKVAKLHGMTYTRYADDLTFSTPRRDFGREIAVELIQKVYRSLGRFGLQPNLAKTQVVPPRSRKVVLGLLVDGKEPRLTREFKNKMRQHLYYLERPDVGAVRHAQARGFSAVAGLRNHLLGLAAYASQVEPQYGAELARRLNAVSWPVVY

SEQ ID NO: 1644 - protein, 390 aa, Alcaligenes faecalis
  source 1..390: note = Related to NZ_CP013119.1
MNDWKPQPYRREAQRRGVSPEVLAAAIAASEAVVAVNPSLPPILSLRHLSHLTGVPYQLIRAWVTREGAGESPYKTFSIRKRPKKDGTKQFRFICVPQHDLGLTQRWIASKVLALGRPHSASTAFAPKSKLFEAVEPHCECKWLIKVDVQRFFESITEIAVYQVFRKLGYQPLVSLELARICTRLGPPGRYRPPARWRRHAPLDAHIINSYSTRALGHLPQGASTSPMLSNLVMVDLDEKLSKLASSVNMTYTRYADDFTFSSHATDFNREAAERFIKDIYHALGQFGLKANLAKTQIIPPRARKVVLGLLVDGKTPRLTRKFKAKMRMHLYYLKHAEVGPLRHAERRGFSSIAGLRNHLLGLAAYAIQIEMEYGLELKTRLEAIQWPLL

SEQ ID NO: 1645 - protein, 389 aa, Pseudomonas sp.
  source 1..389: note = Related to AKJM01000112.1
MTDWKPQPYRRAAEELGVSEAVLEAAIAASEAVVAVHTSLPPILTLGHLSHLSGVSYQDLRSFVSRDEPDPYKVFRVRKRPQPDGRLRFRVICVPDARLGDAQRWIARHVLVHGRPHSASTAFAPKARLIDAVRPHCGSRWLIKIDVRRFFESISEISVYKVFRRLGYQPLVSLELARLCTRVGPNTWLTRTQRWWRRAPLHVSTIRNYALPRLGHLPQGAPTSPMLANLVMREADIELSKIAKSYGLNFTRYADDLTFSTTKPKFDRAAAGSLIQQVYQVLGRFGLEPNLAKTQVVPPRARKIVLGLLADRDAPCLTREFKNKMRMHLHYLEHEDIGPVRHAQHRGFSAVAGLRNHLLGLAAYASQIEPVYGAEIKTRLMAVPWPIIY

SEQ ID NO: 1646 - protein, 390 aa, Pseudomonas sp.
  source 1..390: note = Related to NZ_LT629691.1; note = Pseudomonas thivervalensis
MKDWKPQPYRRIAQELGVSDAVLRSALAASEAVVAVHPKLPPVLTLKHLSRLSGVGYMDLRRYVSREDPHTYKVFCIRKRPQPDGRIRFREICVPEHSLCDVQQWIVRHILVHGRPHSASTAFAPGAKLIDAVQPHCGSRWIIKLDVRRFFESISEISVYNVFRSLGYQPLVSFELARICTRIGSDKTWLSKTRRWRRKAPLHVAAIRNYSAKQLGYLAQGAPTSPMIANLVMRAADAEISALSEPFGITYTRYADDLTFSTNSAHFDRTTASALIRKVYQTLGRFGLQPNLAKTQVVSPRARKVVLGLLADGVSPRLTREFKGKLRMHLHYLEHVDVGPIKHAQRRGFSAVAGLRNHLLGLAAYAIQIEPEYGYAVKARLMAVHWPIIY

SEQ ID NO: 1647 - protein, 389 aa, unidentified
  source 1..389: note = Related to NZ_VEHL01000001.1; note = Bordetella sp.
MENWRSQHYQSVGRSQGIAPEILNAATQTGTAIVRTNARLQPVLTLRHLAYLADCDYGFLRAVVGRAIENPYRVFAIHKRPAPSGNARFRTICAPDPRLLGVQRWLVTNVLNHAPTVHPASKAFAPECTLVKAAEPHCGARWLVKVDVRNFFESISEIAAYRAFRALGYQALVAFELARLCTRLGRFTPRRSHPQWLRKRNRIYRIASYNHAEGRIGHLPQGAPTSPMLANIAMQAADAEFDMLASSAGMVYTRYADDIVFSTKDKDFTRDLAAGLVGSAYRILGKYGFSPNVAKTEIIPPRARKVVLGLLVDDLTPRLPREFKEKMRMHLYYLKRDDIGPVRHAKKRGFIAVASLRNVLYGLAAFATQIEPTYGSRIRRDLDAIEWPT

SEQ ID NO: 1648 - protein, 391 aa, unidentified
  source 1..391: note = Related to NZ_CP028901.1; note = Orrella marina
MENWHPQHYQAVGHSQGISPDVLAAAMQTAKVILRVNPRLQPVLTLRHLAYLTDCDYGYLRAVIGRGIENPYRVFTIHKRPGPSGNARFRTICAPDSQLLKVQRWLVTNILNHATAAVHSTSKAFAPGCTLMKAAEAHCGARWLIKVDVQNFFESVSEIAAYRAFRNLGYQALVSFELARLCTRLGHNTPRRGHAQWLRKKAGVAYKISKYNHSMGRIGHLPQGAPTSPMLANLAMRAADAEFDNLARIDGMTYTRYADDLVFSTCDSGFTRDKASAIVGSVYRILGKYGFSPNVAKTEIVPPRARKIVLGLLVDEPSPRLPREFKEKMRMHLYYLKKDGIGPARHASKRGFISVAGMRNVLYGLAAFATQVEPTYGSSLRQDLDAIPWPT

SEQ ID NO: 1649 - protein, 390 aa, unidentified
  source 1..390: note = Betaproteobacteria bacterium; note = Related to JACRAR010000013.1
MENWRSQHYRNFGTRKGVSPEILEAAVQTGEAIVRTNARLQPVFTLRHLAYLTDCDYGLLRAIVGRSLQNPYRVFRIHKRPRSDGLNRYRTICVPDPQLLAVQRWLASNILNHAASSIHAASTAFAPGCTLLRAAEPHCGAKWLIKVDVQNFFESVSEIAAYRAFRRLGYQALLAFEFARLCTRLGNRTLRRSHQQWRRDPWRRYEIAAYNHSQGRIGHLPQGAPTSPMLANIAMHTTDVDLDALALSFRLTYTRYADDLVFSTTDPAFTRKLASSFVGSVYGILGKYGFSPNVAKTQIVPPRARKVVLGLLVDEPSPRLPREFREKMRMHLYYLKKDGVGPARHAVKRGFTAVASLRNVLYGLAAFATQIEPQYGAGIRAELDSINWPT

SEQ ID NO: 1650 - protein, 390 aa, unidentified
  source 1..390: note = Related to QUNA01000002.1; note = Paraburkholderia sp.
MGNWRPQHYRTIGSEKGVPRDVLDAAVQTGKAIVRTDAQLEPVFTLRHLAYLTDCDYGLLRAIVGRSIQNPYRVFRVHKRPGPDGQKRYRTICAPDPQLLTVQRWLSTNVLNHASSSIHAASTAFAPGCTLLNAAEPHCGARWLIKVDVQNFFESISEIAAYRAFRGLGYQPLVAFEFARLCTRLGRKTSRRSHAQWRRAPWRRYKIAAYNHDQYRIGHLPQGAPTSPMLANIAMHGADEALHALARSSGLTYTRYADDLTFSTTALDFNRELASIVVRSVYRILGEYGFSPNVAKTQIIPPRARKIVLGLLVDEPNPRLPREFREKMRMHLYYIKKDGVGPARHAANRGFTAVASLRNVLYGLAAFATQIEPQYGLSIRKELDAVAWPT

SEQ ID NO: 1651 - protein, 389 aa, unidentified
  source 1..389: note = Related to NZ_KE386569.1; note = Methylobacter luteus
MADWKPQPYRAKAQSLEVDPTILDAAVAAGNEVVAIHPSLPPIFTLKHLAYLTDTKYSVLRMMVGRHIEEPYRVFKIRKRPGPDGAARFRVICAPSPTLLAVQSWLARKVLVHARTKVHSASTAYAPGCSILEAASPHCGCRWLIKVDIKNFFESVSEISAYHAFRSLGYQPLVSFELARLCTRVGSQTRHRAHRQWQRHLPSTKSKIHDYVYWRLGHLPQGAPTSPMLANIAMYKADGELTAWGLKHGLVYTRYADDMTFSISDEGFNRNKAAAVIRGIYRIIGKYGFAPNVTKTQVVPPRARKVVLGLLVDQNEPRLPREFKMGVRMHLHYLKSPKFGPAVHAANRGFTAVAGLRNHLFGLVAYAAQVEPAYGTRIKSELEAVKWPI

SEQ ID NO: 1652 - protein, 386 aa, unidentified
  source 1..386: note = Related to JAIETD010000002.1; note = Methylobacterium sp.
MLTKRPQHYRSLGRCAGIDDVIIERALATAAIQDRVGGRIPTILTLRHLAELAGVPYGFLRGVAARRFPDPYTTFQVRKIARPGEEGYRTITVPPPLLMSVQRWISGNILVHGRPHAASTAYAPGSSVVKAAERHCGCRWLIKLDARRFFESISEIAAYRVFTTDFAFQPLVALELARICTRLPENARTNRARRWLAKVSGYGAILDYHAAQLGHLPQGAPSSPMLANLAVREFDDEMARTAQQHRMTYTRYADDIALSTSDPAFTRSRASDVVLAAYAAMGRHGLSPNTTKTNVVPPGARKLVLGLLVDGDRPRLTREFKDSLRMHFHYCLMPDVGPVAHAEKRNFVSVIGLRHHLGGLVAFASQIEPEYGASLSEQMKKIVWPL

SEQ ID NO: 1653 - protein, 307 aa, unidentified
  source 1..307: note = Related to CABVPY010000024.1; note = Burkholderia lata
MLAKGGTPSRGYRMISVPRPDLKHVQRWICDNILALEKPHSASKAYTPKSTLVEAVEPHLGCRWLIKLDLHAFFDSIPETSVYKVFEGIGYQPLVAIELARICTRLSPDSRWRAHSRWQSRRPERYSNVKGYAVKRLGYLPQGAPTSPMLSNLVMRVFDADLTAAAVKRGFQYTRYADDLAFSTKEMSSRNLCGALITDVYKLIAKYGLAPNLSKTAVTPPGGRKLLLGLLIDGEKPRLTKEFREELNRHLYFIDKYGVQSHADHRKFESIYGLRHHLFGLAYYARQIDPTYGQAVLARLNAVPWPI

SEQ ID NO: 1654 - protein, 386 aa, unidentified
  source 1..386: note = Related to JAFCZG010000487.1; note = Deltaproteobacteria bacterium
MCSWCPQQFRKEALKNNIDLNIIEHAIKNAELVSAVSSELPPLFSLRHLSHLTGVDYVVLRPVVERNYSNPYKIFRLKKGVKGHQNRGFRIICVPDASIMKAQRWIAKNILSCGEASSASFAYAKSSKIIDAAKLHCGCRWMLKLDVRNFFESFSEIAAYRVFRSFGYQPLISFELSRICTRLGNQTKTHSHPKWMATNKNYTVINKYISRRIGHFPQGAPTSPMLSNLAMKLFDNEVIGIATKHGLVYSRYSDDLCLSTADKKFNREKAKTIINAIYKEMMKIGLAPNITKTQIIPPGARKIVLGLLVDGEAPKLSRAFRSKLRMHFYYLKHVDIGPPLHAKNRGFESVMGLKNHIQGLIAYARQIDPAYASSCTDQMNGIDWPL

SEQ ID NO: 1655 - protein, 387 aa, unidentified
  source 1..387: note = Related to NZ_VIKR01000006.1; note = Aliikangiella marina
MHIWCPQQFRKAGEANNVDPKVIENAIQVASAVQAVDKRLPPIFSLRHISHLTGVDYFVLRSLVERNYIEPYKVFKLDKKNKRSGNRGYRIISIPSPQLMIVQKWIAKNILKFGEVHTASFAYAENSKIIQAATLHCNCTWMIKLDVSNFFESFSEIAAYRVFRTLGYQPLISFEMSRLCTKLGTETRLRRHPAWQSSSFSKYHKISRYRNRAIGHLPQGAPTSPMLSNLAMKNFDSAVSKIALDNNLVYSRYADDLCLSTNDKSFDRTIARKVIISIYEKMNAIGLKPNLTKTQIVPPGARKIVLGLLVDGNSPKLSREFRAKLRMHFHFLCRSDIGPAKHAERRGFESVMGLKNHIQGLIAYARQIDPTYASSCDEHMDNINWPF

SEQ ID NO: 1656 - protein, 386 aa, unidentified
  source 1..386: note = Related to JAESRL010000013.1; note = Porticoccaceae bacterium
MHSWCPQQFKKNGIKQGVNPEVIEHAVQNAALVKAVSNNLPPIFSLRHLSNLVGVEYSLLRAVVERQQLDPYKVFKLKKRSKRTSSHPFRIICVPDEFIMKTQKWIAQHILSQGSVHHASKAYAKNSNIVDAANLHVECRWVIKLDVNNFFESFSEISAYRIFRSFGYQPLISFELSRLCTRLGPHTKLRSNSYWTATRHKYKIIKRYKNHRIGHLPQGAPTSPMLSNLAMKGFDKEVSVIAENAGLIYTRYADDLCLSTTSEDFSKSKAQIVINNIYEKMRNIGLRPNITKTQILPPGARKIVLGLLVDGDKPRLSRDFRSKMRMHLYYMMREDIGPVLHAKNRGFESVIGLRNHIQGLIAYAKQVDESYGLVCACKFETIKWPM

SEQ ID NO: 1657 - protein, 384 aa, unidentified
  source 1..384: note = Related to NZ_CP034142.1; note = Marinobacter sp.
MHRWNPQQFRKAAEEQGVAPKVVENAISCAEITRSVDPRLPPLFSLRHLAHYVEADYSLLRKAVARSGDEPYTTFKLKKNGKRAYRIICVPDIFLLEVQRWIAQNILAFGTPHHSSVAYAKNCNIVDAASVHCGCRWLIKLDVANFFESFSEIAVYRVFRSLGYQALISFEMARLCTRLGAHTKTRSGNRWEVRDDRIYKIDGYKNCRIGHVPQGAPTSPMLTNLALREFDKDIGDIAAEYGMYYTRYADDMFFSTKDLSFNREIGKKLISRLYGRMKAEGFRPNISKTRIHPPGARKLVLGLLVDGAVPKLTREFRSKIRMHLYYMNKQHIGPALHAQNRGFDSVMGLKNHVEGLINYAHQVQPDLGARLRAEFKKIAWGASV

SEQ ID NO: 1658 - protein, 367 aa, unidentified
  source 1..367: note = Related to VENF01000020.1; note = Methylophaga sp.
MSRKHSQLLPLQGLQPASASTGACFPVINSLKQLADMTETDYAILRQFVARQQPEPYKTFRIRKKSGGFRIIAIPDENLLKVQQWIYRQILTLVRPSPVSYAFQKGKSIQNAASVHCGCRWLIKLDLYNFFSAISEIDVYRVFRSLGYQPLIAFELARLCTRLGSLTAFRRRNRWQIADHYAVISQYHGQRMGHLPQGAPTSPALSNLVMVNFDRKVLCLAAEEQLTYSRYADDLCFSTPLRDFSRARARAFIHQIYRLMRSHGQSPNMSKTVIVPPGARKIVLGLLVDGEQPRLQKQVRNKIRQHIFHLNHADIGPEKHAQKRGFHSTAGFKKYLDGLLSYVSDIDPDLEQTYRHQLAGVRWPLET

SEQ ID NO: 1659 - protein, 364 aa, unidentified
  source 1..364: note = Related to NZSL01000007.1; note = Methylophaga sp.
MGRKHSQLFFTHDSQEISASSNCLPPIKSLKHLADLTETSYRDLRKIITRQSPEPYKVFRIRKKSGGFRIIAIPDESLLKVQQWIYRHILSQAQPSPVSYAFQKGKSIRDAASVHCGCRWLIKLDLYNFFGAISEIDVYRVFYSLGYQPLIAFELARLCTRLGSLTAFRHRHRWEIEGNSTIISQYQGQRMGHLPQGAPTSPALSNLAMVAFDRKIMNLAAEEQLTYSRYADDLSFSTPLTSFSRELAKAFIHRVFRLMRTYGQSPNMTKTKIITPGARKIVLGLLVDGEEPRLQKSVRNHIRQHIFYLNHSDVGLQKHAQKRGFLSTDGFKAHLDGVLSYVHDIDPSLAQNYRHQLADVYRLV

SEQ ID NO: 1660 - protein, 400 aa, unidentified
  source 1..400: note = Related to NZ_CP013376.1; note = Burkholderia cepacia
MKTWSPQNFQSRAKEKSGQAVIGNAQKIAKQIQTINPKLPVIFTLKHLSVRARISYGFVRSVVSRNPSEPYRSFSIRKRISAPRGKTSKRKAMGVKHEVGEHSFRRICVPTPRLMQLQRWIDKNILSVAPPHTASVAYSQGKKLIDAAQLHCGSTWLVKLDVKNFFESITEIDVYRVFLSLGYPALLSFELARICTRLGIDSKYARKDVFAVRRLARRKGHVAAYFGSRMGRLPQGAPTSPKLSNLVMRSFDEDMTNLAQKEGMTYTRYADDLCFSTRSRTYTRDKATKLIRSVYDALGATGLGPNRTKTVVVPPGARKVVLGLTVNDVRPRLPAELKSRMRVHLHYLKLFGPTEHAKRSGFSSTLGMYRHLAGICAFAQQIEPDVAKDWLTKLQGISWI

SEQ ID NO: 1661 - protein, 385 aa, unidentified
  source 1..385: note = Alphaproteobacteria bacterium; note = Related to QBMO01000003.1
MTPWRSQAFRAEAIAGGGSAGVITNAVATAAALHKHTPDAPPVFTLGHLAHLTDVHYRFLRQVVERQDPERYRRFRILKRTSGAGGAPRYRIICVPDPRLMRVQRWINANVLALGHVHKASTAFKAGDNIVAAAGVHCDAKWMIKIDILNFFESVSEQSVYHVFRGLGYQPLISFELARLCTRRGESSNARRGKRWAHSVGHAKRITNYHSSVLGHLPQGAPTSPMLANLAMKGFDEAVSRLADTYDLSYTRYADDLTLSSLGLFDRSRAQTIVSEVYDQLRCWGFRPNLAKTLIVPPGARKVVLGLLVDRQVPRLTKAFRARMRRHLYFLSHPQHGPVKHAAALGFASVYGLRNHVSGLIAYAQQVDANFAADAWGKFDAIVWP

SEQ ID NO: 1662 - protein, 386 aa, unidentified
  source 1..386: note = Related to JABJCF010000323.1; note = Nitrospina sp.
MTPWRSRSYVDSGSTAGCDETIVKNAAETGKMLLERTPGAPPIFTLKHLSQLTGVNYSFLRRCVERVESEPYRRFRIRKRQNPNEKKQRYRIICVPDPRLMAVHRWINTNILQLVPPHAASVAFGKGNNIAEAAANHCASKWLIKLDIVNFFESISEQSVYHVFSRIGYQPLIAFELARLCTRLGQPSYARWSRRWSARSYRFEKISSYQKEQLGHLPQGAPTSPMLANLSMTAFDASIRQVANDFDLAYTRYADDLTFSTTSVEFNRNKSQTVIPKIYAELLKYGFKPNLTKTKISSPGSRKVVLGLLVDGAEPRLTKKFRDNIRQHLYFINHPNIGPVQHANKKGFKSIYGLRNHVQGLIAHASQIDKEYANAAWEQFNHVLWP

SEQ ID NO: 1663 - protein, 391 aa, unidentified
  source 1..391: note = Related to NZ_FOYI01000015.1; note = Poseidonocella sedimentorum
MEPWRSQHFKKFAISKGSDLATVDAAIAIGKALQVKSPNCQPIFSLKHLAYSADVKYKFLREVVERSTEDKYRVFKIHKRGIPGQTSKRFRIICAPDPQLMKMQKWIARNILAHGRTHDASVAYQAGSNIVDAASLHCGCRWLIKLDIINFFESVTEQNVFRVFSDMGYQPLVAFELARICTRKGSATWRRNRAYKKWRTRNHIYTSIHAYSAVDILGHLPQGAPTSPMLANLAMVDFDKSVEDVANSFGLTYTRYADDLTFSTKSDAFSREVAQKVISEVYKVIRRFSFEPNLTKTQVVPPGARRVVLGLLVDGPTPQLSKKFRNQLRRHLHHVSADWPGVVEHAEKNHFQSVFGLRNHIEGLIAFAHSVDPEYAKKAWEKFAKIDWPQA

SEQ ID NO: 1664 - protein, 380 aa, unidentified
  source 1..380: note = Deltaproteobacteria bacterium; note = Related to JAHLLJ010000012.1
MWHPHSFKYQGKKEAVDDGIVQTAIEIADKTSSVHPELPPIFSLRHLAHLTNVSYGFLRHIVCRNIDEPYEVFQIRKRIYSKKKAYRIVCVPSPDLMCVQRWIAHKILRLGDTHPASMAYAPDSKIYRAALQHCECKWLVKIDVKRFFESISEMKIYHVFLQFGYHPLVAFEMARICTRVGKGSTFWRKPQWIPQRHVYYKITDYMSDRLGHLPQGAPSSPMLANLAMKSLDQKLQRIADKFQVSYTRYADDLTFSTKDKVFGKHNSRKIVRKVYDVLRAHGLLPNTLKTTISHPGARKVVLGLLVDGPKPRLSRQFRSRIRQHLYYLQKDPIAHARARGFISVWGLRNHIQGLLAHTKEIDTDFYDKTSSEFNLVDWPL

SEQ ID NO: 1665 - protein, 425 aa, unidentified
  source 1..425: note = Related to JACHBD010000013.1; note = Rhizobium lentis
MAWNSQRFVRAGELAGVDADILNNAVIIAEQTLRVQSSGPPILTLGHLAHLSGQSVKYLRSLVSREGEDPYRQFTIRKRPVPNQSPRLRFIAVPEPQLMSLLRWILSEILEKAPCHPASSAFAPESKLFNAAFKHRGAQWLIKVDVRDFFESITEIDVYRVFLERGYQPLTALELARICTRLRDVHREKGSIATRNRRSSMRTPNGIGEYNSRIMGTLAQGAPTSPMLANLAVRALDEKLQGVSEKFGVRYTRYADDIILSTTDKTFGRQRSIQLVGEIYAALGLYGLAPNTSKTLIVPPGARKVVLGLLVDGSKPKLTREFRAKMRMHLHFLLHEGVGPRAHAANRGFSSVEGLRQHLLGLIAFAGQVDLPYALRYKNLFRSIDLERRRHLTSSQSESPLRLGWKHLLEPAGATLGSIRRSHPT

SEQ ID NO: 1666 - protein, 387 aa, unidentified
  source 1..387: note = Related to JAAXSV010000011.1; note = Rhizobium laguerreae
MAWNSQRFVRAGELAGIEAEILENAVAVAEHTLGVRSPGPPILTLGHLGHLTGLSVKYLRSLVARDGDDPYRQFTIRKRPVPGQPPRFRFIAVPEPQLMGLQRWILSEILERAPCHPASVAYVPGSRLFKAANQHRRAQWLIKIDVRDFFESITEIDVYRVFLGRGYQPLTALEFARICTRLRDNLRESGAPAPRKRRTKMRGSESVAAYYSAVMGTLPQGAPTSPMLANLAVQGLDEKLQAIADKVGLRYTRYADDLIFSTSDKSFGRERSIQFIGEAYSALGEHGLTPNTSKTLIVPPGARKVVLGLLVDGAKPRLTRDFRAKMRMHLHFLLHKNIGPKAHASNRGFSSIEGLRQHLLGLISFAAQIDRSFANECRRQFRLVEWS

SEQ ID NO: 1667 - protein, 387 aa, unidentified
  source 1..387: note = Related to WUFA01000001.1; note = Rhizobium leguminosarum
MVWNSQRFVKAGVLAGVSTEILDNAVTIAEHTLSFRSPGPPILTLGHLGHLTGLSVKYLRGLVARDGEDPYRQFTIRKRPIPGQPPRFRFIAVPEPQLMDLQRWILSEILQHADCHPASVAFAPGSRLRTAAYEHRRAQWLVKIDVRDFFESITEIDVYRVFLARGYQPLTALELARICTRLRDVHREKGSPAPRNWRTRMRAPNSVGAYYSAVMGTLPQGAPTSPMLANLAVKDLDDKLQAIANKVGLRYTRYADDLTFSTTDKTFGRERSVQLVGEVYTTLGLHGLAPNTSKTLIVPPGARKVVLGLLVDGSKPRLTRDFRAKMRMHLHFLLHEDVGPTAHAIHRGFSSVEGLRQHLLGLIAFAGQIDRSFAEECKVKLRSANWP

SEQ ID NO: 1668 - protein, 392 aa, unidentified
  source 1..392: note = Related to NZ_VNHV01000015.1; note = Maritimibacter alkaliphilus
MRTWNSQRYFAEGLAAGVDESILNNAIATAEHTLRQPSPGPPILTLGHLGHLAGVDVGILKTYASRQDADPYREFSIRKRPIPGQPPRYRTIAVPEPPLLRVQTWIASEVLRHAPCHSASTAFAPGSRLAQAAARHCRAVWMVKIDLRNFFESLTEIDVHRVFLERGYQPLVAFELARLCTRLRDKHRNDTAVLPQRRTPKFRHSSLTSLYPRDLLGVLPQGAPTSPMLANLAVRDLDERLTAIAKTFGVRYSRYADDLTFSTTRKSFGRSRAHDLVGRVYETLAARGLAPNQSKTTIVSPGARKVVLGLLVDGDTPKLTRDFRSRLRKHLYHISAPDQGPVQHAARRGFASVEGLRQHLLGLIAFAGQIDPVYAAKCRAILDSSDWSQTRR

SEQ ID NO: 1669 - protein, 390 aa, unidentified
  source 1..390: note = Related to NZ_PGOI01000009.1; note = Pseudorhodobacter sp.
MNDWHSQHYLDAGRQAGIDEELLQRAVAAAEYTLTRPNHGPPVLTIGHLAQLCGVETGLLHAYVAREGDDPYREFTIRKRPIPGEAPRYRFIAVPEPRLLQVQTWIATEILRQAPCHGASKAFAPGNRLITAAGVHCRAQWMIKIDVRDFFESITEIDVHRVFRERGYQPLVAFELARICTRLRDDHRHPTSFLPQRRKPKYYGGSGYSVYPRTLIGVLPQGAPTSPMLANLAVRDLDEVLTSLASQFGLRYSRYADDLTFSTRRKSFGRARAKDAIGQIYQALINRGLSPNRAKTAIVSPGARKIVLGLLVDGTRPRLSREFRSRLRMHLYFVAHPDHGPAQHAKMRGFASVEGLRQHLLGLIAFAGQIDALFADWCRAEMRRANWPLT

SEQ ID NO: 1670 - protein, 405 aa, unidentified
  source 1..405: note = Related to QOCE01000045.1; note = Phaeobacter gallaeciensis
MDRAVPRCAAFLHGAIRTTLAESKQMTLWRSQPFLTAAKKDGREDQVVKNATKIATHLIRKSPGVEPILSLRHLGHLTGTPYNMLRSVVRRDEPEPYRIFRIRKRPLANEKLRFRTIAVPAPWLMELQRWLNVCILEHISPHSASMAFSRGNSIRDAAAPHCGARWLIKMDIMNFFESVTERQVFRVFEDIGYEPLVAFELARLCTRLGTRSTHAGHPRYRSSLNRMEIKDYSDPLMGQLPQGAPTSPRLANLVSRDLDKALTKLADERGFVYTRYADDLTFSSREALNRTAIKPIIGAISGIIGDNGFSPNVAKTTVSSPGARKIVLGLLIDGDEPRLSREFKQKLRQHLYYLREHGPVIHAGRNGNATTFGLRRHVFGLLQHARQIEPVYGNSCLEEFAKIQW

SEQ ID NO: 1671 - protein, 380 aa, unidentified
  source 1..380: note = Related to JAGHRB010000006.1; note = Ruegeria sp.
MTAWRPQRFKAAAGKAGCEQNVVSHAVTVASHVLIRSPGVEPILSLRHLGHLTDTPYYRLRRLVRREDPEPYSVFRIRKRPLPNEKLRFRTIVVPSPWLMDLQRWLNVNVLEHVPPHPASVAFSRGNSVLEAAAPHCGARWLIKMDIKNFFESITERQVYRVFDDIGYEPLVAFELARLCTRVGNRTSRKYHQRYHSPWQAREISEYTNAFMGHLPQGAPTSPRVANLAARDLDKALSNLADARRFTYTRYADDLTFSTSKKIDRADVRPILGEISKIVSENGFSPNVAKTTVSSPGARKVVLGLLVDGEEPRLTREFKQRLRQHLYHLRKHGPAIHCLHNGNATPFGIRNHVLGLVMHARQIERPYGDACLQEFNSIGW

SEQ ID NO: 1672 - protein, 391 aa, unidentified
  source 1..391: note = Related to CP036420.1; note = Cereibacter sphaeroides
MRRDPPHQRWSKQMTSWRPQPFSTMARAQGRDSATIQNSIDAAQRLAEITPNAEPIFTLKHLAHLTGAPYVLLRGIVSRHEPDPYRVFKIHKRPLPGEVTRFRTIVIPNQSLMDVQRWINVHILEHVKPHRASAAFTRGDSIKRAAERHCGARWLIKMDLRNFFESVTERQVYRVYLSIGYQPLVAFELARLCTRVASSHARLSRYHAPWGWKTIEGYRHPTMGHLPQGAPTSPKLANLVARELDENLEQLARSNGFVYTRYADDLTFSTLGASSRCAVRSFIGDVSESIAQAGFTPNQAKTQVSPPGSRKVVLGLLVDRDEPRLSREFKSQLRQHLFYLKRHGASAHASRQGSATIFGLRRHILGLIQHARQIEEQYGNSQLKSFKELHW

SEQ ID NO: 1673 - protein, 338 aa, unidentified
  source 1..338: note = Related to LR743509.1; note = Hyphomicrobium sp.
MRHLSVRAGVPYAYLREIVERNATRDYRLFRIRKRPVRNQRLRYRIITVPEARLKKVQQWIDRHVLCAAEPDEASVAFTKRSSVYAAASIHCGARWMIKIDIRAFFESISERQVYHVFHEIGYQPLVAFELARLCTRLRRRAPPLKRWSLGFDRRYEISAYINGQVGHVPQGAPTSPRLSNLVVRELDEDIRTIAASAGLTYTRYADDLTLSKTTDDFSRAAAVKVIRKIYRVLGAHGFAPNLAKTQIVPPRARKIVLGLLVDGDRPRLQREFKARIRQHLHYLMHPKFGPAKHAKAQGNATIYGLRNHIKGLLAFAHGVDPEYARKQTELFNRVHWP

SEQ ID NO: 1674 - protein, 373 aa, unidentified
  source 1..373: note = Related to NZ_WPZV01000002.1; note = Ruegeria arenilitoris
MISSSKRNPWHPSEFLEACQRKGAISTVAGPALEIAQRIKAQGPNLPVLLSLAHLAATVDVPIGLLLSYVERDKDPYRVFSVSKLGPNGETSNRRTICVPEPLLSKTQSWIAVQLLNNCTPHAASTAYAPGSSLYKAVRQHCGARWLLKIDLKNFFESINEMMVFDTFISLGYPRPICFQLARLCTRVFGAAQDDFARMRLGVLPQGAPSSPMLANLAVYKLDVSLSEIAAKNGWIYTRYADDLAFSTRSVSSRHETKELMWSILDQIRSFGLTPNKRKTSISPPGARKILLGLNVDTDRPRLTRSFKNNVETHVYAITNPAIGFNKHLEARGFESGPSMIRHIAGLIAYARSIEPDYADSLYKRLTTEAVRS

SEQ ID NO: 1675 - protein, 373 aa, unidentified
  source 1..373: note = Related to NZ_JAEDOS010000003.1; note = Ruegeria sp.
MTSSSNRNPWHPSEFIDACQREGAVSNVAGPALDIAQRIKAQGQDLPVLFSLEHLAATVDVPIGLLLSYVQRGKDPYRVFSVSKQGSKGLRSNRRTICVPEPLLSKTQSWIAAQLLNNCTPHPASTAYAPGSSLAKAVRPHCEARWLLKVDLKNFFESIDELKVFDTFVSMGYPRPICFQMARLCTRVFGAERGDNASTRLGVLPQGAPSSPMLANLSVYRLDVSLSEIASRSGWNYSRYADDLAFSTRLESSRHATKDLMWSIFDEIRSFGLTTNKRKTIISPPGTRKVLLGLNVDTDRPRLTRSFKNNVETHVYAITNPEIGFNKHLEARGFRSGPSMIRHIAGLIAYARSIEPDYAEKLYKRLTTEAVRS

SEQ ID NO: 1676 - protein, 374 aa, unidentified
  source 1..374: note = Related to WUWG01000003.1; note = Proposed Oceanomicrobium pacificus
MTGWSRRNPWSPTAFMQACRREGEVETIAEPALGIARRIKAQGPDLPVLFSLEHLAATVDVPIGLLLSYVDREKDPYRVFSISKKRGPKSEASNRRTICVPEPLLSKTQCWIAAQILNNCKPHSSSTAYAPGSSLVNAVKEHCGARWLLKVDVKNFFESINELMVFETFSSLGYPRPLCFQMARICTRVFGTAQFEVSKARLGVLPQGAPSSPMLANLAVNELDEAISEIAIRRGWIYTRYADDLAFSTKRESSRHEAKELIFSIVDEIRSFGLSPNNRKTTISPPGARKVLLGLNVDTSRPRLTRRFKNNLETHVYAITNPSIGIKKHSEARQFRSEQSMIKHIAGLIAYARSIEPEYADKLYRRLTADAIST

SEQ ID NO: 1677 - protein, 385 aa, unidentified
  source 1..385: note = Related to NZ_JACHCP010000006.1; note = Rhodanobacter sp.
MRSWRPQNFVREGQLRGVDDDVINNAVLTAARLRQRSPVLPPIFSLGHLAWLVGASYELLRDVVSRYTVDPYRSFQIRKRPLPGQGKRFRRICVPDTFLMLTQKWIASNLLVRVPAHSASVAFSKGDRIVDAVQPHCESTWLIKMDVVNFFESIDERVVYRVFRRMGYQPLVSFELARLCTRIGAPTAARRGRRWNPIRNSESKISSYEAPRLGHLPQGAPTSPMLANLAVIEMDERLSEVAGKAGFVYSRYADDLAFSSRRQLDRKSCREVIASASAILDVFGFSVNSAKTSVRPPGSRKVLLGLNANSVQPRLSRELRDRLLRHRYFLLHPQIGPAKHAKRLGFDSTIGFKNHLFGLVAYAAQVEPGFAMVLKEDLAQISWPL

SEQ ID NO: 1678 - protein, 384 aa, unidentified
  source 1..384: note = Related to PZOX01000020.1; note = Vitiosangium sp.
MSSWRPHLYKSNGIAQGRARVTLLNAIVQAQKVQARGLPAILTLGHLSKHVGVPYLLLREVVRRKRDTAYREFPVAKRSGGWRRIYVPEPLLLRTQRWISRYVLANLTPHSASVAYVRESSVFKAAEMHCRCQWLIKVDIQDFFESISERQVYLVYLQAGYQPLVAFELARLCTWVFDEQSLRYRRKRWRTSPERRSVPGEIGGYRDSRIGHLPQGAPTSPMLSNLVMAKFDAAAEAIALSEGCVYTRYSDDLSISSDASDFGRSRAENVVRELFALMRGSGFEPNPEKTVIAPPGARKIVLGLLVDSDRPRLRREFKSRLEAHVHGLVKFGPVQHARQRDFKSIFGMKRHLYGLLTYAEQIDSAFAEPLRKKLDSVVWPGVEP

SEQ ID NO: 1679 - protein, 388 aa, Pseudomonas sp.
  source 1..388: note = Related to NZ_VJOY01000004.1; note = Pseudomonas mangiferae
MSRWSSQPYLKAGRKAGVPGDVLKNAVKTAKQVKQGCPPILTLNHLSHLTGVPHSFLHRMVSRTYRTEAYNVFKLRKPNVGHSADRFRWICAPSEELLRVQRWINTHILSKVEPHEASYAYDNRHGVLDAAELHCGAQWLIKLDLTNFFESVLEPRVYELFRSFGYQPLVAFELARLCTRVRASGNPDRRFGNRELPAGLPYPADPRIGHLPQGAATSPRIANLVMQSLDESLHDYACDNELVYSRYADDLVFSSKNAFDRQEAIQHIKLIGKCLIEEGFWLNEAKTKIVPPGARKIVLGLLVDGDEPRLSKSYKKYVSDQLYYLSHPKIAPMAHAKRHGFQSLQGLINHVSGKIAYGFSIEPDWAKKQGKQLKGISGKLELDHVIFP

SEQ ID NO: 1680 - protein, 388 aa, Pseudomonas sp.
  source 1..388: note = Related to NZ_JH635998.1
MNRWSSQLYLKTGREVSVPDDTLQNAVKTAKQMKHGCPPIFTLKHLAHVANVPYPFLHRTISRTYRTEAYNVFKLRKPNVGHSPDRFRWICAPSEDLLRVQRWINTNILSRVEPHEASYAYDKRHGVLEAAELHCGAEWLIKLDLTNFFESILEPRVYDLFRSFGYQPLVAFELARLCTRVRSSGNPDRRFGNGELPAGLPYPADPRIGHVPQGAATSPRIANLVMQSLDESLQDYALEKDLVYSRYADDLVFSSKKAFDRSHAHQHIKSINARLIEGGFWLNEAKTKIIAPGARKIVLGLLVDGDTPRLPKSYKKFVSDHLYYLSHPAIDAKTHAKHRGFQSLQGLINHVSGKIAYGYSIEQDWAKKQGDRLKEICSKNELDHVLFP

SEQ ID NO: 1681 - protein, 388 aa, Pseudomonas sp.
  source 1..388: note = Related to NZ_CP007637.1; note = Pseudomonas simiae
MSRWSSQLYLTTGRKAGVPGDILQNAVQTAKQMEHGCPPILTLNHLAHLAGVPYPFLHRTISRTYRTEAYNVFKLRKANVGHSPDRFRWICAPSEDLLRVQRWINVHILSKVDPHEASYAYDKRHGVLEAAVLHCGAEWLIKLDLTNFFESILEPRVYKLFRSFGYQPLVAFELARLCTRVRKSGNPDRRFGNTTLPVGLPYSGDPRIGHLPQGAATSPRVANLVMQSLDENLQEYARENELVYSRYADDLVFSSKNAFDRSQVALHIKMINACLIKEGFWLNEAKTKIIPPGARKIVLGLLVDGDRPRLTKSYKKYVTDHLYYLAHPNIDAMTHARHRGFQSLQGLINHVSGKIAYGFSVEPDWARVNGARLKEICSKIQVDYVLFP

SEQ ID NO: 1682 - protein, 388 aa, Pseudomonas sp.
  source 1..388: note = Related to CP031146.1; note = Pseudomonas plecoglossicida
MTRWSSQPYLKEGRGLGVPQDILQNAVKTAKRMKHGYPPILTLNHLAHLTGVPYPFLHRTVSRTHEKEAYNLFALKKPNVGHSPDRLRWISAPCEDLLRVQRWINANILSHAESHEASYAYDKRHGVLEAAELHCGAEWLIKLDLTNFFESILEPRVYKLFRSFGYQRLVAFELARLCTRIRVSGNPDRRFDHRTLPAGFPYPADPRIGHLPQGAATSPKIANLVMYSLDEQLQAYATKNELAYSRYADDLVFSSSNPFDRPQAIEHVKAINECLIKAGFWLNKAKTKIIPPGARKVVLGLLIDGEQPRLTKAYRKYISDHLYFLSHPDIDAITHAEHRGFKSLQGLINHISGKIAYGYSIDPDWAKEHGNRLKMICRALEVDHVIFP

SEQ ID NO: 1683 - protein, 388 aa, Pseudomonas sp.
  source 1..388: note = Related to NZ_JAHSTV010000019.1; note = Pseudomonas farris
MNRWSSQPYLKAGRKSGVPEDILKNAVKTANQMKHGCPPLLTLNHLSHLTGVPYPFLHRTISRTYKTEAYNVFKLRKPNAGHSLDRFRWICAPSEDLLRIQRWINVHILSKVEPHEASYAYDNRHGVLEAAALHCRAEWLIKLDLTNFFESILEPRVYELFRSFGYQPLVAFELSRLCTRIRASGNPDRRFGNKTLPAGLPYHADARIGHLPQGAATSPRIANLVMQSLDENLQAYATENELVYSRYADDLVFSSRNAFDRSEAIQHIQSINECLVEEGFWLNKAKTRITPPGARKVVLGLLVDGEKPRLPKIYKKYVSDHLYYLAHPEIDAMTHAKHRGFQSLQGLINHVSGKIAYGFSIEPDWAKKQGAQLKAVCKTIEVDHVVFP

SEQ ID NO: 1684 - protein, 388 aa, Pseudomonas sp.
  source 1..388: note = Related to NZ_CP085704.1
MNRWSPQRYLKAGRQEGVSEATLQNAIDTAKQMKHGCPPIFSLNHLSHLIGTTYPFLHETVSRENEEEAYKVFRLKKPNVGHSPDRFRYICAPCEDLLRVQRWINNHILSRIEPHEASYAYDNRHGVLDAAALHCGARWLIKLDLTNFFESILEPQVYELFKSLGYQPLVAFELARLCTRLRVSGNPDRRYKNKTPPEGLPYTGDTRIGHLPQGAASSPRIANLVMRSLDESLQYFASENDLTYSRYADDLVFSSRAEFDRSQATQHIKAINNRLVDEGFWLNKAKTKIVTPGTRKIVLGLLVDGKKPRLPKSYKKYVSDHLYYLSHPTIDAMAHAESRGFQSVQGLINHVSGKIAYGFSIEPVWGKEQGDRLRGVCRELDLDHVIFP

SEQ ID NO: 1685 - protein, 388 aa, Pseudomonas sp.
  source 1..388: note = Related to NZ_CP061943.1
MTRWSSQPYLKAGRQAGVSESILQNAVQTAKQMKHSCPPIFTLKHLAHLTDVPYPFLHRTISRKYRAEAYNVFKLKKQNAGHSPDRFRWICAPTEDLLRVQRWINTHILSKIQPHEASFAYDNRNGVLETAQLHCGATWLIKLDLTNFFESILEPQVYELFRSFGYQPLVAFELSRLCTRVRASGNPDQRHGNKPLPPGLPYSGDTRIGHLPQGAATSPRIANLVMQSLDETLQTYATENDLMYSRYADDLVFSSKGVFDRPQATQHIKAINKCIAEEGFWLNTAKTKIVTPGARKIVLGLLIDGGTPRLSKAYKKHVSDHLYYLAHPKIDAMAHATRRGFHSLQGLINHISGKIAYGFSIEPDWANEHGKRLKGICAKLHVDHVLFP

SEQ ID NO: 1686 - protein, 371 aa, Pseudomonas sp.
  source 1..371: note = Related to NZ_UVZC01000005.1; note = Pseudomonas viridiflava
MPEDVLQNAVKTAKQMKHGCPPILTLNHLAHLTGVPYPFLHRTISRTYRKEAYNVFTLRKPNSGHSPDRVRWICAPSEDLLRLQRWINTNILSKVEPHEASYAYDSRHGVREAAELHCEAQWLIKLDLTNFFESILEPRVYELFRSFGYQPLVAFELARLCTRIRARRNPDQRHGNKSLPPGLPYSRDSRIGHLPQGAATSPKISNLVMQSLDETLQAYAEDNELVYSRYADDLVFSSRKPFDRSQALQHVKSINQCLVEEGFWLNKAKTKVITPGARKVVLGLLINGKKPRLTKAYKKYVSDHLYFLAHPDIDAITHAEHRGFKSLQGLINHISGKIAYGYSIEPDWAREQGNRLKVICAAHEVDHVIFP

SEQ ID NO: 1687 - protein, 387 aa, Pseudomonas sp.
  source 1..387: note = Related to CP024630.1; note = Pseudomonas aeruginosa
MKRWSPQAYLKAGRAAGIPEDVLQSAVKIAAQMHEGCPPIFSLKHLANLTGVPYPFLHRTISRTYKTEAYTVFMVHKTNVGHSPDRFRTICAPSPELLKAQRWINKYILSNIPSHHASYAYEGRNGVLEAANVHCQATWLIKLDLTNFFESILEPKVFTLFRSLGYQPLVAFELARLCTRTRKTGNPRVMSRAGGGSPALPYKNSLIGHLPQGAATSPKIANLVMRSLDEKLFKFAQDNDLIYTRYADDLIFSSRQPFDRTVPSAYILAINQLLRAEGYWPNRAKTKVVTPGTRKVVLGLLVDGSEPRLTKTYKKYVRDHLYYLSHPEISPELHAKRKGFRSLQGLINHVSGKIAYGISIEPEWGTAQGEKLKEICQKWQVDHVLFP

SEQ ID NO: 1688 - protein, 387 aa, Pseudomonas sp.
  source 1..387: note = Related to NZ_AVEP02000116.1; note = Pseudomonas avellanae
MKRWSPQSYLKAGHAAGIPEDVLQNAVKIAGQMLDGCPPIFSLKHLATLTGVPYPFLHRTIDRTYQTEAYTVFRLQKASVGHSPDRFRYICAPCPELLRAQRLINKYILSNLTPHHASYAYDGRNGVLEAASVHCQATWLIKLDLTNFFESILEPQVFKLFRSIGYQPLVAFELSRLCTRVRVRGNPDTKFWSGELSSSFPYKDSRIGHLPQGAATSPKIANLVMRSLDEKLYDLASKNELIYTRYADDLIFSSRQTFDRALASRHIRAVNQVLREEGYWLNRAKTKIVPPGTRKVVLGLLVDGPVPRLTKSYKKYVSDHLYYLSHPEVSAEAHAARRGFNSLQGLINHISGKIAYGISIEPLWGAEQGQRLRQICGRLLVDHVMFP

SEQ ID NO: 1689 - protein, 387 aa, Pseudomonas sp.
  source 1..387: note = Related to MKGS01000151.1
MNRWSPQHYLKAGRAAGIPEDVLQNAVSIAAQMHEGCPPIFSLKHLANLTSVPYPFLHRTISRTYQTEAYTVFRLQKANIGHSPDRYRYVCAPSPEMLRTQRWIHKHILASLKPHHSSYAYEKRNGVFEAASLHCQCIWLIKLDLTNFFETILEPRVYKLFRSLGYQPLVAFELTRLCTRIRPRGNPENRLWRGELTENLPYIGSAVGHLPQGAATSPKIANLVMKSLDEKLYEFASLNELTYTRYADDLIFSSTKSFDRALASKHIETINKLLRDEGFWINRAKTKVVTPGARKVVLGLLVDGAEPRLTKDYKKYVSDHLYFLSRLDIDAEAHAKRKRFDSVQGLLNHLSGKIAYGISIEPKWGAERGTKLRQICDRLSLDHILFP

SEQ ID NO: 1690 - protein, 382 aa, Pseudomonas sp.
  source 1..382: note = Related to NZ_FYDX01000020.1
MNRWSPQRYKSEGLNQGVDQNTLSNALSTAELLRANSPKLPPIFTLRHLAHEAGVPYALLRAVVARSERAEAYKVFKLKKAVASFGANRFRYICVPHPSLLKVQRWIHKHILMQVDAHPASYAYKEKTSPCDAATMHAGCTWMIKLDATNFFESILEPDVYFVFRDMGYQALVAFELARLCTRVRPTGNPVKANRVKEGQGNLPYRTIKIGHLPQGAATSPLLSNLVARKLDCALTGLANDRGLTYTRYADDLTFSSFGDFDRDISTNLVREIYEIMRTHGLWPNKSKTKIIPPGARKVVLGLLVDGPVPRLTKEFKAEVRTHIHFMLRPDVGVRKHLRARKFDTPWGMQNYLFGKLAYAQPIEPRWTARMRDLLRKIDWTS

SEQ ID NO: 1691 - protein, 382 aa, Pseudomonas sp.
  source 1..382: note = Related to NZ_CP061723.1; note = Pseudomonas putida
MNRWSPQRYKSAGLNQNVDKGVLNNALRTAQLLHANFPLLSPILTLRHLAHEAGVSYGFLRGVAARSERVEPYKVFKLKKNVVSFGANRFRYICAPHPSLLKMQRWIHKNILMHVHSHPASYAYKEKTSPRDAAAMHAGCKWMIKLDATNFFESILEPDVYRVFREMGYQALVAFELARICTRVRPSGNPVKTDRFKDGMGNLPYKNVAIGHLPQGAATSPLLSNLVARTLDHSLAEFANSKDLAYTRYADDLTFSSFGTFNRDGAENIVREIYEIMRAHGLWPNKSKTKIIPPGARKVVLGLLVDGHVPKLSKEFKAEVRTHIHFMLRPDVGVSNHRKARKFDNSWGLKNFIFGKLAYAQAIEPIWTSRMRDLFMKIDWDS

SEQ ID NO: 1692 - protein, 382 aa, Pseudomonas sp.
  source 1..382: note = Related to NZ_LHVL01000030.1
MNRWSSQHYIRIGNDQGVAPAILKTAAETAKHLHKCNPNFPPVFTLRHLAHYTGVPYGFLRMVVARNKQVEPYRVFKLKKQVRSFGRERFRFVCAPHPYLLKAQRWINREILAKIPGHEASYAYSPGSSVYDAASMHAGCRWLIKLDATNFFESILEPKIYEIFRTIGYQPLVAFELARVCTRTRPSGNPVYSNRADPNKKGLPYNTVQIGHLPQGAATSPHLSNLAARDLDESLKNFALLNQLIYTRYADDLTFSSTEEFVREDVVKKIHEIYGFMRANGLWPNKSKTQIVPPGARKIVLGLLVDGAQPRLTKEFKQEIRTHLHFLQRSDIGVRKHLKARGFDSFWGLRNFLVGKLSYAKSVEPEWESKMNRLFVKINWDT

SEQ ID NO: 1693 - protein, 375 aa, Pseudomonas sp.
  source 1..375: note = Related to JACVBX010000001.1
MTRWSSQLYIKEGRSKDVPRDILRDAARTAELLISPDLPPVFTLRHIAHLTGVPYNFLREVVSRSSDPYRVFKLKKNSPNLVGRYRYICAPHPKLLKVQRWINREILESLQPHEASYAYTKGAGVLKAAEVHSGCRWMIKLDVTNFFESILEPRIYKIFRGLGYQPLVSLELARLCTRVRPYGNPVYRNKQDANLPGLPYMVAEIGHLPQGAATSPLLSNLAVYELDKELSSYSIEHELTYSRYADDMVFSSEAKFSRSAVLVMVHELYDIVRKHGLWPNRVKTKIVSPGARKVVLGLLVDGKKPRLTSEYKQEVRTHLHFLLREDIGVEKHLVKRGFDSRFGLRNFLLGKIAYAQHIEPKWAGEMRNMLHLVKW

SEQ ID NO: 1694 - protein, 388 aa, unidentified
  source 1..388: note = Related to NZ_CAKLIV010000056.1; note = Pectobacterium versatile
MNSWNSQLFKTEGRARGIPNEILDNATKIAKQLKYAGLPPIFTLNHLSHLCGVKYSTLRYIVERKHNDDAYKVFKLKKSGVGFSDERVRFVSVPNSELFKVQRWIHNNILKLIPAHENSFAFHSNGGILKAAYPHCNKKWMIKLDVSNYFESILEPTVYNAFLKMGYEPLVSFELARICTRVKPHHNPVKKNRINWLLNTDLPYKTIEIGHLPQGAPTSPLLSNVCSIKLDELLSDFAGVNNLTYTRYADDIVFSSADFFNRDLCNGYIKSVYSIMRENNLWPNRTKTKIIPPGARKIVLGLLVDTDRPRLTKEYKKEILTHLYYIFNESIGLEKHCKARGFDSVYGFLNFINGKLTYANFIDPEWSKPLIYKLKCVARPYIDLDSSC

SEQ ID NO: 1695 - protein, 385 aa, unidentified
  source 1..385: note = Related to JACVUO010000002.1; note = Pantoea sp.
MKIWSPHLYISQGIADGVSPDVLNSAVATAKKLRYLDLPPVFTLKHLSVLSGVSYSSLRFIVQRRDPSSNYKTFKLKKSNAGFHPDRVRFISVPEPSLLIVQKWIHEHILKKIPHSKSTMAFHADGGILKAAIPHCGNNWMIKIDIKNYFESISEVKVYDAFVQAGYQPLISFEMARLCTRVRNKSNPIKMYRHDDTLGTQLPYTTVEIGHLPQGAPTSPLLSNICTKKLDASFFEFSIAHGINYTRYADDIIFSSRSFFSRDICVSLIKEIKYILNKNGFWPNEAKTKIVTPGARKIVLGLLVDGPVPKLTSEYKKEILMHLHFASRKDIGIISHCNRRGFKSVTGFLNYLEGKISFASSIEPLWARKVNATFVYIKNKYNNTI

SEQ ID NO: 1696 - protein, 382 aa, Pseudomonas sp.
  source 1..382: note = Related to NZ_LPNO01000008.1
MTNWSPQHYVETGEQHHVSAAVLNAALKTASVIRSRNKDVPIIFTLGHLAALTGVPHSFLRAVITRDDFAPYKVFKLRKRSAGFAKDRFRFICAPHPKLLRVQRWINERILKHIPIDIASYAYRENTSIQDAAIQHCECNWLIKLDMSNFFESILEPKIYRVFRELGYNRLLSLELARLCTRIRHFGNPSMPKEKKLLKKFPYRKSRFIGHVPQGAATSPLLANIVSRGLDASIREFSRTMNITYTRYADDLIFSSKSKFDRQGAHSLVKDLYELIKAHGYWPNLTKTKVSPPGARKIVLGLLVDGRTPRLTKEFKSEIKTHIHFITRPDVGIAKHMLNRGFDSTAGLRNFLYGKLSFAAHVEPLWAAKMRSKLDQVNWPKR

SEQ ID NO: 1697 - protein, 382 aa, Pseudomonas sp.
  source 1..382: note = Related to NZ_LIGO01000012.1; note = Pseudomonas corrugata
MTNWSPQRFLETGKQRLASPLVLEAALQSAKLIKSRNKNVPVIFTLGHISAHTKVPYHFLREVITRENLKYYKVFKLQKRNAGFTKKQVRFICAPHPYLLRVQRWINERILKHIPIDDSSYAYRANTSIADAAFQHCECRWLIKLDLSNFFESILEPKVYKVFRELGYNRLLSLELARLCTRTRNYGNPSISREKISQKKLPYIKNKYIGHVPQGAATSPLLANIISRDLDVSLKQFSKNLGLVYTRYADDLIFSTKTDLTRAQLNQHINELYKIIKSHGYWPNFTKTKISPPGARKIVLGLLVNGVTPRLPKEFKAEIKTHIHFISRSDIGVAQHMANRGFESAEGFRNFLYGKLSFANHIEPDWAARRKCELDRVDWAGL

SEQ ID NO: 1698 - protein, 388 aa, unidentified
  source 1..388: note = Related to NZ_CP014579.1; note = Paraburkholderia phytofirmans
MVNWRSQHFINEGRQQGIAEPLLRNATLIARRIQAVNADLPPLFTLRHLSHEVGVPYLALRSIVSRKFTCEPYRVFSLRKKNVGHGSRRFRVICVPDPALLKTQRWIHSRILKFGRCHEASGAYSKGSGIYDVASTHCNARWLVKLDVTNFFDAILEPKVYQVFARLGYQPLMAFELARLCTRLRHDGNPKRKSKTGYRKIWTYGSSVVGHLPQGAPTSPLLANLVAYDLDSELFALAENANVRYTRYADDIVFSSSEKAFTRSDAEGLIRGAYACLERHGLWANRAKTHVVSPAARKIVLGLLVDGPVPKLQREFKDKLRMHIHYLHHPQIGPVEHARRRGFDNVLGLQRHLLGLAAFAMGIEPAWGRQQMDEIKRANWPIGIPPFK

SEQ ID NO: 1699 - protein, 388 aa, unidentified
  source 1..388: note = Related to NZ_CADETV010000001.1; note = Burkholderia anthina
MVNWRAQQFINEGRQRGVSAPILQNAVQIARQIQSVSNDLPPLFTLRHLAHEVGVPYLALRGIVSRQFIDEAYRVFTLRKRNVGHDSRRFRVICVPNPALLKTQRWIHSKILKLGRCHEASGAYSKESRIYDVASIHCNARWLVKLDVKDFFDSILEPKVYQVFIKLGYQPLVAFELARLCTRTRYTGNPKRRSKRQYPKIQGYRNPVVGHLPQGAPTSPLLANLVAYDLDSELLALAGKTNVRYTRYADDIVFSSADKAFTRADAEKLIDETYACLKQHGLYPNRAKTNIVSPSARKIVLGLLVDGPTPRLQREFKDRLRMHIHYLHHPQFGPVEHAKRRGFDNVLGLQRHLLGLAAFAIGIEPVWGRQQMEEIKRATWPIGIPPFK

SEQ ID NO: 1700 - protein, 390 aa, unidentified
  source 1..390: note = Related to QBTZ01000001.1; note = Acidovorax sp.
MNHWNSQRYLASGRSQKRAANVLANAASTAELIRKAAPGAAILFTLNHLARETGVPYHYLRSVTERGGLNSNTFYRVFSLKKHNGGFRGKRTRTICAPEPLLMKTQRWIHEHILTKGCPHSASSAYRPGSRIRDAAEQHRNARWLVKMDVTNFFESILEPKVYEVFRSFGYQPLMAFELTRLCTRIRKGGPKRHKVNDTARIGRYSSGSLGHLPQGAPTSPLLANLAAFDLDCELNSLATSNGMVYTRYADDIVLSSSAEDWSKSKAVTLLKQGHDILKAHGFQPNLAKATIAGPGGRKLVLGLSVSGAEPRLTRDFKNKLRAHIHYLQKYQSQGIPPHEKLKFDSRLGLQRHVFGLAYYAIGIERAWGAARLAELKALPWPVEHGISFV

SEQ ID NO: 1701 - protein, 389 aa, unidentified
  source 1..389: note = Related to NZ_LMHZ01000013.1; note = Noviherbaspirillum sp.
MNHWQSQRYLKEGLATNKNIGLLNRAIATAEAIRAVNPHAPPILTLNHLAHETGVPYDFLRGVVTRGGSSDHSFYHVFTVKKNNVGHAHGRTRTICVPHPMLIKAQRWIHENILQFGRFHEAACAYRPGSKIVDTASLHCEARWMVKMDVTNFFESILETKVYKVFRSFGYQPLVAFELTRICTRIRKESPRRIQPSKAGISSYANNYVGHLPQGAPTSPLLANLAVYDLDKELSLLARQNGMIYTRYADDITFSSVTSTWSRAKAVQLLCDGHAKLKSHGFWPNHAKAHIVSPGSRKIVLGLTVDGTAPRLTKQFKNTLRAHIHYLERFQLSNRPPHQVLGFDSILGLQRHVFGLAYYAMGIERGWGAARLAELKSISWPAEHGIAFD

SEQ ID NO: 1702 - protein, 383 aa, unidentified
  source 1..383: note = Related to CABFMN010000087.1; note = Xylophilus ampelinus
MTSWDSQHYLSSGLVAGIDAGLLARVDATARRMLAVNPTATVIVSLGHLASLCDVPYGYLRRVIRRDATLEPYRVFALARGGHGPTRRPRTICAPEPLLLRAQRWIHANVLQHAKAHAASTAYAKGCSVVEAARVHCGASWLIKLDVSNFFDSILEPKIYQVFLAQGYQPLVAFELARLCTRVRSKGNVARSTGSGVPGPYVYPSIGHLPQGAPTSPLLANLVSFAFDEEVSQLARRFCLRYTRYADDMTLSFRGTGFDRTKAREVIGACYRIMLDHSLWPNRTKTQVIPPGARKLVLGLLVDGNRPALTREFREQMRMHLHFLETQGPVSHAQHRGFGSVIGLQNHLFGLAAHAMGVNKAIGRDWMYRLQRLPWPAAFEMPV

SEQ ID NO: 1703 - protein, 402 aa, unidentified
  source 1..402: note = Related to NZ_VUYU01000002.1; note = Massilia rubra
MTHWQSQLFEVDAPPDAPVDAALAIANAIRSINPLLPPLFTLSHLAHETGVPYKYLRNTVARGKVDEQYSVFRIQKRAPSATIQYRWIAAPHPLLLKTQRWINTNILKNIAVHNAAFAYIKEGSAYKAACLHNQAKWLVKVDIRNFFESILETKICKVFETAGYQPLLAFELSRICTRIATPEMERALAPNGRVPNSLKGLKYSISAYNSFALGHLPQGAPTSPMLANIVAKEIDDEISSLAEKYKLRYSRYSDDIVLSTPSTQFGKEMCKEVVGKLYRILLSAGYQPNVEKTKISGPGSKMIVLGLLVDGKTPRLTSEFKSKLRMHLFYCRTRSPQQHAVKRKFASLLGLKNHLIGLISYAGTIDAAFASKCYAELNACSWPIFDSADFDSIIESTVKILR

SEQ ID NO: 1704 - protein, 399 aa, unidentified
  source 1..399: note = Related to NZ_WKJJ01000024.1; note = Massilia rivuli
MSNWQSQLFKQDAPPGAPVSAAIAIASEIRSTNPFLPPLFTLAHLAHETGVPYKFLRSVVARTGATEHYTVFKIKKRSQNAIKQYRWIAAPHPFLLRVQRWINDNILKKLPVNEAAFAYLEDRSAYKAAIVHKNAKWLMKVDIENFFETVLETRIYKIFLDAGYQPLLSFELSRICTRIANPELERAYSINGFAKVKTKGTKYVIEAYASSALGHLPQGAPTSPMLANLIAKDIDEKIAELADRFDLRYTRYSDDIVLSSKSNDFGKANAAKAIGQLYAILRRAGFQPNMEKTKVSGPGSKMIALGLLVDGNKPRLTSEFKDKLKMHLYFCRTRSPQAHAVARKFDSVIGLKNHLLGLISYARMVDSSFADECLAQMNSCHWPITGPIDLSLILESLKA

SEQ ID NO: 1705 - protein, 305 aa, unidentified
  source 1..305: note = Related to RKJT01000001.1; note = Burkholderia pseudomallei
MAAPHPLLLRVQRWINTEILSKLQQHPASYAYRSGRCAFDAARRHQRARWLVKADVTNFFESILEPDVYSIFRSAGYQPLIAFELARICTRVRTVDEINPKDLRTSRTKSAAYKIQAYRSAYIGHLPQGAATSPLLANLVANPLDVTLSQVATRTGFRYTRYTDDIAFSSASLDTTRADAVSVAGAIHSALYKHGFSPNLAKSVIRGPGHRRIVLGLLVDGDRPRLTSEFKDTLTLHLRHLEMSGPIEHAKARGFHSIVGLKHHIDGLIAYAKGVDEAFAAKCAQKLGRVSWPLLTPLDLDAIVP

SEQ ID NO: 1706 - protein, 363 aa, unidentified
  source 1..363: note = Related to JAAUUP010000100.1; note = Deltaproteobacteria bacterium
MESKGVAVVLSLSHLSKLTGASYWSLRQVISRHGDMPYRPFRIPKRSGGARLIFEPHPMLRHVQRWILDSILSKVRPNDNAYAFVQGRNAIDAARKHCGAKWLVKADIVNFFESIQEFKIFKVFADIGYGPLVGFELSRLCTYPYRVGHPRYEQPEWTHRLGQEHGENGYIGSYFGSYFDSRIGHLPQGAPTSPALSNFTCKWLDQKLARYAEMHEWEYTRYADDIVLSKVAANRAEAIEALNYVRWVAARSGFMLNSKKTKIVPPGARKIVLGLLVDGDRPRLTKKFQNDLDMHCHYGLKLGAKRHSERRHFRSVLSFLDHVQGKISFAFQVDPLRAEGWASKFLIIRSEYLASVGSDVCNG

SEQ ID NO: 1707 - protein, 387 aa, unidentified
  source 1..387: note = Related to JAIUHI010000001.1; note = Mesorhizobium sp.
MSAPSPQRYASGASRQGIDAVTLENALATLARIRATDPRITPVLTLRHFSVLTELPYLFLRRTVARRGHAEYRFVLLKKRIPGRSAKRMISIPPKSLAVAQRWLVDHVLRYAPVHPVSFAFHPESSPVQAAEQHPNTKWLLKVDIEDFFHSVSEGTVSAIFTRLGFPKLLAFEFARLCTIGLDRGPGKNPAPHAGPISFYALGYEGFLPQGAPTSPMLANLAMLRIDTLLASLAEERGLRYSRYADDLTFSTDTDRTLVEMRRLQRDVCGILNDSGFRHNQRKTGIRGPGTRRIVLGMLVDGPMPRLQRAYKDMIRLHLHYLSSPAYGPAKHALARKTGVSSLYHHVRGLISWAQQVEPAFGQQALEQFASADWPPIQPRQIEGRLG

SEQ ID NO: 1708 - protein, 388 aa, unidentified
  source 1..388: note = Phyllobacteriaceae bacterium; note = Related to JAAYVT010000069.1
MSTPSPQRYASGARQRGVDPATLKNALATFARIRTTDPRITPVLTLRHFSVLTELPYRFLRGTVARSGLVEYRTVYLKKRIPGRSAKRMISIPPPSLASAQRWIVDHILRYARVHPASFAFHPDSSPVHAAEQHPNTKWLLKVDIEDFFHSVSEGTVSAIFFRLGFPKLLAFEFARLCTISIDRGRSRNPAPHAGPITAYAYGYEGFLPQGAPTSPMLANLAMLRVDALLADLAEERGLRYSRYADDLAFSADNNRSLAEMHRLQRDVCQILNDAGFQHNRRKTVIRGPGTRRIILGMLVDGPTPRLQRAYKDIIRLHLHYLASPAYGPAKHALARKTGISSLYHHVRGLIAWAQHVEPAFGRQALEKFTSVNWPTIQPRWVERGSND

SEQ ID NO: 1709 - protein, 389 aa, unidentified
  source 1..389: note = Related to NZ_VCDI01000012.1; note = Lichenicoccus roseus
MAAPSPQRYLSGGRRQGVATVTLDNALAAFARLRETDPRITPVLTLRHFSVVTGLPYFFLRRSVARRAHIGYRFVYLRKRIPGRSSMRMISIPPPSLAAAQRWLVDNVLRYVEPHPASFAFHPDSSPVLAAEQHPDTQWLLKVDIEDFFHSVSERHVSAIFASLGFPKLLAFEFARLCTIGLDRGPGRNPAPHPSPIALYQSNFEGFLPQGAPTSPMVANLAMVRTDEFLSMLAEARGFRYSRYADDLAFSSDKSRTIAEMRGLQREVCRILNEAGFRPNHRKTVIRGPGTRRVVLGLLVNGPTPRLSRAFKDNIRLHLHYLTSPDHGPAKHALARKTGTSSLYHHVRGLIAWATQVEPAFGAAALRTFRSASWPLIQPQEVGEEDDWL

SEQ ID NO: 1710 - protein, 394 aa, unidentified
  source 1..394: note = Related to NZ_CP010954.1; note = Sphingobium sp.
MPVPSPQRYASGGRRQGIDSQTLDNAIAAITRIRATDPRITPVLTLRHLSVLTELPFLFLRRKVARQERVGYRTIFLKKRIPGRSSMRRISIPPKSLAHVQNWLVQNVLQYTSAHPASFAFHPDSSPILAAEQHPNTKWLLKVDIQDFFHSISEGTVASIFSRLGFPKLLAFELGRLCTIPCNRGPSRNPKPHPSPIEFYRSDFEGYLPQGAATSPMLANLAMSMTDQRLSALAEKFGFRYSRYADDLAFSSPNDHALADLQKLKRNVFHILNSSGFRPNLRKTVIRGPGARRIVLGMLVDGKEPRLSKEFKDNIRLHLYYLTSPQHGPQKHALSRKTGVSSMYHHVRGLIAWARQVEKTYGEEALAKFKSVNWPPIQPRMVHCSLDDLRDKDD

SEQ ID NO: 1711 - protein, 344 aa, unidentified
  source 1..344: note = Related to NZ_BAJW01000019.1; note = Acetobacter persici
MRHLSALTGLPFLFLRRTVARKEHVNYRKVYLKKRIPGRSTKRLILIPPKSLAVAQGWLVQNVLRYTVAHPASFAFHPESSPVQAAEQHPSTKWLLKVDIQDFFHSVSEGRVSAIFAGLGFPKLLAFELARLCTVAADRGAGRNPQPFAGPINYYDNPFEGFLPQGAATSPMLANLAMLSVDEALSGIAKRTGFRYSRYADDLAFSTKKDSSVAQMNRLKREVIAVLNDNGFRPNLRKTVIRGPGSRRIILGMLVDGPDPRLSKEYKDNIRLHLYFLTSQKHGPQKHALSRKTGVSSLYHHVRGLISWAKQVEPAYGQLALEKFQTADWPPIQPRRIFKIEAEF

SEQ ID NO: 1712 - protein, 388 aa, unidentified
  source 1..388: note = Related to NZ_SLXP01000012.1; note = Rhodovulum marinum
MPAPNPQRYRSQGRLEGVDDTVLDHAVETFERIRAVDPRITPVLTLRHLSHLTDIPFLHLRDLVGRRAHRPYKFFYLKKRIPGRNRVRMISVPNGTLMSLQRWIVDNILQFTRPHAASFAFHPDCRPYEAAAEHCGCAWLLKIDLEEFFHTVSEGRVAAVFENLGFPRLLSFEFARLTTVACERPGSRPDPGERWPAIPYYQCEHEGMLPQGAPTSPMLANLAMLKVDEILSALAEEYGMTFTRYADDLAFSCGEEYDFAHVQRFKRLVLEKLNKSGFRPNHRKTVIRGPGTRRIVLGMLVDSERPRLPREYKDNIRMHLHYLTSESHGPSVHAASRQTSVSGIFHHVRGLIAWAETVEPDYGARALENFESVDWPPLEPNRLLGHRG

SEQ ID NO: 1713 - protein, 390 aa, unidentified
  source 1..390: note = Related to JACIJP010000010.1; note = Sphingobium subterraneum
MSLPSSQRYRSQGRREGVDDAVLNNALAAMRRIRAVDPRITPVLTLRHLSHLIDVPFLHLREIVARRARRPYKFFYLKKRIPGRSRMRMISAPNATLLKIQRWIVENILQYTTAHEASYAFHPGSRPFDAAQEHCGCEWLLKIDLEDFFHSISEGRIAAVFAHLGFSKLLSFELARLVTVGCERPGTRTDPAIRWPAIPYYQSKHEGMVPQGAPTSPMLSNLVMFKTDEILARLADAHGMKYTRYADDLAFSCGPGKNEIHVRRFMRLVLDQLNHAGFRPNHRKTAIRGPGSRRIVLGMLVDSDRPRLTREYKDMIRLHLHYLTSPSYGPALHALARKTSVSGIFHHVRGLIAWSQIVEPDFGAGALTRFEGVDWPPVQPDPYDEEANDT

SEQ ID NO: 1714 - protein, 389 aa, unidentified
  source 1..389: note = Related to JFYY01000007.1; note = Sphingomonas paucimobilis
MPPGPQRYRAQGRREGVDETVLANALSVIDRIRAADPRITPVLTLRHLSELVGVPYPHLRDLVARRVPRSYKFFYLKKRIPGRTSTRMISVPNKTLLSIQQWIVSDILRFTSAHEASYAFHPGGRPLEAAEEHCGCAWLLKVDLQDFFHTISEGRVAGIFAELGFNRLLAFELARLVTVACERAKPSDPAARWPTIPYYQCAHEGMLPQGAPTSPMLSNLVMHRTDGVLARLARAHGMRYSRYADDLAFSCGADRDAAHVRRFKRLVLKSLNEAGFRPNLRKTTIRGPGSRRIVLGMLVDGDRPRLPKGYKDMIRLHLHYLTSPDYGPAAHAQARKTSVSGIFHHVRGLISWAETVEPAYGKQLLARFWSADWPPLEPTYLDDLSEDGD

SEQ ID NO: 1715 - protein, 391 aa, unidentified
  source 1..391: note = Related to NZ_JACONT010000017.1; note = Sphingomonas albertensis
MPAPAPQRYRSEGRRKGVPPDVLANALASISRIRDTDPRIEPVLTLRHLAFLTDVPYRYLRQVVARSAATGYRTFRLKKRVPGRSRMRTISVPPPSLKEVQRWIVENVIQHVAPHEASYAFHPGSSPYLAAEEHCECSFLLKVDVQDFFHSIGEGSVAAVFEAIGFQKLISFEMARLVTRPIPSSKPAPDPAARWVAIPYYNYPHEGVLPQGAPTSPMLANLVMRHADQRLANLATRMGMRYTRYADDLAFSAPHGSAIALADMRRCRTQVLRILNEYGFSPNLRKTVIRGPGSRRIVLGMLVDGDRPRLAREFKDNLRLHLHYLTAPSHGPAAHAMARKTGVSSMYHHVRGLISWAQCVDPEYAADALALFRTANWPLVQPRWSGASDDD

SEQ ID NO: 1716 - protein, 387 aa, unidentified
  source 1..387: note = Related to NZ_BPQL01000193.1; note = Methylobacterium goesingense
MNLPNPQRYRSEGRSLGVDEITLDNAIATIKRLQASSPSLPAVFTLRHLAHLTQVKYGYLRYIVRRKVNYRHFRISKKLPGRNRYRLISIPPANLSKLQRWISNNILRHLSPSSASYAYHPGSNPRFAAEQHCGCEWLIKIDVQDFFHAISEGRIAEIFYKAGYPRLLSFELARIVTCVLPGTIKRAASYSARWPVISQYQHDREGVLPQGAPTSPMLSNLAMRALDERLIALAAKNGMIYTRYADDLVFSCKNRTKPTIDKVKRSILRELSREGFQPNLRKTAVRGPGSRRIVLGVLVNGKEPRLTRDFKENLRMHFHFLTSEKHGPHNHANNRGTSISGIYHHVRGLIAWAKVIEPAYGANLMVRFHSINWPSLQPHSIFEDMEK

SEQ ID NO: 1717 - protein, 386 aa, unidentified
  source 1..386: note = Related to NZ_CP030037.1; note = Bradyrhizobium sp.
MSLLSSQRYRSRGRRLGIDPTTLERAVATIERIQRSDPRLTPILTLRHLSELTGAQYGYLRRVVGRILGGYRHVHFKKRIPGRSRRRVISIPPRRLLEVQQWIAQNVLRFAEPSRASFAYHPSSSPVLAAEEHCGCEWLLKVDIVDFFHSITEGRVSAVFYRLGYPRLVAFELARLTTMQLIRGALQRDAERWSAIPYYQSEYEGVLPQGAPTSPMLSNLVMKDLDERLIELSKQHGMRYTRYADDLAFSCGKGRDRSHVERFKRLVLAELSREGFNPNLRKTVIRGPGTRRIVLGMLVDGPSPRLPREFKDMLRLHLHFLKSEGHGPSAHAQKRRKSISGLYHHVRGLIGWAMSVEPDYGARILAEFERVAWPPVQPRWSERPDR

SEQ ID NO: 1718 - protein, 416 aa, unidentified
  source 1..416: note = Related to FNXB01000037.1; note = Rhizobium tibeticum
MLVSRSDIFMLRNGTSLSRRRLGGASCHYPPNGVKVMQSWSPQQYRYDGAQHGVSDETIESVIARVELIAAVNPSITPVLTLRHLSELCGVEYGFLRRIVSRSTVPYRVFSLRKRIPGRTRHRLICVPRNELKAAQDWIVRNILRHTKAHGASFAYHPKSRPELGAHRHCGCDYLLKIDITDFFHSVSEGRIFRIFAELGFSELVAFELARLTTIIAQGTERPDWIAAARWPAIPAYQTSYEGFLPQGASTSPMLSNLAMLALDARIAGMASDAGLVYTRYADDLTFSGRKPHDLKSMKRFKRKVFDALNEAGFRPNLRKSSIRGPGARRIVLGMLVDGPRPRLAKEFKDDLRKHLHYLRSKDYGPAKHAAANKTSISAMFHMVRGLIGWATRVEPQYGRSCLVEFRKVVWPPLIP

SEQ ID NO: 1719 - protein, 428 aa, unidentified
  source 1..428: note = Related to RPNF01000004.1; note = Sinorhizobium meliloti
MGILDVQSIGFSMLVSRSDIFMLRNGTSLSRRRLGGASCHYPPYGVKVMQSWNPQQYRSDGAQKGVASETIESAIARIKLIGAANANVTPVLTLRHLSELTGVDYGFLRRVVSRSIVPYRAFSLQKRVPGRTRHRLICIPRDELKSVQDWILRNILTHTKAHEASFAYHPRSRPELAAQSHCGCHYLLKIDVQDFFHSVSEGRIYQIFVDLGFSELVSLELARLTTIIAPGTGRPDWVAAVRWPNIPAYQTPYEGFLPQGAPTSPMLSNLAMVALDARISAMASKAGIVYTRYADDLTFSARAPHDAISLKRFKREIFAVLNEAGFRPNLRKTSIRGPGARRIVLGMLVDGPRPRLAKEFKDDLRKHLHYLKSPDFGPAKHAAANKTSVSAMFHMVRGLIGWATRVEPEYGRSCLVEFRKVVWPPLTP

SEQ ID NO: 1720 - protein, 383 aa, unidentified
  source 1..383: note = Related to LXKM01000017.1; note = Agrobacterium sp.
MQSWSPQHYRFHGTTENVPESILESAISRIELIRARNPNITPVLTLRHLSLLADVDYVFLRRVASRSTHPYRAFMLKKNVPGRTRLRLICVPNKNLKKIQDWIVRNILRHTRAHRKSFAYHPYSRPEFAAQAHCDCDYLLKVDIEDFFHRVSEGRVYKIFCDLGYSELVSLELARITTTVAEGTERPIESIHFRWPAIPAYVSPYEGFLPQGAPTSPMLSNLAMLGLDEQLDSMAREEGIVYTRYADDLTFSARRPHNAATIKRFKRRVLALLNDTGFRPNHRKTMIRGPGARRIVLGMLVDGPKPRLPNEFKDEIRKHLYYLQSEKFGPAHHSAANKVSISTLYHIVRGLIGWAARVEPEYGRRCLQQFKLIEWPPIDRGSS

SEQ ID NO: 1721 - protein, 446 aa, unidentified
  source 1..446: note = Related to NZ_QJKM01000019.1; note = Rhizobium terrae
MGTTGVQSIGFSMLASRSLFFMLRTGTSLYRRRLRYASRQYPPNGVKVMQAWSPQHYRYEAERHGVQDETIDNAIARIELIVANNANVTPVLTLRHLSAMSGVEYGFLRSVISRSMMRKKYRVFSLRKNVPGRTRYRLICVPNEELKTVQDWIVRNILRHTRSHPASYAYHPKSRPEFAAKAHCGCDYLLKVDIQDFFNRVTEGKITRIFRDLGFSDLVSFELARLTTVTAQGMELPEGLSERRWPAIPAYQSRYEGFLPQGAPTSPMLSNLAMLALDEKLQELASSEGISYTRYADDLTFSARKPHDFESIKRFKRKVLTELNAAGFRPNLRKTHIRGPGMRRIVLGMLVDGQRPRLTKEFKDDLRQHLHYLTSDDHGPATHAQANKTSIGGMFHIVRGKIGWATRVEPEYGRKCLIQFRTIKWPPIERAKSGTISLDFDMIDEP

SEQ ID NO: 1722 - protein, 393 aa, unidentified
  source 1..393: note = Related to PEGF01000002.1; note = Caulobacter sp.
MSSWNPQHYRFDGERQGVPGAVIDSALAIMERIRRVDPRMTPVFTLRHLSEMTGTRYGLLRSVVARRTHPYKVFTLKKAIPGRTRVRLICTPNRELKTTQDWIVRNILQHTRAHPASYAYHPGSRPEFAARMHCGCDFLLKVDIEDFFTRVTEGKICEVFEGLGYPDLIAFELARLTTVVASGGKSPSVDPAVRWPTIKAYQHAAEGFLPQGAPTSPMLSNLVMRHLDDRFAAMAAAANMKYTRYADDLAFSARKPHTRATVAAFKRKVLRELSEAGYRPNLRKTAIRGPGARRIVLGMLVDGPEPRLSREFKDDLRQHLHYLASEDFGPSRHAERQKLSVSTLYHRVRGLIGWAMRVEPKFGAKCLAQFEAVAWPPIDIRSPINAIDWDELA

SEQ ID NO: 1723 - protein, 384 aa, unidentified
  source 1..384: note = Related to NZ_NEFY01000006.1; note = Marinobacter vinifirmus
MSFWSPQRYQFEGEKHGIDDDAIAASVEVIKRIQNINARLPIVLTLRHLSWLTDTNYGYLRKVVSRESGKYKRVLFKKKVPGRSRYREIHIPEASLLAVQKWITAKILSNTSAHPSSFAYHPDSQPIFAASRHCGCKWLLKIDIENFFHSISERMVYKVFRDLGYTKLLSFELARITTTTGLSNKKSEDIFRSDSSRWPSIPNYYCSDEGFLPQGAPSSPMLSNLVMKAIDKDLEYLANCNGFTYTRYADDLAFSTEKNATIADINRFKKEVNRLLIEAGFNPNRRKTAIRGPGARRIILGILVDSKNPRLSKEYKDQLRQHLYYLRSQEHGPSKHAEARKLSVSTLFHHVRGKIAWAEKVEPEFGALCLEKFESISWPPLDNW

SEQ ID NO: 1724 - protein, 380 aa, unidentified
  source 1..380: note = Related to NYXE01000056.1; note = Rheinheimera sp.
MSSWSSQRYKFEGETQGIDDSVLDSSISAIGRIQKVDERLPIILTLRHFSLLTDCHFGYLRRVVSRESREYKRILFKKKVPGRSRYREIHVPEQELLEVQQWVTAKILSNTKAHHSSFAYHPNSQPIFAASQHCGCKWLLKIDIEDFFHSISERMVYKVFKDLGYNKLLSFELARITTIVKARDKSQASSDLTKWPAIPTYCKNSEGFLPQGAPSSPMLSNLVMKSVDEKLATLAKTNGFIYSRYADDLAFSTKLNVGMVSMRQLSKLVSCLLSAEGFNLNKRKTVIRGPGTRTIILGILVDSKKPRLSKEYKDDLRQHLYYLCSQDHGPSKHAEIRKISVSTLFHHIRGKIAWAEKVEPEFGAYCLEQFNGIKWPPLGY

SEQ ID NO: 1725 - protein, 388 aa, unidentified
  source 1..388: note = Related to NZ_JACHOW010000011.1; note = Longimicrobium terrae
MPAWNPQRYQHEGKIRDIDQGILDSVVRIINRIRAVDARLPVILTLRHLSVLTDVPYKYLRDVVSRQAGDYKRVLLKKRVPGRTRHREISIPNPVLAGVQKWINENILQFTSAHPLSYAYHPESQAVFAATPHCGCRWLLKVDLTDFFHSISESDVYAVFKSLGYSPLLAFELARLTTMLSASSRPAPADFTERWSSIPAYACEKQGVLPQGAPTSPMLSNLVMRDLDEGLAQLAEAAGYTYTRYADDLAFSTAKDVGLEHVQRLRKSVLLKLAKSGFSGNLRKTVIRGPGARRMVLGILVDGHEPRLAREYKDALRQHLYYLLSPAHGPAKHAGARNLSVSTLFYHVRGKIAWAERVEPSFGSACLEEFEKVDWPPVDVARQRSRDA

SEQ ID NO: 1726 - protein, 395 aa, unidentified
  source 1..395: note = Related to NBDP01000036.1; note = Bosea sp.
MRITSPQHYVAAGQGLAIDPLVLENASRAISQIWSRNINLFPLLTLNHLSVATGLNYGFLRRVVARKGGPYLYSHFYMRKRVPGRRKVRMISIPAPKLAQCQSWIVRHILKHVPPHSGSYAYHPHSNPVFAARRHTEAVWLIKVDIQDFFHAINEHAVYRVFRSLGYASILSLELARLCTMTAERPRQAKDPSARYVSPAVEYYQTPYVGVLPQGAPTSPMLSNLVMRDVDQGLSDLAKESAMRFTRYADDIVFSCADKRLGSSVRLVRNKILEILNQAGFRPNLRKTVIRGPGDRKVVLGMLVDSAHPRLMKEFKDELRLHIHYLRHPKFGPAHHALARKTSVTSIYHHVLGLIFWARTVEPTYGARLLKEFKLIQWPPITRRDYYATVRQAGD

SEQ ID NO: 1727 - protein, 395 aa, unidentified
  source 1..395: note = Related to RCIZ01000007.1; note = Mesorhizobium sp.
MRITSPQHYVAAGHELAVDPLVLENASKVISRIWSVNPNLFPLLTLNHLSVASGVDYGFLRNVVARKTGNYRQFLMRKRVPGRRRVRVISMPVPKLMHCQHWIVENILKHAKPSPDSYAYHPNSNPVFAARRHTNSVWLIKVDIEDFFDSVHEHDVYRVFRSLGYAGILSLELARICTMAAKWRPDTDERWARYKGHGVAYYRNQWIGVLPQGAPTSPMLSNLVMRDVDQKLARLASSSCMRFTRYADDIVFSCSDRRTAETVRSVRSQILTILNEAGFRPNRRKTVIRGPGDRKLVLGLLVDGKKPRLAKEFNDEIRMHLHYLGHPDFGPARHATARKTSIAAIYHHVLGLIFWARAVDKTFGSELLRQFNSIAWPPVSERHYFATMEQQENHR

SEQ ID NO: 1728 - protein, 385 aa, unidentified
  source 1..385: note = Related to NZ_JAHVKC010000001.1; note = Pseudooceanicola nitratireducens
MRQTSPQQYKAAGHELEIAPAVLNNAAAAMQRIASINSQLFPLLTLKHLSIESDVSYGFLRKTVAREAGRYRHIYLRKKVPGRKNVRMISIPEGRLLRCQKWISENILRFGAPHQASYAYHPGSNPVFAARAHTEAKWLIKVDIQDFFHAISEHQVYRVFRSLGYARLMSFELARLCTMPCERLEPDTADVKYLEATITHYYSPYVGILPQGAPTSPMLSNLVMKELDAKLAKLADDNAMNFSRYADDIVFSCKDARPSQSVNRVKRLILKALNDEGFRPNLRKTKVRGPGTRKVVLGILVDGKQPRLPREYKDKIRQHLHYLTHPDFGPAGHASARKTSVSRIYHHVFGLICWAKAVEPSFGEEALRSFNAINWPPISRPKFYS

SEQ ID NO: 1729 - protein, 323 aa, unidentified
  source 1..323: note = Related to WIEL01000040.1; note = Rhizobium leguminosarum
MARWNPQRYQDEGEKQGIDPGVLDAASKAIANIQAVNPSLPPILTLMHLSKVTEVNYPYLREIVGRKIDPYKSFALRKRTPGLHRTRTIHVPEDYLLTVQRWISRAILRQAAPHSASFGYHPGSSPVTAARRHRNAKWLIKIDLKDFFDNIREPAVFDVFRSLGYGSLISFEMARIVTRAPDAKRAQIAIDEHRIPFYSVDSNGFLPQGAPTSPMLSNLVMRGLDAKLQELANEHDFRYSRYADDLVFSCRDQKSRSAAQTLRDAALQALRAGGFTPNMRKTTIVAPGGRKIVLGLLGAVEVQGFFWGLFVIQAADGTICADG

SEQ ID NO: 1730 - protein, 375 aa, unidentified
  source 1..375: note = Related to NZUJ01000046.1; note = Ponticaulis sp.
MRFPSLQQYKAKLVSFAVAQPLFSRLVRVLLRIRSTSDSIYPIFTLRHFCQIVGADFKFLRLVIGRKFPYTYTTFYLKKNSPSRGFREINVPCNELRLVQRWLVENIISHVHPSEHSFAFHPGSSPYAAAAEHRNTKWLLKVDIKDFFHSVSEHEVYDIFYGIGFQKLLAFELARICTIPSTDSASLVSKERKIEDYQSNRIGRLPQGAPSSPMLANLAMRKVDHEIASCCAEYDLRFTRYADDIAISSDDDCGLDTLIQIRRQVFRILRAHGFDPNPRKSVIRKPGDRKIVLGLLVDTERPRLTSEFKNNLRMHLYYLMKPSGPSAHAKARNSSITTVHAHVLGLIHWARYVDSTYGNARLAEFKSVNWPKGTW

SEQ ID NO: 1731 - protein, 384 aa, unidentified
  source 1..384: note = Related to NZ_JABVZR010000001.1; note = Novosphingobium sp.
MAHPWDPQTFIAGARLAGRSEVTIQACQAAAIAIKRTHPDLPVILTLNHLAHLADVNADFLQEVAHRKIDPYRVFRVKKRGVANLVPAQPRRYRTICVPEPRLMRVQRWIAQNILQVTPSHTASFAFIKNRDLKGAAEMHVNAKWVVKMDVRQFFESIPEAAVYRVFRTFGYGALLSFQMARICTRRPDHHRRDTRALLGRGGQRPYRLHPMGHLPQGAPSSPMLANRAVEALDRRLERLAISAGWTYTRYADDLAFSRTTDATRSEAMKLVKLAELSLQIHGLVVHRQKTSILSPGSRKILLGMLVDTGKPKLTKAFRNNIETHLYALTHKKIGAEKHRTKRGFSSLIGMRRHILGLIAYAHQVDEAYAATLYAKANSVDWTR

SEQ ID NO: 1732 - protein, 384 aa, unidentified
  source 1..384: note = Related to JAALZB010000008.1; note = Agrobacterium tumefaciens
MAHRWDPQTFIGGARVAGRDEYTIEACKAAATAVKRIHPDLPVIFTLNHFAHLVDVDADFLAEVAHRKIDAYRVFRVKKRGVANLVSAPSRRYRTICVPEPRLMRAQRWIAQNILQVTPSHRASFAFTKGRDLRGAATSHANAKWLVKMDVRQFFESISEAAVYRVFRAFGYGALLSFQMARICTRLPDHHHSDNRDRLGRGGRGPYRAQAVGHLPQGAPSSPMLANRAVEALDRKVERIANKSGWTYTRYADDLAFSRSDDARRGDSMKLVKLIEMSLMSNGLVVHRQKTSITASGGRKILLGMLIDRGEPKLPKSFRNNIETHLYALSHANIGAEKHRATRGFASLIGMRRHIMGLIAHAHQVDKTYAAKLYAQVNLVDWNR

SEQ ID NO: 1733 - protein, 384 aa, unidentified
  source 1..384: note = Related to VFSZ01000005.1; note = Mesorhizobium sp.
MPYRWDSQAFIVGARSEGRSESTIQACLAAATAVKRKHPDLPIIFTLNHLAHLADVNADFLQEVAHRKIDPYRVFRVKKRGVANAVPAPPRRYRTICVPDPKLMRVQRWIAQNILQATPSHHASFAFTRDRDLVDAAKKHAGAKWVVKMDVRHFFESIFEDSVYQVFRSFGYGALISFQMARICTRLADHNRNDARALLGRGGRRPYRQHSKGHLPQGAPTSPMLANRVVETLDQKLDLIAITADWAYSRYADDLAFSRITTTTRRQAMSLVKKVEAELAKFGLETHRQKTTIVSPGGRKVLLGVLIDTDKPRLTKNFRNNIETHLYALTSQKIGPEQHRLKRNFVSLIGMRRHILGLIAFAHQVDETYAAKLYTLFNTVNWNR

SEQ ID NO: 1734 - protein, 385 aa, unidentified
  source 1..385: note = Related to NZ_QDKO01000010.1; note = Caulobacter sp.
MRHPWSSQQFRLGALAAGRSEAIIAAAESIARDIKRRNENLPVVLTLHHLAHLVDVPIEPLQKIIFRQIDPYRVYRVKKRGTPNGAAAPPRKYRTICVPHPQLMRLQRWIAQNILNEVAPHDASFAFTPKRNLVGAAWRHTEARWLLKMDVRHFFESISERQAYWVFRTLGYTALLSFQMARLCTRLTQHGVADPRRAAGRGHTGLPYWQHPQGHLPQGAPTSPMLANLVMRSFDRRVEALAQSTGWGYSRYADDLAFSRRDGSSRGAAMHLAKAVEHELALLGLVSHRAKTSVVPPGARKVLLGVLVDSTRPALTRAFRNNVETHLYALTSPKIGAAAHRAKRGFASSIGMRRHIEGLIAFAHQVDRAYGAKLYAQFNDIDWTR

SEQ ID NO: 1735 - protein, 389 aa, unidentified
  source 1..389: note = Related to KB291762.1; note = Brevundimonas diminuta
MTFTWDPQQFEAGALGAGLDRRSVEAALAAGAAIKASHPDLPVVLSLGHLAHLTDVSAGVLDKIVRRRLDPYKVFRVQKRGTPKAGNAPARRYRTICVPTPGLMRVQRWIAQNILNVITPHAASYAFTPNVKMSDAIKRHANATWLVKVDVRHFFESISETQVYWFFRRLGYPALLCFELGRLCTRLAPDHRVYATDPPVTPGSRPSAGHDLPYPPRLQGWLPQGAPTSPMLANHIVEPLDVKLSAMARSGGWRYTRYADDLHFSRTSKFTRKAAVDWSHEVERELVRLGLRANRQKTTITPPGARKLVLGALVDSSTPRLNRGFRNNVETHLFALTHPDIGVDKHQAKRGFASTIGMRRHVQGLIAFARQIDRPYGDKLLVQFESIKW

SEQ ID NO: 1736 - protein, 378 aa, unidentified
  source 1..378: note = Related to PCOO01000001.1; note = Ochrobactrum sp.
MLHPWDSQAFAEGAKKIGRSDATIANALAVADAIKKSNVNLPVILSLGHLAHLTDVGLPVLRNYTERSDDPYRVFQVKKNHVGKAPRRHRTICVPEPSLMRVQRWIAQNILNAQKPHPRSYAFAPCRSLVQAAERHAGCRWLIKMDFKDFFESIDERRVYLVFRSMGYGALLSFEMARLCTRLPGAYSAKPQEAAALSTGYKFQQPGFLPQGAPTSPMLANLVVRALDRRLERIGLKYGWVYSRYADDLAFSTKDISGRGAAIALVKQVEREVRDFGLRENPAKTSITPPGHRKVLLGLLVDRDQPRLTKSFRNNVETHLFALGHPKVGAMAHCAARGFRSVTGLRRHLAGLIAFAHAVDKPYAARLYADFDKVDWSR

SEQ ID NO: 1737 - protein, 378 aa, unidentified
  source 1..378: note = Related to NZ_LMCH01000057.1; note = Pseudovibrio sp.
MKHPWDSQNFVRGARASGRDLDTISAAVSIAKAIKQVSPNLPVIFSLSHLAHLVDVSPKDLRPIVDRMSDPYRHFRLRKKSGGNGSKAPKRRFRDIYAPQPHILRTQRWIAQNILNLIQPHPSSFGFAPGSDMLAAATLHCGCAWLLKMDVSNFFESITERQAYQVFRECGYTALLSFQLARLCTRSIDKKHYSHLRETEFPHPSATEGFLPQGAPTSPMLANLAVYSLDVKLKQIADELGWKYSRYADDIAFSTEQSVSRTDALKLRGIVEGTLKSFGLSENSNKTRISPPGARKILLGVLVDRERPRLTRRYKDNIETHLYALNHEKIGVLAHQANRKFSSVTGMRHHVLGLISFAYHVDRKYGNKLYSEYNRVKW

SEQ ID NO: 1738 - protein, 378 aa, unidentified
  source 1..378: note = Related to NZ_CP066786.1; note = Martelella lutilitoris
MKHPWDSQTFRRGARENGLDAVSIEAALSIAKAIKSTAPDLPVIFSLSHLAHLVDVSPKHLRPIVDRMSDPYRHFRLRKKSGRKGSKAPRRRYRDIYAPQPHLLRTQRWIAQNILNVLKPHSSSFAFAPDSDMLDAATQHCGCTWLLKMDVSNFFESITERQAYQVYRGCGYTALLSFELARLSTRSVDQKHYFHLQESEFPHPEAVEGYLPQGAPTSPMLANLAVRPLDMKLKRIAAELGWKYTRYADDMAFSTDRVRTRKEALQLKAIVETALTRFGLSVNQSKTRISPPGARKVLLGLLIDRERPRLTRQFKDNIETHLYALNHAKIGAQAHRDKRGFSSITGMRHHIRGLIAFAHHVDPDYAQKLYKDFNRIKW

SEQ ID NO: 1739 - protein, 380 aa, unidentified
  source 1..380: note = Related to JAEUMP010000012.1; note = Hyphomonadaceae bacterium
MSHPWDSQTFTAAARAAGRSDAVIDASLRAATYIKDRHPDLPVILTLAHLAHLTDVSGEFLRGVVDRETDPYRVFQLNKRSRPNAPQRAHRTICVPHPLLMRTQRWIAQNILNVIDPHRASFAFAPKRDIVQAAKRHAGCRWLVKLDVTDFFTSIREDAVYRVFRALGYGALISFELARLCTRAPGSSRRKHRASHDQRLPYHRKHCGFLPQGAPTSPMLANLASYQLDEDFEALATSRNWIYSRYADDLAFSTKHPSNRSEALHVSRKAEALLERHGFAANRSKTCIAPPGARRLVLGLLVDRGAPRLPRAFRDNIETHLYALAHADIGPLRHLNKRGFASLIGMRRHIEGLIAFAHQVEPTYAARLYARFKKVAWPAQ

SEQ ID NO: 1740 - protein, 380 aa, unidentified
  source 1..380: note = Alphaproteobacteria bacterium; note = Related to VGDE01000018.1
MQAWNSQRFRAGAKASGSSEETIQAAIEIAACIRKENPRLPVVFTFHHLSHLTDVSSEFLQDVAFRKVDAYRTFQLKKRGKPNSVPAPARRFRTISVPEPGLMRVQRWISQNILNVTTTHAASFAFTPKRDLKQAAMRHREAKWLVKMDITSFFESIKENKIYFVFRKLGYPPLLCFQMARICTRLPIEHGSKIPKQDKMLPYKRRTEGFLPQGAPTSPMLANLVAHALDNDLSMLAAQEGWIYTRYADDLSFSHTECRSRQEAVALVRRVESLLKRHGFLHNPTKTTISPPGARKIVLGLLVDREDPRLPKSFKNNLEAHLYALRSPKIGARAHVKRRGFTSHIGLRRHVYGLLAFAHHIEPSYAKKKYAEFNMIDWSA

SEQ ID NO: 1741 - protein, 380 aa, unidentified
  source 1..380: note = Related to JXQV01000002.1; note = Agrobacterium tumefaciens
MLHPWDSQQFRRGAKDAGRPDQVIDRAIATARRIKRKNRDLPVIFSIFHLAHLTDIDVDSLLSVVDRTEDHYRIFRVKKRSVPGRVAPSRRYRTICVPSPALKRIQRWIAQNILNVTETHPASHAFAPESDLVEAANEHLRSSWIVKLDIINFFETVTERQVYYVFRSLGYAALLSFQLARICTRTLKLTPKGRAGSEGRVPHERYIAGHLPQGAPTSPMLANLAVRQLDDELDNLAKRLGWKYTRYADDLTFSLEGKSSRGKAAELMSLASQTLSRAGFTSNKLKAKIIPPGARKVVLGVLVDTDRARLSKKFRNNLETHLYALTSHKIGVRSHMQNRGFDSVIGMRQHIEGLLAFAHHVDEKYAAGLYRQFNSIDWLA

SEQ ID NO: 1742 - protein, 320 aa, unidentified
  source 1..320: note = Related to NZ_JAHYCB010000008.1; note = Rhizobium populisoli
MLSFVERTHDHYRIFRVKKRATPGTTAPTRRYRTICVPSPALKRVQRWIAQNILNIIDPHEASHAFAPESDLVEAANKHLGCSWLVKLDIVNFFETIGERHVYYVFRSLGYTALLSFQLARICTRTLRLTPNGRAGNDGRLPHEKYIPGHLPQGAPSSPMLANLVARHLDEELTALASSRGWTYTRYADDLTFSVHGKSSRGKAAEIMAVATQALARQGFASNKLKSKVVPPGARKLVLGIVVDTEHTKLSRKFRNNLETHLYALTSDKIGVKLHMANRGFDSIVGMRKHVAGLLAFAHHVDEKYTARLYQQFNSINWLT

SEQ ID NO: 1743 - protein, 375 aa, unidentified
  source 1..375: note = Related to NZ_LHZT01000085.1; note = Acetobacter tropicalis
MLSWNPQQFTREAKKEGCSQPLINAAIQTASLIKKVDIGLPVIFTLSHLAQITDTPLVKLGAYSRRTSKNSYRVFRLKKADRRKFRVICVPEPTLMHVQRWLAQNVFQTRAAAPHQASYAYYSDTRRGLLNAAKQHAGCLWLIKMDIQNFFGSIMEPQVYKVFRDLGYSALLSFQLARICTYVGDKPSPRRKKSYGIPNSYCENLGYLPQGAPTSPALANLTTRLLDSELEKLAQENGWRYSRYADDIAFSTTQTINREVAKSLVLLVREKLINFGFTPNDTKTVISPPGARCIVLGLLVDGPYPRLTNDFRNNLDTHLYALLSKKIGVKKHQEKRGFDSVTGMRRHIMGLLAYAHSIDREYSRKCYEKFNKIIW

SEQ ID NO: 1744 - protein, 408 aa, unidentified
  source 1..408: note = Related to JAAXBO010000012.1; note = Rhizobium leguminosarum
MNYLTSQHFRSVGISLNIESKVLDNAVLVHQRIRKQSPNRGVVFTLAHLAHLTGVHYNFLRMCVSDPGTGSYREFFIKKSTSGQKKNKRAASRPMRRISIPAPMLMLVQRWILHRILHTAEGHEASVAFHKDADIKRAAKLHCGCRWLIKLDVQNFFESITEEQVFKVFVRLGYPRLLSFELARLCTKVIGPEDRSLSPTTRFANFGRGPYEDAAFIDPSTPRRLRRDAPLIVSRRVLPQGAPTSPLLANLAVTELDTEILAIAEEHGLIYTRYADDIALSTKRKDFSRDEASQVIGKVYAAFARARLLPHTGKACVRPPGALKIVLGLVVNGPEPRLTREYRNKLRLHAHILGRLGIEPADHAKALGFRSVLSMRRHIYGKVEHARRIEPDFASKIADTLSKVNWLL

SEQ ID NO: 1745 - protein, 314 aa, unidentified
  source 1..314: note = Related to NZ_CP090091.1; note = Rhizobium leguminosarum
MRRISVPAPLLMHVQRWILHRILHTAAGHEASVAFHKDADIKGAAKLHCGCKWLIKLDVQNFFESVSEEQVFKVFVRLGYPRLLSLELTRLCTKVIDPEKRVRTRFTRLASYGRGPYEDDAFLDQSLKRRERLGSPILAQRRVLPQGAPTSPLLANLAVFEMDREIMEIAIEHDLVYTRYADDIALSTNRDNFTRDEASKIIGKVYACFARARLVPHPGKACVRTPGALKIVLGLVVNGTEPRLTREYKNKLRLHAHILGTKGIDPSEHAKALGFRSVLSMRRHIFGKLEHAKRIEPDFAVKIGNSLKAVNWLL

SEQ ID NO: 1746 - protein, 408 aa, unidentified
  source 1..408: note = Related to NZ_CP092346.1; note = Rhizobium gallicum
MNYLTSQHLRNIGTSLQIEPEVLDRAVLIHRRVTSQNTKRAVVFTMSHLAHLTGVHYNYLRMCIGDPGLLSYREFFIKKSTSGRTKGKKSPSRTMRRISVPAPMLMLVQRWILHRILHTAAGHEASVAFHKEADIKKAAKLHCGCKWLIKLDVRDFFESISEEKVFKVFSGLGYPRLLSFELTRLCTKVLDPGKRIASQNTRLANVQRGPYEDDLFTDQRIPRRQRLDADVLTHRRVLPQGAPTSPLLANLAVFDMDEEIMEIAARHGMVFTRYADDIALSTKRTDFTRDEASKVIGKVYAAFEKAGLIPHPGKACVRTPGALKIVLGLVVNGSEPRLTREYRNKLRLHAYMLGTRGILPSEHAKALGFKSILSMRRHIFGKLEHAKRIEPEFANKIDITLKGVNWLL

SEQ ID NO: 1747 - protein, 425 aa, unidentified
  source 1..425: note = Related to NZ_CP065229.1; note = Erythrobacter sp.
MSSFSPQHYKQIGRRLGVDPAVLETAAKIGTRITASAPDRAVVFSLRHLSALSGVPYQFLRDWVGRWGPDPYREFFLAKKPDGRTANKPSRRPKRRIAAPTPILMRQQRWLVERVLHHAPRHPSSMAFHRKADIVETARLHCQCNWLIKMDIRNFFESIYEPSVFNVFVELGYPRLLAFELTRLCTRIVPENRLKWASGLKHGLFDARRGPKFYSRVRKQPDAKGQHAIGKRDRFHEWVTGAIGSDRLPLPLGSLPQGAPTSPLLANLAVRGLDERINIIAAEHDMTYTRYADDVALSTERKDFSRKEAGQVIGKIKREFEREGLLPHHSKTRLVSPGARKIVLGLVVDGKAPRLTREYRNKLRLHAHMLGTRGISPSAHASALRFRSVISMRRHIEGKIAHARRVEEPFADKIAAQLAKVDWTL

SEQ ID NO: 1748 - protein, 425 aa, unidentified
  source 1..425: note = Related to NZ_CP016461.1; note = Blastomonas sp.
MPSFSPQHYIQIGRRLGISPTVLARAGAVGTRITANAPDRAVVFSLRHLSALSGVPYRLLRDWVGRWGPDPYREFFIAKKSDNRRTNKPSVRPKRRIAAPTPDLMRQQRWLVERVLHHAPRHPASMAFHRDADIVETARLHCKCNWLIKMDIRNFFESIYEPAIFKVFIDLGYPRLLAFELTRLCTRIVPENRLEWKTGLRHGLFDPRRGPKFYNRVRGTPDVTGRRTIHTRDRFHEWAMGAVGSDRMPLPLGSLPQGAPTSPLLANLAVRALDERITLIAAEHDLVYTRYADDVALSTQRKDFTRKEAVQVIGKVLREFEREGLRPHHAKTRLISPGARKIVLGLAVDGNTPRLTREYRNKLRLHAHMLGARGINPSAHATALRFRSVVSMRRHIEGKIAHAHRVEPAFADDIKAKLQGVDWTL

SEQ ID NO: 1749 - protein, 391 aa, Pseudomonas sp.
  source 1..391: note = Related to NZ_JACAQV010000005.1; note = Pseudomonas salomonii
MSVWRAQPYINAGRRAGADPVALAHAVRYGQSIVRHSASLVPIFTLKHLAVLSGTPYGVLREIVGRDATSMKDQPYRIFRIRKRIAKKGEAQRLRTICVPSPMLLRVQRYIHERILVRLPVHPASIAYNPGRVMVEDVAVHCGCQWLIKVDIKNFFEAIPEQVVYRVFRNAGYPALISFEMARLCTRVPMPFALERPFNFPPNRSERYSISAYSKRLQGSLPQGSPSSPLLANLCSRALDERIEELALRHGLVYTRYADDIALSSEDKSFGRGHARYIVRKLHAIMRDCGFAPNLAKTIVVPPGGRKVLLGLYVDTERPRLSREFRAKLEQHLHFCLRPDVGAIAHSKHRGFDAVLGFRNHVRGLVAFAIQVDPDYGAKRLSEFNKVEWPL

SEQ ID NO: 1750 - protein, 391 aa, Pseudomonas sp.
  source 1..391: note = Related to NZ_UWGW01000546.1; note = Pseudomonas viridiflava
MSVWRAQPYVNAGRRAGADPVALAHAVRYGQSIVRHSASLIPIFTLKHLAVLSGTPYGVLREIVGRDATSMKGQPYRIFRIRKRIAKTGEAQRLRTICVPSPMLLRVQRYIHERILVHLPVHAASIAYNPGRVMVEDVAVHCGCQWLIKVDIKNFFEAIPEQVVYRVFRSAGYPALISFEMARLCTRVPMPFALERPFNFPLNRSERYSITAYSKRLQGSLPQGSPSSPLLANLCSRVLDERIEELALRHGLVYTRYADDIALSSEDKSFGRGHARHIIRKLYAIMRDCGFAPNLAKTIVVPPGGRKVLLGLYVDTDRPRLSREFRSKLDQHLHFCLRPDVGAMAHSKRRGFDAVLGFRNHVRGLIAFAIQVDPDYGEKRLTDFNKVVWPL

SEQ ID NO: 1751 - protein, 391 aa, Pseudomonas sp.
  source 1..391: note = Related to NZ_CM001559.1; note = Pseudomonas chlororaphis
MSVWRPQPYKKAGELAGADPTALAHAVRYGQTIIRHNAEVTPVFTLRHLSVLSGTPYGVLREIVGRHATSKKDLPYRIFRIRKRMARPDGIERFRTICIPSPVLLRVQRYIHEHILVHLPVHPASIAYNPGKKLIDGVAVHCGCNWLIKVDIKNFFEAIPEQVVYRVFRQAGYPALISFEMARLCTRTVMPFSPDGPFNFTQNRPDKYKITSYSNRLQGSLPQGAPSSPLLANLCSRLLDERIEELALLHGLVYTRYADDIALSSEDKRFGRGNAKDVIRKLYAIMRDCGFAPNLAKTIVVPPGGRKVVLGLYVDTSRPRLSREFRSNLEQHLHFCLHPDIGAVAHAKHKGFDAVLGFRNHVRGLVAYATQIDPAYGAKQLADFNKVKWPF

SEQ ID NO: 1752 - protein, 391 aa, Pseudomonas sp.
  source 1..391: note = Related to NZ_UWJA01000102.1; note = Pseudomonas viridiflava
MTVWRPQHFRKNGLKAGADKAVIANAIEYGKAIVRCDPALTPVFTLRHLAALSGTTYEVLREIVGRQAVVGKEQPYRIFRIRKRKPRPDGAERFRTICIPSPMLMRVQRYIHDHILTHLAAHPASIAYNEGKKIVDEVAIHCGCKWLIKVDIKNFFEAIPEQSVYRVFRGAGYPALVSFEMARLCTRVVPLNWTEGPRGNSQNLDSKYSIARYSNRYQGSLPQGSPSSPLLANLCSRRLDDRIEQLAIEHDLVYTRYADDLSLSTDDPEFNRTKASQVIGRLYAILAECGFAPNTMKTAVVPPSGRKILLGLYVDSDRPRLSREFRYKLEQHLHFCLHAGVGPVEHAKRRGFDAVFGFKNHVRGLVAYAVQIDPEYGAKRLAEFHKVAWPF

SEQ ID NO: 1753 - protein, 401 aa, Pseudomonas sp.
  source 1..401: note = Related to NZ_CP077076.1; note = Pseudomonas fakonensis
MAIWRPQPYKATGQKLGVNQVALVNAIKYGKSITGHHPSLTPVFTLRHLAALSGTPYAVLRGIVGRQTETGTDRAYRIFRIRKRLSKKGEPQRYRTICIPSPVVLRVQRYIHEHILTHLAVHSASIAYSEGNKIAEEIAVHCGCKWLIKMDVKNFFEAIPEQAVYKVFRGAGYPALISFEMARLCTRVVPLNWSEGPTAYPTNRISRYSITTYSNPSKGVQPAGTQVQGSLPQGSPSSPLLANLCARGLDEMLSELADEYGLVYTRYADDLAFSTSDKSFDRRRASQVIGRVYAIMAKCGFVPNTAKTVVVPPRGRKILLGLYVDSDRPRLSREFRYKLEQHLHFCMHPKIGPVLHAKRRGFDAVLGFKNHVRGLIAYAVQVDPEYGAKRLAEFHKVMWPF

SEQ ID NO: 1754 - protein, 401 aa, Pseudomonas sp.
  source 1..401: note = Related to NZ_FOTU01000001.1; note = Pseudomonas syringae
MAIWRPQPYQKTGQQLGIDPAVLASAIKHGKSIIGHHPSLTPVFTLRHLAALSGTSYAVLRGVVGRKTELGSDRSYRIFRIRKKISKVGGAQRYRTICIPSPVLLRVQRYIHEHILMHLPVHSASIAYSAGNKIAEEIAVHCGCKWLIKVDVKNFFEAIPEQGVYKVFRGAGYPALISFEMARLCTRVVPLNWTEGPHGYLNNRCSRFSIAAYSNPSQDARPAGTQIQGSLPQGSPSSPLLANLCARKLDEKIEELADDCGLVYTRYADDLALSTDDQCFTRRKAKQVIGRIYSLMASCGLTPNTAKTVVVPPGGRKLLLGLYVDSDRPKLSRDFRYRLEQHLHFCLHPGVGPVSHAKQKGFDAVLGFKNHVRGLIAYAVQVDPLYGEMRLVDFNKVAWPF

SEQ ID NO: 1755 - protein, 391 aa, Pseudomonas sp.
  source 1..391: note = Related to NZ_UUET01000191.1; note = Pseudomonas viridiflava
MVVWRSQLYRKTGRQLGVDNSILDAAVLYGKAISNHQPCLVPVFTLRHLAALSSTPYNALREIVRRHQLGGGMHPYRLFRIRKRISKKGGEERFRTICIPSPVLLRVQRYIHEHILIHLPVHPASIAYNEGKRIVDEVAIHCGCRWLIKVDVKNFFEAIPEQAVYRVFRGAGYPALVSFEMARLCTRVISRSRDEGAFGYRDNRSLRYSIKAYSQALQGSLPQGAPSSPLLANLCSIPLDHEIEKLAEEYGLAYTRYADDLALSTPDTTFDRDQARQVIVRLYAAMARCGFVPNTAKTAVISPGGRKVILGLYVDTERPRLSRDFRYKLEQHLHFCLHDGVGPVEHAKHRGFEAVLGFKNHVRGLIAHAVQVDPEYGARRLADFHKIAWPF

SEQ ID NO: 1756 - protein, 389 aa, unidentified
  source 1..389: note = Related to NZ_LPFA01000028.1; note = Burkholderia cepacia
MAIWRAQHYRQNGLLQGIDPQLLSRAIEYGDAITRSNRNLTPVFTLRHLALLCGASYAALRAYAGRKNDEANHPYRFFRIRKRTGPGERPRRRTICVPAPELRKAQRFIHDSILSYLPVHPGSIAYSRHTRPVEEIGIHCGCRWLIKLDVQNFFEAISERAVYRVFRNAGYPALISFEMARLCTRIVPGNRDEGPSGQTSGRVGRYSIEAYWNWRQGSLPQGAPSSPLLANLCSFGLDTLVANIASEYGMVYTRYADDIALSTTNHHFSRSDALRVIQQVYAAMRQCDLQPNTAKTMIAPPGARKIVLGLYVDQSTPRLTREFRSRLEQHLHFCLHPDVGPVAHARRKGFSAVLGFKNHLRGLIAYATQVEPGYGATKLVDFQRVAWPF

SEQ ID NO: 1757 - protein, 388 aa, unidentified
  source 1..388: note = Related to PBYJ01000011.1; note = Oceanospirillaceae bacterium
MNHWRPQHYRKQGTKSGKDPVIIKRAIEIGTSITRKYPTITPIFTLNHLALISGTSLHKLRKVVSRNESDGYHYRFFQISKRCRKKSKPTKRFICIPSSDLMRVQRVINSVILSKVPAHSASVAYTKGSSIYNAASIHCGCKWLIKLDIKNYFESISERSVYSIFRSIGFPALLSFEMARICTRVIPRRGLTYDSRWINPRFEKGKIKAYRNRDVGSLPQGSPSSPMLANLASVHLDEEIADLAYKNGLEYTRYADDITLSTDNEYFSRLKASKLIQEVYFVMRKYGFEPNTTKASVTPPGGRKVVLGLLVDGASPRLTRDFRSKLRQHLYFCRKDGYGPIKHAKHKNFASILGFKNHLAGLISYAKQIDPDFGKKMNDEFNKIEWPF

SEQ ID NO: 1758 - protein, 381 aa, Escherichia coli
  source 1..381: note = Related to CP059835.1
MKQWSPQRYRAEALIQGVKPEIIDSAILHTKKIINLNPKVIPILTLRHLAFMAGVEYSFLRKVINREHFHPYRFFLIRKRRSISKRKIFVPEPQLLKVQKFIHDNVLKHILPHDASFAYTPYSSIYDAAHVHINSRWLIKIDITNFFESISEIDAYHVFKYNGYSNLISFELARICTWPIPRSRNERLHRLQNKYLKEYKFYDRKQKLGSTPQGAPTSPCLSNLVCKNLDAEISFLCEKLQVRYSRYSDDITISSTNKSFSRHNAQHIIDSIYRILNKYGFNPNKYKTKIIPPGAKKIVLGLNVDKDSVGLDKEFKYKIKQHIHFCLHEKVGPVQHARFKGFSSVIGFRNHLYGLIVYARSIDVIFGEKMLSKYNEINWPF

SEQ ID NO: 1759 - protein, 381 aa, unidentified
  source 1..381: note = Related to NZ_CP011118.1; note = Yersinia enterocolitica
MKQWSPQRYRSEALIRGVEPEIVNNAILHIKKIVNLNDKLLPILTLRHFAFMAGVEYSFLRKVINREHFHPYRFFLIKKKKSISKRKIFVPEPQLLKAQKFIHDNVLKNISPHEASFAYTPQSSIYYAANMHINSRWLIKIDITSFFESISEIDVYHVFKSNGYSNLVSFELSRVCTWVIPRSPKERLPRLKNKYLKEYDFYNRSSELGSTPQGAPTSPCLSNLVCKHLDSEISLLCEKLKVRYSRYSDDITISAVNINFSRTNALDIVDSIYRILRKYGFNPNKVKTKIIPPGAKKIVLGLNVDKNRVNLDKAFKYKLKQHVHFCLHEKIGPVKHSKFKGFSSVIGFRNHLYGLIIYARSIDAMFGEEMQKKYERISWPF

SEQ ID NO: 1760 - protein, 308 aa, Acinetobacter sp.
  source 1..308: note = Related to CP018254.1; note = Acinetobacter baumannii
MRKKNSLEKRRIFIPHPQLVKVQKYIHQNILKFVECHENSFAYTPGISIVDAASLHTNSKWLIKLDITAFFESISEVSVYKVFRSLEFPALLSFELARICTWNSPRNRNTIPPRFKISKKTNYTVYSSTEGIELGHLPQGAPTSPSLSNLVCRELDKQLTAFSVKNELEYSRYSDDITFSSKNINFSRKDAIEIIKMVYKILINYGFTPNIQKTKIISPKAKKIVLGLNVDREKVKLDKKFKNKINQNIYFCLHPDIGPVRQAKYKKFSSVLGFKNHLHGLIIYALSIDKEFGEKALNNYNKIVWPIH

SEQ ID NO: 1761 - protein, 386 aa, unidentified
  source 1..386: note = Related to NZ_PUJU01000037.1; note = Photorhabdus tasmaniensis
MRQRWSPQRFQASAKNQDIDQNTIEHAIKHAKNIIQHGKYILPIFTLRNLSFLAGVEYSFLREIVSREYIHPYRFFYIRKKGRNRRRKICIPNPQLCKVQRFLHKEVLQEFQVHPACFAYIRDSSIVDAASVHVESRWLLKLDIVNFFDSISEISVYRAFRENGFPALISFEMARICTWLSLRNPHEIDSRWKIDHRHNYKIYHRSSISEMGSLPQGAPSSPMLSNIVCFKLDETLEELAVENGLRYTRYSDDLTFSTNSINFNRKNATLFISKVFSILKSFGFEPNKTKTEIIPPSSKKVVLGLNVDKKSVSLDKNVKYKIKQHIHFCLHSDVGPINHAKRKGFSSVIGFRNHLKGLINYAKSIEPEFGEKMLSLYKKIKWPLDI

SEQ ID NO: 1762 - protein, 394 aa, Vibrio sp.
  source 1..394: note = Related to NZ_CP073273.1; note = Vibrio fluvialis
MNNIWRPQLYISEARSQGIPTDIINNAVAIGDRITNKGLNIPIIFNLEHLAKLSGVDYDQVYKLTKRAGENSSGKDYYRIFAIRKKDTKSKRYICVPSKNLLRVQKYINQFILHNLKSHPSSMAYNKGCKIVDVANVHRQAKWLLKIDIEDFFENISEVDIYKIFFSSGYSKLLSFQLARLCTRIVPYQKEHAEKYSHSRWRAHKNYNNKNYNFHVIGSLPQGAPTSPLLANLVLRELDEKITKIALSYGVRYTRYSDDLTFSSCDIKFGRKNCYRLIREIYDSLYSNGFSPKKNKTKIISPGSRKVVLGLIVDGNKPKLTKEFKANILRHLHFCNLESVGPVQHAKHQKFDSVIGFNNHLKGLVSYSLSIDPKFGSKVKSLYESINWPSLPFN

SEQ ID NO: 1763 - protein, 393 aa, unidentified
  source 1..393: note = Related to JACFTX010000002.1; note = Photobacterium damselae
MNNWRPQQYRIEAQRKGVPENVINSAIAIGDKISSTGLNIPIIFNLEHLSYLSGVDYNQLYKLTKRVGERFYEKENYRIFTIKKKNSKSKRYICVPNHKLLRVQKYINKFILQQIKTHHASMAYNSGCQIVDVAKLHCNSRWLIKIDIKDFFEEISEVNVYSVFNECGYSNLLSFQLARLCTRIVPYQKEDVLNNIKSRWKSSKQYRNINYNHDVTGSLPQGAPTSPMLANLFFRALDEKIMTIANKYNLIYSRYSDDIALSSRDDLFGRSKCHQVVKDVYKVLYSSGLSPQKGKTKILSPGSRKIILGLVVNGSSPKLTKEFKKNLLQHLHFCNLKSIGPVRHAKYKKFDSIIGFRNHLHGLISYALNVDPNFGKKVKQQYDHIDWPPLPFV

SEQ ID NO: 1764 - protein, 390 aa, unidentified
  source 1..390: note = Related to NZ_KE383828.1; note = Oceanospirillum beijerinckii
MYKNWNPQRYRKNANRDNISHDVIRNAIEIGNRINSVNRDIPIVFTLNHLSVLSKSKLSFLESIASRNYEDKPYRFFKIRKKGKNSNDKRRVICIPEPRLLSVQQYINEEILSKIPSHECAMAYSKGKGVYDAAELHCGCRWLIRIDLKDFFDSISERQVYYVFNKLGYPKLLSLELARICTRVYPRFIYPSEKSKWISNRSKDSGIASYTCSGNMLGSLPQGAPTSPALSNLVCKSLDGDLLLFSEQHGFLYNRYSDDLYLSTTSDLSRKDIRCFLLSVYGLLNKREFQVNKNKTVISGPKTKKLVLGLNVDKEYPKVRREVKNQIKQHLHFCLRKDIGPVIHSQKKKFSSVVGFRNHLLGMINYVNQIEPMYAIKLRKSFDRIDWPFI

SEQ ID NO: 1765 - protein, 381 aa, unidentified
  source 1..381: note = Related to NZ_CH672406.1; note = Idiomarina baltica
MNRWSSRAFKKHNSDKPAAVVETAALYGRKIQTSCPELPVIFTLNHLALKSGVPYNNLRSFVDRTIERPYRSFTLRKNGLGSNPRKFRVIKVPQQDLKKAQQFINQNILSKMEPHECSVAFSPGSKIYDAASEHCNARWLLKFDIVSFFESITEKSVYRVFRRYNYPALLSFEMARICTALKARPPINWGGAPPNIRYRTIPGYSNKNLGTLPQGAPTSPMLANLVSYNLDRRLKLIADAYNCHYSRYADDITFSTDSSLSRGEVSRIIAMINSTLREYGHTMNKAKTTIAPPGARKFYLGMNIHGDSPQLRKSFKRKLKQHLFFCEKNSVGPEKHSKHLGFVSVIGFKNHLRGLINYANQVDTVFGENCMKRFQSIDWPL

SEQ ID NO: 1766 - protein, 385 aa, unidentified
  source 1..385: note = Related to NZ_AKKU01000003.1; note = Alishewanella agri
MNRWSSQLFQKEARRLGRSEDVIDNCLNAAALIQLKNSQITPIFSLRHLSYMAKADYGFLRAIVSRDDRIDSYRTFQIRKRKRRKNDKERYRNINVPSHDLKKTQQWINKHILSHVSPHQCSMAFYKDSSIIEAVNAHVGAKWVIKVDVKNFFESINEISVYRVFRELGFNALLSFELARICTKKRTMLPSRSRKWISTGRRETISTYAQPIQGFLPQGAPTSPMLSNLASLRLDQEIFKFCAHEGFIYTRYADDIVISVHRDVKKSECSNIINKLYRVMASNGLSPNKTKTIVLHPGARKVILGLMLTDKGVMLTKEFKSRLRQHLFFLNSENVGPVEHAQHKGFVSIIGLRNHIIGLLSFAKAVDKNFASKCQADFDRIVWPI

SEQ ID NO: 1767 - protein, 383 aa, unidentified
  source 1..383: note = Related to NZ_LCTG01000001.1; note = Gluconobacter oxydans
MTLWDSQAYIVEARATGINPNIVTAALGHANAIRSVSRDLPIIFTLSHLAQACGVAHSYLMDVADRRIDPYRDYITKKREKPHRTAFSRRYRIICMPDPELKKVQRWVHQNILSKVTPHRASTAYSNSNTLLDAAARHTNARWLIKIDIERFFESIKEPYVAGIFERLGYPDLLSFQLARLCTRLPSLKSRKDIFCRRSKPVKGVMQNDWIGFLPQGAPTSPQLANLVMRRFDRRMTSLSRTEGLRYSRYSDDMIFSTLGSFSRPQATSFVHQVYDVLGAYGFEANRTKTSIAAPGARKVVLGLLVDRDEPRLTREFRSNIETHLHYLERPNVGPVAHAKAREFDSIIGLQNHLLGLIAFARQIDRKYGDELRARLHRINWPA

SEQ ID NO: 1768 - protein, 383 aa, unidentified
  source 1..383: note = Related to NZ_JSXI01000043.1; note = Sphingomonas sp.
MTLWDSQIFTAGARAANVDPAVISAAVGHANAIRSVSIDLPIVFTLAHLAHLSGVSHRYLIEVAGRGSDPYRDYIAKKRQAPGSTAASRRYRTICMPDPELKKVQRWLQQNMLSKIAPHAASTAYSEDDTVFAAAARHVNARWLIKIDIERFFESIKEPYVASVFERLGYPDLLSFQLGRLCTRLPTLKSRKDIFKRRSKPARGVMQHEWIGFLPQGAPSSPQLANLVMRRFDRRATAAAKKAGLRYSRYSDDMIFSTAGSFSRERAEHFVHDIYDVLGAYGFEANRTKTSIAAPGARKIVLGLLVDRDKPRLTREFRAGIETHLHYLERPDVGPVGHAEVREFDSVIGLRNHLEGLVAFARQIDQPYGDRLKARLRAIVWPA

SEQ ID NO: 1769 - protein, 384 aa, unidentified
  source 1..384: note = Alphaproteobacteria bacterium; note = Related to JAFKFG010000027.1
MQNWNSQLFSKGAAAAGVSPSIIASANAYARRIISCNSDLPIVFTLKHFAHLTELPFDNLVKIVERKEDPYRSFLIKKRSRPGDRAVARRYRTICIPDTTLMFAQRWIDQKILSKVDPHNCSTAFHGNSSIVRAAQRHCGCRWLIKIDIQRFFESITESSVCRVFQSLGYPDLLSFELGRLCTREPSVLSRRWKFRRTRSYPSGVHQHPSIGFLPQGSPTSPRLANLTMREFDEGVNSISRSYGLVYSRYADDLIFSTDAATFSRVEAEALISRIYQVLLEYGFEPNRTKTMISPPRARKIVLGLLVDRDTPKLTRQFKQDLENHVFYLSHPRHGPSQHANKRNFTSVIGLQNYVQGLLAHAAQVDSAFADRMRAMLAQVKWPI

SEQ ID NO: 1770 - protein, 377 aa, unidentified
  source 1..377: note = Planctomycetes bacterium; note = Related to JABMRO010000623.1
MNRWVPHIYRQTGQQKDVPDAIINEALSQAHRVQNKELPAILTLRHLAFQTDVSYTNLHKIISRDVDPYRSFSIKKRSGGWRRISVPQFELLKVQKYIDHFVLSRIADSSYSYAFKSKTSIADCANQHLSCRWLVKIDLRHFFESLSEMQAYRVFNEAGYNNLVSFELARLCTKVLPLTAKKYSKPNWRSVGHISMYSFYEDKYNRIGHLPQGVPTSPRLSNLIVRGLDREIVEATDEYDLTYTRYADDMTFSTGSSCFSKKKGRDFINKIYSLLPKYGLRPHPQKAQIVPPGARKIVLGLLVDGDKVRLTKHFRSNLECHLYYCVKNPISHATNRGFASVLGLKNYVNGLLAYANQVDPDYVNKISSDVGKPDWPI

SEQ ID NO: 1771 - protein, 372 aa, unidentified
  source 1..372: note = Related to NZ_FNIN01000001.1; note = Desulfonauticus submarinus
MKRWSPHLYKIYGKKNKKDDKLIENALNQADILQNRNLPVVLTLGHLARHTDIPYQTLRKLVARQVNAYRIFRIRKRSSGYRVICVPNKDLLKVQRWIDKFILSNLESSPYSYAFEEGQSIVDCASQHLSCRWLIKIDLRNFFESLSEIQVYRVFKVAGYNNLVSFEMARLCTKQSKSGWKLYNPYWKSYPREKIPLYNADVIGHLPQGAPTSPKLSNLIMKNLDFEVNNIAQKFSLVYTRYADDMIFSTIDSSFDYKKAKCFIKDIFNILPKHGLLPNRQKTKIIPPGGRKIVLGLLVDSEKVRLPKDFRNKLECHWYYCTKDITQHAEKRGFKSYLSMQYYIKGLISFARQVDSDFVEKLKKKYGEIKWL

SEQ ID NO: 1772 - protein, 383 aa, unidentified
  source 1..383: note = Related to JAGRCJ010000081.1; note = Caldilineaceae bacterium
MSIGPPHTYVTEGRKRGVSNQILRDSLEQARKVQEKGLPPVLTLRHLSSLTNVEYKLLRKIVARRQDDAYRSFLITKHSGGKRVICVPHPSLKRVQRWINQKILMNVSTHWRSYAYSRNSSIVDCAQQHCGCNWLIKLDIRQFFESITEIQVYQVFQNLGYQPLVSFELARICTRTYSSYNELELNKKWLSQPEAYSVIPFYQYKYLGHLPQGAPTSPMLANLVCKLMDEALFNIAHDEGLVYTRYADDIVLSSSDIHFTRKKAQSVIRKVSSVLTKYEFEPQHNKTSVVPPGARKLVLGLLVNNSTPRLTRTFKCKLERHIWAVGKFGLANHAHHIGFDSIWGFVRHLEGLISYAMMVERRFGESMQIAFQKTLDGNGWNNN

SEQ ID NO: 1773 - protein, 381 aa, unidentified
  source 1..381: note = Related to VTRK01000013.1; note = Comamonas thiooxydans
MMWSSQHYLAQGRQLQISEAILQTAMKQSRRLVQRRPQSLPVLLTLGHLAKRTGIPYSSLRAYVGRQAIEPYRRFRIRKRSGGIRRICVPEPALSAIQGWIAENILQRVDVHSASHAFKKGDSIARCAEVHAGARWLVKMDIADFFGSISEIDVFRVFKSLGYNSLVSFELARICTELPLNSAKYAFSSWRRSHARRGIPAYNQQYVGRLPQGAASSPMLANLAMINTDQRLTEIANSFGLEYTRYSDDLTFSTTGDFDRASAYALIEQVANVLKRRNLFPNKAKTKVVHPGARRVVLGLLVDGVAPRLTRAFRDRLRQHLYFLEKRGIEAHVQARAFESAGGLYRHLRGLVDYANSIDSAYAAPVLARLEALPWRPEVKI

SEQ ID NO: 1774 - protein, 376 aa, unidentified
  source 1..376: note = Related to NZ_CP049990.1; note = Pusillimonas sp.
MWSSQHYLAQGKQLQHNNEVLQEALKQSRRLVQHRPQPLPVILTLFHLAKRTGVPYSALHAYVGRQAIEPYRRFRIRKRSGGIRRICVAEPRLGSIQAWIAENILQRAEVHPASHAFRKGDSISRCAEVHAGARWLVKMDIADFFGSISEIDVFRVFKSLGYNPLVSFELARICTELPAKSAKYLLPSWQLHHTRRQIPGYSQKHVGRLPQGASSSPMLANLSMIRTDQTLSEIANSFGLKYTRYSDDLTFSTAGDFDKASAYALIEQVANVLKRRNLFPNRAKTSVVHPGARRVVLGLLVDGDVPRLTRTFRDRLRQHLYYLEKHGIVAHVQARAFESAGGLYRHLRGLIDYANSVDPAYAAPLLARLEALPWRS

SEQ ID NO: 1775 - protein, 376 aa, unidentified
  source 1..376: note = Related to JAKZFD010000012.1; note = Pelomonas sp.
MWSSQPYLVRGRKLGLSPELLQEAVKQSRRLAQRHPQPLPVLLTLCHLAKRTGVPYSSLRAYVSRQAVEPYRRFRIRKRSGGVRRICVPEPTLGAIQTWIAEHILQRAQVHRASHAFKKGDSIVRCAEQHSGARWLVKMDIADFFGSVSEIDVHRVFVGLGYNPLVSFELARICTELPSRSDKYALSSWQCRYARRGIPAYGQQYIGRLPQGAPSSPMLANLTMVATDQKLEEIALKAGLLYTRYSDDLTFSTAGDFDKGRAYGLIEEVAAVLKSRGLFPNRAKTVIVHPGARRLVLGLLVDGDAPRLTRVFRDRLRQHLYYLEKLGIAAHVQARAFESAGGLYRHLRGLIDYANSVDPTYAGPLLARLEALPWAR

SEQ ID NO: 1776 - protein, 376 aa, unidentified
  source 1..376: note = Related to NZ_CP028294.1; note = Acidovorax avenae
MWSSQHYLARGREIGRSPELLQEAVKQARRLVHRHPQGIPVLLTLCHLAKRTGVPYSSLRSYVGRQAIEPYRRFRIRKRSGGVRRICVPEPNLGAVQAWIAEHILQRVDVHQASHAFKKGNSIVRCAEQHVGARWLLKMDIADFFGSVSEIDVYRVFVALGYNSLVSFELARICTELPAASAKYALRSWNCHRFRSGITHYQQKYVGRLPQGAPSSPMLANLAMLKTDQLIAELASKEGLIYTRYSDDLTFSTSGDFDRRRANKFIEEVAAILKARGLFPNRAKTVVVHPGARKVVLGLLVDGDAPRLTRQFRDKIRQHLYYLEKNGIKAHVEARAFESIGGMYRYLRGLIDYAKSIDSAYAAPLLRRLEALPWPR

SEQ ID NO: 1777 - protein, 378 aa, unidentified
  source 1..378: note = Related to JACEZU010000002.1; note = Duganella sp.
MWSPRHYLEQGRLQKQPSAVLAVAVEQIKRLQAHNPPLPPILTLKHLAKVTKVRKAKLECFVERIAPEVSYKRFNIKKRTSGYRKISIPEPDLMKVQAWISQNILQLPSVHSASKAFRKHDSILKCAEVHCGAKWMIKIDIADFFGSITEIQAYRVFKDLGYNPLISFHMARICTDLIPKSQKYKMQAWQIFENKYSITEYHNKNNFGRLPQGAPTSPLLSNLVMLRLDKTIAELAEKQGLRYTRYSDDITFSTKGDYSRKQAVEFVASVSALLKADGLYLNRKKTVIVPPGSRKIVLGLLTDREYPNLTKEFKEKLRQHLYYIKTLGVEAHMRRREFDSVGGLYRHILGLINYANLVDPTYAYKMKQQFKSLPWPGQ

SEQ ID NO: 1778 - protein, 383 aa, unidentified
  source 1..383: note = Related to NZ_JACHHM010000011.1; note = Parapusillimonas granuli
MPWSPQRFLAEGLRRGRDHKALMEAIRQISRMQRQRPVLPTLLTLGHLACRTQISYEYLRDIIARNTGHPPYRSFRITKRSGGLRVISVPSPQLMKVQSWLTTHVLNKVQPHPTSYAFSPGSSIADCARQHAGATWLVKIDIADFFGSITEIQVFRVFQMLGYNKLVSFELARLCTILPIVSAKHKLKPWKTKFPRKPIDYYSEQLIGRLPQGAPTSPMLANLAMRDIDEELQHLADSLKLVYTRYSDDITFSTKGKFSRTAASAVIKQTTAILKRRGLFPNRAKTAVIHPGARKIVLGLLVDQEQPRLSRKFRDRLRQHLYYLETRGITAHLEARGFDSAGGLYRHLRGLIDYANMVDQPYAQKQLLRLQALPWGSTLNASS

SEQ ID NO: 1779 - protein, 381 aa, unidentified
  source 1..381: note = Related to SEEN01000026.1; note = Hyphomicrobiales bacterium
MLWSPQRFLEEGLLRDRDYYALQEAIKQITRMRRRGPGLPVVLTLGHLANRTRVPHEHLRDLVARNTGQPAYRTFRISKRSGGSRVISVPGPQLKKVQTWLTQHVLRKVKPHIASHAFSPGSSIADCARQHAGARWLVKVDIADFFGSVTEIQVFHVFRRLGYSDLVSFELARLCTTVPFASAKHSMKAWQVRFPRRRIHFYSEKLMGRLPQGAPTSPMLANLVMREADEELQNLADSYGLVYTRYSDDITFSTRGEFSRDQAVTVVRQSATILKRRGLFPNRAKTAIVHPGARRIVLGLLVDSDQPRLSRAFRDRLRQHLYYLETRGIMAHVEAREFDSAGGLYRHLRGLIDYANMVDQPYAQQQLSRLLALPWSSVAQV

SEQ ID NO: 1780 - protein, 394 aa, Pseudomonas sp.
  source 1..394: note = Related to RKKU01000049.1; note = Pseudomonas neustonica
MWSSQRFIRQGLARGISQQILDAAVEQVEALAKGPIRLPAILTLGHLAQRTDVSYISLRRLVADEYRHPYRTFTILKRKANKSGYRGRREISVPTPELLTVQRWLSAHVLRQVRPHPASHAFSPGGSIVKCASEHCNAKWLIKLDIADFFGSISEIQIYHAFRKLGYQPLISFELARLCTDRPRKNVPPAFVRGRNRMPSGKVRFKARVIDQYDHRYIGYLPQGAPTSPMLANLVMRDIDVQLAAIASRYELRYTRYSDDINFSTTENFSRDKAHELIQRVAKCLIKKGLGLNKSKTTIAPPGAKKLVLGLLVDTAKPRLCHQFKDRLRQHIYYIERFGIEAHAQRRAFDTTAGFIRHIKGLLDFAYMVEPAYALDLTERLQVAVFSWDDSFVI

SEQ ID NO: 1781 - protein, 377 aa, Pseudomonas sp.
  source 1..377: note = Related to NZ_CP018420.1; note = Pseudomonas veronii
MDEPTIRAVIAQVKATVAPPLRLPAILTLGHLAQRSGVSYDALRRLVAGTQHHSYRQFKIRKKSEQARKRRSFRIIHIPCPPLFEVQRWISTYVLRELPVHPSSHAFSPGSSIVKCAEIHCKARWLVKLDVHDFFSSVSEIQVYRVFRSLNYGALISFEMARLCTYRPNRETFKLALPGRFRVPSGIVRHPGRGIKSYSHKYVGYLPQGAPTSPMLANLAMKDIDVAISKIASDHGLRYTRYSDDLTFSTEGDFSRGKALNVIQEVAKKLIVHGLMLNNPKTTVAPPSARKIVLGLLVDGADPRLMKSFKDKVRQHLYFCGKYGVEEHAARRKFDSVGGFVRHLRGLIDFGNMVEPCWAADMYDQMSKVLGSNKFDL

SEQ ID NO: 1782 - protein, 396 aa, unidentified
  source 1..396: note = Hydrogenophilales bacterium CG_4_10_14_3_um_filter_58_23; note = Related to PFJY01000128.1
MWSSQHYRMNAKEHGLSKETIDAAIAQTIAVVEGPHKLPAILTLGHLALRTGVDYVALRGLLTGSCCHQYRHFKIRKRVNGPEKTIRYRKISVPTPDLYRVQRWIAVHVLRSVPVHGASHAFSPGNSIVKCAEKHCGAKWMVKLDILDFFGSISEMQAYRVFHSLGYQPLVSFEMARLCTYRPKHDVPPNFVLPRYQIPSGRVKKRNRVIESYNHPYMGILPQGAPTSPMLANLAMRDIDEKILSIANRFGLQYTRYSDDLTFSTRNDFDRQQASLLIQEIANLLIKRGLMLNRQKTAIIPPGARKIVLGLLVDGDLPRLSRPFKDRIRQHLYYLEKFGPDQHVSKRCFDSVGGFFRHLKGLIDFANMIEPQYARESYVRLCAVVSDAQIESPQNQ

SEQ ID NO: 1783 - protein, 381 aa, unidentified
  source 1..381: note = Related to CP021181.1; note = Rhizorhabdus wittichii
MWSPQHYRERGRQLGADDDVIERAAAAIESFIDKHPNRPPLLTIGHLARRSGVSWFHLRQFVEGSRSGIYRYFRIRKRSGGHRQISVPDPKLMIVQRWIARHILAAIPVHRASFAFAPQSSIVGCARQHCRARWLIKLDISGFFGSISEIQVYRVFLGAGYAPLVAFELARLCTHAPSGSKRYAKRTWTAALTERAIRPYTQPHIGYLPQGAPTSPMLSNLVMRETDKLVAAVATKAGVTYTRYSDDMTFSTIGSFDRERALAVIREVTAILRRAGLSVNEKKTKIVPPGARKLVLGLLVDGAEPRLTRTFRDRLRQHLHYLQKLGPEAHRAARGFDTVSGTHRHVRGLIDFAQSVDPALAEKMREKFDAVAWSLDRPGAE

SEQ ID NO: 1784 - protein, 381 aa, unidentified
  source 1..381: note = Related to SECT01000232.1; note = Oxalobacteraceae bacterium
MWSPQHFRETGRQLGADHDLTERAATAIETFTDRHPTLPPILTLGHLAHRTGVSWFQLRLIVESGRWTNYTFFRIRKRSGGHRQISVPDTKLMIVQRWIAGHILAALPVHRASFAFAPKSSIVGCAAQHTGARWLIKLDIAGFFGAVSEIQVYRVFLDAGYAPLVAFELARLCTHAPSGSKRYGRQEWLAHATHRPIYAYRHPHIGYLPQGAPTSPMLSNLVMRGPDRKIATLATKAGLTYTRYSDDITFSTTGVFDRAKAMAVVRETTAILRATGLEVNGRKTRIVPPGARKVVLGLLVDGKVPQLTREFRDRVRQHLHYLETRGPEAHRAARNFDTVAGLYRHVRGLIDFANSVDAVFADRMLTKFDAVRWSLDSPEDT

SEQ ID NO: 1785 - protein, 384 aa, unidentified
  source 1..384: note = Related to NGUN01000003.1; note = Sphingobium sp.
MWSPQHYHEAGQQLGLDDAMVQRAATAIEDFLDRHPKLPPILTLKHLASRTGISWYHLRKMVLGSRASDYTFFKIRKRSGGHRQISVPDAKLMAVQRWIAAHILSELPVHRASFAFAPKSSIRRCALQHCGARWLIKMDISGFFGSISELKVYRVFLEAGYSPLVALELTRLCTHAPSGSKRYDRPEWLAHATRRKIPAYRQFHIGYLPQGAPTSPMLSNLVMRELDKEIAALAARAGVTYTRYSDDITFSTNGDFDRARAMLLVRQVTARLRRVGLSVNGRKTCIVPPGARKVVLGLLVDGAEPRLTREFRDHLRQHLYYLEKVGPEAHRDARKFDTVSGMHRHIRGLIDYAKSIDEGFAAKMRLKFDSVPWSPDVAPPSEDA

SEQ ID NO: 1786 - protein, 381 aa, unidentified
  source 1..381: note = Related to QFNB01000026.1; note = Pelagerythrobacter marensis
MWSPQHYREIGEKSGADPVVTDRAVAAIDAFMEKQPKLPALLTLGHLAQRTGVSWFHLRQYVEGQRSTEYTYFHIRKRSGGHRLISVPGQQLMMVQRWIAAHILAELPVHRASFAFAPKSSIVRCAKQHCGARWLIKMDISGFFGSISEIQVYRVFLQAGYAPLVAFELARLCTHAPNGSKRYARAEWLAPTTWHPIVAYRQPILGYLPQGAPTSPMLSNLVMRDIDKQIAALANAIGLTYTRYSDDITFSTMGEFNRERAIRVVRKTTAILRRIGLKVNDNKTRIIPPGARKLVLGLLVDGIKPKLTRGFRDGLRQHLYYLEKLGPEAHRKARNFDTVTGLYRHVRGMIDYAKSVDEPFFDEMRTKFEAVAWSLDSPADD

SEQ ID NO: 1787 - protein, 382 aa, unidentified
  source 1..382: note = Related to JAEMRT010000003.1; note = Sphingopyxis sp.
MWSPQHYRDKGIEQGHEAELVSRAAAAIDSFVDAHPQLPPILTLGHLARRSDISYFQLRRLAEGPRWNHYTFFRIRKRSGGRRLISVPEHRLMIVQRWIAEHVLKKLPVHRASSAFADGASIVKCAKQHCRARWLIKLDISGFFGSISEIQIYRVFLAAGYAPLVAFELARLCTHAPSGSARYDRAQWRSRDNWQLPIMRYRQPHIGFLPQGAPTSPMLSNLVMVGMDKLLAALATAEGLTYTRYSDDITFSTTGAYDRQRATEVIRSTSRLLRTIGLKVNDQKTRVVPPGARKIVLGLLVDNPEPRLSRDFRDRLRQHLHYIEKFGPEAHRAARGFDTVSGLYRHVRGLVDFAKSVDRNYASAMRDRLDAIAWSPDFPVET

SEQ ID NO: 1788 - protein, 379 aa, unidentified
  source 1..379: note = Related to NZ_JACRVS010000011.1; note = Acetobacter sp.
MWSPQRYRELGLEKGVDPEVVDRSAEAISDFLDSYATLPPILTLGHLAARTGIPYYKLRKIVVGQRTLEYQYFWIRKRSGGRRLISVPEPDLMHIQRWIAGHLLARQPVHRASAAFRPKASISKCARQHCEARWLIKLDISGFFGSISEIQVYRVFRRMGYAPLVAFELARLCTHAPANSKRYQQDSKWLVRKCESRKFYTQWGIGYLPQGAPSSPMLSNLIMVEADKKIAKLATNQGLTYTRYSDDITFSTTRGYDRERAKKIVRDTTAILRRMGLAVNDKKTRIIPPGGRKIVLGLLVDGSHPKLTRDFRDRLRQHLYYLQKFGPEAHQLERGFDTVSGLYRHVRGLIDFAKSIDANYAARVQKKFEAIKWSLDFSD

SEQ ID NO: 1789 - protein, 376 aa, unidentified
  source 1..376: note = Related to NZ_SCNH01000027.1; note = Sphingomonas sp.
MWSPQRYIEHGLTEGYDAELVRSAAGQIDDFLEKHPDLPPILTLGHLGKRTSLPYARLRKLVSGLRSNDYSYFRIRKRSGGHRQISVPEADLMWLQRWVSAHILSKLKPHRASYAFAPKASIVSCAKAHCEARWLIKLDISGFFGSVSEIQVYRVFLAAGYAPMVAFQLARLTTHAPYFSMRYKRPEWRAVPDRARLPYLFRTRLLGFLPQGAPSSPMLSNLVMRQIDAKLHAIALSAGLTYTRYSDDITFSTRGGFDRERARAVVSKTRRILAKEGFTLNSKKTRIVPPGGRKLVLGLLVDGSEPNLTRAFKDSLRQHLHYVCTFGPDAHAKRRGFDTVSSLYRHLLGLINYAKSVDEDYALRARTKLNSVQWSL

SEQ ID NO: 1790 - protein, 343 aa, unidentified
  source 1..343: note = Related to NZ_CP013949.1; note = Bradyrhizobium sp.
MRLASALPLFTYGEVKVTMSWSSQHYITKGLASGRDRELLETAAKEIERAVYSNPTPLPAVITLNHLARRCGVSYNSLRAIVARNGKQYSYFRIRKRSGGHRLISVPEAELLRVQKWIHTYILSQAKAHEACFSFLRKKSIRDCAAVHRGATWVIKIDISAFFGSISERDAFDIFKGFGYNPLVAFEMARIVTDAPLYSKRYQAVPWKRDPGEYEIAQYRSAKVGYLPQGAPTSPLLSNLFMINIDQQLQALAEHRKLRYSRYSDDMTFSTRGDFSRERAKELIHAVAAIIRVKGLRINTAKTRIIPPDGRKVVLGLLVDGTAPRLSRKLRDNLRMHIFHMRK

SEQ ID NO: 1791 - protein, 379 aa, unidentified
  source 1..379: note = Related to CP090554.1; note = Neorhizobium galegae
MAWSSQRYISAGLKLGFSPDVLNIASEQLEQHITGLPPFPALLTLNHLAKRTNVPYLELRPLVRGQKPDAYHHFYIRKKSGGHRRISVPEPTLMRIQQWIATHILNIAPVHQASYAFSPGSSIYKCAYQHRKARWLIKMDVTGFFGSISEIQVYRVFRSFGYQPLIAFELARLTTYAPISSPRYLLKEWQARTHSSPIDDYHRANIGYLPQGAPTSPMLSNLVMRSVDERIAKIAEKYGLRYTRYSDDITFSTTAEFDRKRARDVIRSVTKMLTRVGLHVNAGKTVVVPPGGRKVVLGLLVDGPEPKLSRDFRSNLRQHIFFLESLGPMEHAKARGFETISGMYRHIRGLIDFANMVDADYAAELLSRFQRVNWPFAIP

SEQ ID NO: 1792 - protein, 383 aa, Citrobacter sp.
  source 1..383: note = Related to DACSWP010000009.1; note = Citrobacter freundii
MWSSHIYKKQGLTKGISPYLLTEAITQIELLVYSQNNLPSILSLSHLAKRTGVEYKLLRCYVMRTGATSVEPFEIYKKFSIRKRSGNRRFIHIPTPKLMRTQRWISEHILAKLPVHAASQAFNKGNSIKKCASRHCGAKWLIKIDIEDFFSSISEIQVYRFFRSLNYQPLVAFELARLCTVGTHNKSPRGVFSNWKIINPNNAIPSYNQKLLGYLPQGAPTSPLLANLIMNDCDKALQTIARKNDLIYTRYSDDLTFSTTDKKFDRSKAKTFIFDAYKILSKHGFRPQFRKTTIVPPGSKKIVLGLNVDSEQPRLAKHTRDSIRQHLYYLEKMDPVQHAFNRQFDSVWGLKMHLRGLIDYANMVEPDFAKACLAKFNAIEWPV

SEQ ID NO: 1793 - protein, 383 aa, unidentified
  source 1..383: note = Related to CP068391.1; note = Serratia proteamaculans
MWSSQSYKKQGLANGLSVPLLNEAIAQSELLLYSEYTLPSILSLKHLAKRTSVEYEWLRSFVIRTAINGVENFEIYKKFSIRKRSGGRRFIHVPSPKLMHTQRWISEHILKALPVHPASHAFRKGNSIKKCALRHCGAKWLIKIDIADFFSSVSEIQVYRIFRSLNYQPLVAFELTRLCTVGTPGLSPRANFPHWKTKEFNEAIPLYHQTMLGYLPQGAPTSPFLANLVMKNCDKSLNALAQKNGLVYTRYSDDLSFSTRDKDFGRSRAKHFVFEAYKIISQSGFRPQFRKTTIVPPGGKKIILGLNVESEFPRLAKSTRDTIRQHLYFLEKVGPVQHAFNRKFDSVWGLKSHVRGLIDYANMIEPDFAEVSLEKFQAIEWPV

SEQ ID NO: 1794 - protein, 383 aa, Aeromonas sp.
  source 1..383: note = Related to NKWH01000001.1; note = Aeromonas veronii
MWSSQTYKQQGLAKGLSESLLTQAISQSELLIYSEYNTPSILSLNHLAKRTGIEYEWLRSFVMRKAIKGVENFEFYNKFSIRKRSGGRRFIHVPTPKLMRTQRWINEHILAKLPVHPASQAFRKGNSIKKCALRHCGAKWIIKIDIADFFSSVSEIQVYRIFRTLGYQPLVAFELARLCTIDTYCESPRRIFPQWRSKKSNKAIPSYDQELLGYLPQGAPTSPTLANLIMKDCDTALQTLARNNGLIYTRYSDDLVFSTKDKNFGRYRAKQFIFESYKIISKAGFRPQLRKTTIVPPGSKKIVLGLNVESEVPRLMKCTRDKIRQHLFFLEKVGPVQHAFNRQFDSVWGLKMYVRGLIDYANMIEPEFSKACLEKFNAIEWPV

SEQ ID NO: 1795 - protein, 453 aa, unidentified
  source 1..453: note = Related to CP022196.1; note = Celeribacter ethanolicus
MTSASERFKFAPSGAKEDRYTTVRWMLGYGFRGLTEKPTHGWRRRTLPHPAYASGHQSAPSPAATHRSSFMWSSQSYKNQGLAKGVSETLLDNAIVQSELLIYSELSLPSILSLNHLAKRTCVEYEWLRGFVMRRAMNGVEDFESYKKFSIRKRSGGRRFIHVPTPKLMHTQRWINEHILKGVPVHPASQAFGKGSSIKKCASRHCGAKWLIKIDIADFFSSVSEIQVFRIFRSFGYQPLVAFELARLCTVGTYWESPRGSLPQWKTRHPNKSIPLYDQKILGYLPQGAPTSPLLANLAMKDCDRALQALAHKNGLAYTRYSDDLSFSTKDKGFSRSQSREFVCDAYAILSRSGFRPNLRKTTVVPPGSRKIVLGLNVETEHPRLTKSIRDRIRQHLHFLKKVGPVEHAFNREFDSVWGLKAHLRGLIDFANMIEPDFAEASLKEFDSVEWPV

SEQ ID NO: 1796 - protein, 310 aa, unidentified
  source 1..310: note = Related to JAIUZF010000015.1; note = Salipiger thiooxidans
MHTQRWINEHILKDVPVHPASQAFGKGNSIKKCASRHCGAKWLIKIDIADFFSSVSEIQVFRVFRSLGYQPLVAFELARLCTVETYWKSPRGSLPQWRARRFNGSIPSYHQEILGYLPQGAPTSPLLANLAMKDCDKSLQTLAQKNGLAYTRYSDDLSFSTKDKNFDRTQSRKFVCDVYSVLSRSGFRPNLRKTTIVPPGSRKIVLGLNVETEHPRLTKNARDRIRQHLHFLKKVGPVEHAFNREFDSVWGLKAHLRGLIDFANMIEPDFAAAPSRNFTLLSGRCRHAAVLCERHFQAMKSTTVHTIQYW

SEQ ID NO: 1797 - protein, 384 aa, unidentified
  source 1..384: note = Related to JAHVJB010000004.1; note = Mameliella alba
MWSSHTYELEAIELGRPRETIDASIEQIENLNETNPPAPAILTLNHLAKRTGVGYEWLRAFVMRQLMPGMDGDARPYRKFSIRKRSGGYRTIHIPEPKLMHTQRWINYHILREVSPHSASQAFTNGCSIKKCAIKHCGAQWMIKIDLEDFFGSVTEIQVYRVFRSLGYQALVSFELARLCTITPGDRSLRSRHPHWRVWKPNKEIPTYSKKYLGFLPQGAPTSPRLANLVMRRCDQEIQKLAKSYGLTFTRYSDDLCFSTRTKKFNRHAASKFIGEAYMVLAKYGYQPNLRKTSVVPPGAKKVVLGLTVDGQEPKISKEVRDKIRQHLYYLAKVGAAEHAHRRGFDSVWGLKCHLRGLIDFAHMIDEDLAQSYIKKFNEVDWPV

SEQ ID NO: 1798 - protein, 377 aa, unidentified
  source 1..377: note = Related to VIRH01000027.1; note = Rhodobacterales bacterium
MWLPQTYIKEAKSKGLDSQTIDAAVDQVDTVLRKAENIPSLLTLNHLATRVGVNVKELRQFVDRTDLDAYQRFSIRKRRGGRRFISIPAPQLMRTQRWINEFILKPLPVHGSSHAFERHSSIVKAASVHCGARWLIKIDVEDFFGSISEIQVFRLFRSLEYQPLVSFELARLCTIGTSPHSPRKEYPNWRVHKRNKIIQGYSQQLLGYLPQGAPSSPRLSNLIMKPLDEALYLEAKQKGLYYTRYSDDLCFSYHNTDFNRRNATELVSAVYRILSSAGYRPNMRKTTVVPPGSKKIVLGLNIENDQPRLSKPFCDKVDQHLYYIKKYGPVEHSHRRKFDSVWGMKSHIRGSIDFAKMVEPERSAVWLEDFNRVEWPV

SEQ ID NO: 1799 - protein, 383 aa, unidentified
  source 1..383: note = Related to JAAXTE010000009.1; note = Rhizobium laguerreae
MWSSHRYRLEARQKNLPESVVQAAIAQSEKLLTADPSLPSILSLKHLAVRCDVPYSDLREFASRRPIDGNQPSLPYQNFSIRKRSGGRRFIHVPNPKLMVVQRWINNHILQEVKPHRASHAFTRNSSIKKCAQIHCGSAWLVKLDIADFFESVSEIQVFRVFSGMGYSPLVAFELARICTIRTPTHSPRQYFKQWVVRNINHTIYAYNDRYLGYLPQGAPTSPLLANLVMRQCDKELSEIAATFGMRYTRYSDDVTFSSLDPALGRDACRKLIFEAYAVLSSAGYRPNARKSTIVPPSARKLVLGLTIDGAEPGLTKEFKDRLRQHLYFLEKLGAIDHAFNRKFDSVWGMKAHIKGLIDFAKMIEPNYAAVCRERFNLIDWPV

SEQ ID NO: 1800 - protein, 383 aa, unidentified
  source 1..383: note = Related to AHZC01000134.1; note = Rhizobium sp.
MWSSHRYRLEAREKQLSETVIQAAILQSEKLITADPALPSILSLNHLSVRCGIPYWELREFVSRRSIDKNEPSMPYENFSIRKRSGGRRFIHVPNRQLMAVQRWINNHILQDVKPHIASHAFSRKSSIKKCAQVHCGSAWLIKLDISDFFESVSEIQVFRAFQGMGYTPLVAFELARICTIRTPAHSPRQHFKQWLVKKANHTIYAYNDRYLGYLPQGAPTSPLLANLVMRQCDKELSEVAARFGMKYTRYSDDLTFSSHDPTLGRDPCRELIFEAYSVLSRPGYRPNARKSTIVPPSARKLVPGLTVDGAEPGLTKEFKDRLRQHLYFLEKLGPVDHAFNRKFDSVWGMKAHIKGLIDFAKMIEPKYAALCRERFQKIDWPV

SEQ ID NO: 1801 - protein, 383 aa, unidentified
  source 1..383: note = Related to WIDU01000012.1; note = Rhizobium leguminosarum
MWSSHLYRVDARKKGLSEATIEAAISQSEKVINADPSLPSILSLKHLASRCGVPYSELREFVSRRAMFTIAPSMPYNKFSIQKRSGGRRFIYVPNRSLMTVQRWINTHILAQISPHGASHAFTKRSSIKRCALVHCGSAWLVKLDISDFFESVSEIQVYRSFKSMGYTPLVAFELARICTIRTPRHSPRERYGQWRIRELNEEIYAYNEHLLGYLPQGAPSSPLLSNIVMRDCDMLLSQIAAKFGMKYTRYSDDLTFSSLDPQFGREACRNLIFEAYAILSKAGYRPNARKCTVVPPSGKKIVLGLQIDGTEPRLTKDFKDRIRQHLYFLEKFGPLNHAFERKFDSVWGMKAHIKGLIDFAKMVEPGYAEICRRRFNLIDWPV

SEQ ID NO: 1802 - protein, 423 aa, unidentified
  source 1..423: note = Related to PAYC01000024.1; note = Idiomarinaceae bacterium
MWWEAGVPVLFGKALAEREHSHSGNVPSLARVARATVRSGLIGVIVMWSPLSYKRKGLEIGIAEELLDSAIEQTENVIEENPDLPSILTLNHLSTRTKTSLETLKAYISRDEPDAYRKFSIAKRSGGRRFIRVPAPQLAHVQKWIHHHILSHISPHRASYGFRKRTSIKDCARKHCGARWLIKLDIVNFFETISEIQVFSVFQKLGYQPLVAFELARLCTVSSDEYSPRRNYGNWWAFKSYKVIRNYEQKLLGYLPQGASSSPMLSNLVMWKCDEQISKIAKKNGMKYSRYSDDIALSTSSKDFNRALAKQVIQEVNRVLSQYGYLPHFKKCKVVPPGARKVILGLNVDGAVPVLQRETKDRIRQHLYFLKKHGPVEHALARGFDSVWGLQSHLRGLIDYAKAIEPEYAAKRLREFREIDWPF

SEQ ID NO: 1803 - protein, 377 aa, unidentified
  source 1..377: note = Related to JXYC01000005.1; note = Marinomonas sp.
MWSPQLYLKLGIQEGHSTELLERAISQSDAVINSEYSLPSILSLKHLAVRTGVSYESLRSIVSRSAPKTYNKFSIRKRSGGRRYIHVPSLELMHAQRWINEHILKKIKVHPSSHAFIEGSSIQKCASKHCGAKWLIKLDITDFFESISEIQIFRSFKELGYQPLVSFELARLCTVPTHHKSQRRHYIQWRSWYRNESITDYNKSLIGYLPQGAPTSPLLSNIVMRKNDEELKKLAHKFKLTYTRYSDDLSFSTRSKNFDRYKAKELVFEVYRILSKSGYLPQYRKTKVISPSSKKVILGLNVDGDTPRLQKEFKDRLRQHFYYIKKLGLDEHIINREFDSVWGFKSHLRGMIDYANMIEPEYAKKQLETFKSIDWPI

SEQ ID NO: 1804 - protein, 374 aa, unidentified
  source 1..374: note = Endozoicomonadaceae bacterium; note = Related to JAAOIO010000006.1
MWSPQSYKKIGSEKGLSDELLETAITQSKAVFCNIPSILSLRHLACRTGISYRKLRCFVERSSYVPYKKFSIKKRSGGRRFIHVPDPDLMHVQRWFNEYVFKLVPVHPSSYAFTTGSSIKKCAAEHCGAQWLIKLDITDFFESVSEIQVFRLFKGLGYQPLVSFEMARLCTVLILDKSPRTHYSQWHVRKENKIIPQYNQKMLGYLPQGAASSPLISNLVMKECDEKLTNIANRYKLSYTRYSDDLSFSTRSKNFCRSKAKDVIFEVYEVLSKAGYRPQLRKTKIISPSSKKIILGLNVDGAEPLLQKEYKDKIRQHLYYIEKLGVAKHVEKRGFDSIWGFKSHLRGMIDYANMIEEDYAKKCLDRFSNIDWPV

SEQ ID NO: 1805 - protein, 376 aa, Vibrio parahaemolyticus
  source 1..376: note = Related to CP006008.1
MWSPHNYKEQGLEKGLSDELLERAISQSEDVIERNHDLPSILSLKHLSVRTCTSHQKLTRFVAREEFSYEKFSIKKRSGGRRFIYIPEPTLLHVQRWINEFILKPIPVHQASFAFNPGSSIRKCAAKHCGAKWLIKLDITDFFESISEIQVYRLFREFGYQPLVAFQLARICTIATPEMSPRRKFNNWKVRRKNKNIPRYNQRILGYLPQGGATSPIISNLVMRELDSEFSKIARKYRLVYTRYSDDITFSTRANTFERDSGRRLITEVYNLLNLSGYKPQYRKTKIVPPSAKKIVLGLNVDGRAPRLQKEFKDNIRQHFYYVETLGLSEHIVNRGFDSVWGFKCHLKGLIDYANSIEPEYARKLVVRFNNIDWPV

SEQ ID NO: 1806 - protein, 377 aa, unidentified
  source 1..377: note = Related to PUHN01000047.1; note = Rhodobacteraceae bacterium WD3A24
MWSPHQYRAAAKEKGLSDATIEAAIDQIETVEQGTPELPAILSLNHLATRARVPYQYLRSVVSRSEPSTYRKFSINKRSGGRRFIHVPEPPLAHVQKWINRFILRQVPVHKASFAFAPGSSISGCAARHCGAHWLIKMDITGFFESVSEIQAYRCFEELGYQPLVAFELARIVTVGPLDQSPRHRDPVWKVREPNAAIPSYSSGALGYLPQGAPTSPMLSNIVMKPVDEEIAAAARKAGLIYTRYSDDLTFSTPAKEFGRSAATDFVHTVGQILAAAGFRPQHRKTKIIPPGSRKIVLGLNVEGTAPKLRKEFKDNLRLHLHYLDKFGPAEHAKARQFETIWGMKAHIRGLIDFANMVEPVYAKGMLDQYEQIEWPF

SEQ ID NO: 1807 - protein, 380 aa, unidentified
  source 1..380: note = Related to NZ_CDRJ01000001.1; note = Ralstonia solanacearum
MWSSQRYLSEGKKNGAAQLVIDNAISQIELVLDQNNNIPAILSLKHFSLRSHVGYKFLRSVVEREEEDDKQGVQVYRYFNIRKKSGGTRTISIPHPQLLIAQKWLATNVLSKLSASNYSFAFSPGSNIVACAKKHVEANWLVKMDVKDFFGSISEIDVYRQFRKLKYQPLVAFELSRIVTWPKSPRVDSPRWELDSVRSSIGSYIHTEIGCLPQGAPTSPMLSNLVANALDEELSRVANKFGVRYTRYCDDLTFSTRRKSFDRNQAKALIEAATMTMLPLGFSPNEKKTVVIPPGARKQVLGLNVDGPVPTLSKEFKSKIRQHLFFLTKNGPAAHAADREFDTIWGLKRHLYGLADYAFMVEPEYGKHVKSALSSINWPV

SEQ ID NO: 1808 - protein, 375 aa, unidentified
  source 1..375: note = Related to NC_017559.1; note = Ralstonia solanacearum
MWASQHYFQEGKSLGVDEDILVSAVDQIERVLDVNGDLPSILTLNHLATRAKVGHAFLRRVISRTQNGAYRHFAVKKRTGGQRWISVPHPQLLNVQRWLAKHVLNQIDASRHSYAFEPESSIKKCAEQHIHAKWMVKMDVEDFFWSISEIDVYRQFVSLGYQPLVAFELSRLATWPLFAHGPAKAAVWRARPREGIPTYSWGNMGCLPQGAPTSPMLSNLVMRELDDRIHRAARKHRMVFTRYADDLTFSSRDETLGRAACRELIGEVGDLLRQRGFNPKHKKTVVVPPGARKVVLGLNVDGDAPRLPKEFKSKMRQHLYYLRTAGPAAHAAKRSFDTVWGLQRHLRGLADFAHMVEPEYGSELLRALQAVSWPV

SEQ ID NO: 1809 - protein, 395 aa, unidentified
  source 1..395: note = Related to JADGAR010000007.1; note = Magnetococcales bacterium
MEFPLHNYLKSLRDIGARDGYIKAIQRNAKPLADCGLPVILTLGHLAHITDVSHGILTDIIKRQIDPYRVFAIRKRNGGKRFICVPETGLLNAQRWIHDEILCSLAATKNLSCHATAYAPGCSHVINAKRHVGAAWILKFDITRFFESISERQVYRVFRGLGYRSQVAFCLTRLCTRVLPTNVDHRLLRHTKRWQTGDQRNQRNFSGARVIGHLPQGAPTSPMLANLVCIPLDTDMQNIAAREGLTFTRYADDMTFSGEMLDRAAAVKISREVSIVVGRYGFGINLQKTSIAKNGGRKIVTGLSVDGDVVRLPRAYKDAIRQELFYLDKHGIQEHCARIGHKNHLSYLLRLAGRIRYATSIEPVIGQRMMHLFLRIFPTFQETERLIFQDFVSDD

SEQ ID NO: 1810 - protein, 395 aa, unidentified
  source 1..395: note = Magnetococcales bacterium; note = Related to JADFZH010000217.1
MEFPLHNYLNSLRDSGARVEYISAIRRNAQPLVDCGLPVILTLGHLAHVTDVSHGILADIIKRQIDPYRVFAIRKRSGGKRFICVPEKGLLTVQRWIHKEILCAPVALRKLSCHATAYAPLSSHIVNAKRHIGAAWILKLDITRFFESVSERQVYRVFRGLGYRALVAFCLTRLCTRVLPSTVDHRLRLRTKRWQTGDQRNQRNFPGARVIGHLPQGAPTSPMLANLVCVKLDADLQKIAAREGLTYTRYADDMTFSGEVVDRAAAIRISREISIAVGHYGFGINLQKTSIAKNGGRKIVTGLSVDGEVVRLPRAYKDAIRQELFYLDKHGIQGHCARIGHKNHLSYLLRLAGRIRYAISIEPVIGQRMMEKFLRIFPTFLETEQMVAQVFVKDD

SEQ ID NO: 1811 - protein, 388 aa, unidentified
  source 1..388: note = Related to NZ_LMUI01000048.1; note = Methylocapsa sp.
MEFPLHAYLNHLQTEGASGEFIAAVRRNAKPLADRDLPVILTLGHLAYATDVRYGTLNGIVRRQIDPYRVFAIRKRNGGKRSICVPEPGLLSVQRWIHEHILCSHYALSRLSNQSTAYAPGCSHLANARRHISAAWLLKLDITRFFESISERQVYRVFRGFGYRALVAFFLTRLCTRVLPFAVDRRLKRQIRRWRTGEPRRYLNAAVVGHLPQGAPTSPMLANFVCTVLDAELQTIAVREGLTYTRYADDMTFSGGIGVACSPAEIIREISTIVGKFGFGINSQKTSIAKNGSRKIVTGLSVEGDMLRLPRSYKDELRQELFFLKKYGIAEHCSRTNHKNHMSYLLRLAGRIRYAVSAEPIIGTRMMLQFQHLFPNFTEIEQSLFDRP

SEQ ID NO: 1812 - protein, 402 aa, unidentified
  source 1..402: note = Related to JADGBU010000012.1; note = Magnetococcales bacterium
MEFSLHTYLNRLRTRGASDEFVEIIRRHAKPLSDRGLPVILSLGHLAFATSNSHEVLHGIVKREVDPYRGFWIRKRSGGKRYICVPEGGLIRTQRWIHDHILCSTWGKKSLSMAATAYVPGSSHIDNAKRHSGADCVLKLDITNFFETISERQVYHVFHGFGYRPLVAFYFSRLCTRVLDPKHDVRSPTVRWAGKKKRWQTEANRKNNNYHTVGHLPQGAPTSPMLANLVCFGLDLELQQIADSINLVYTRYADDMTFSGSFTTKEQISQFICQVSAVVGKFGFSINQQKTSLSRTGGRKIVTGLSVEGDALRLPRAYKDAIRQELYYIERYGLSGHLERVGYANHLTYLMRLKGRIQYWFSIEPATATPSIEQFRAIFPNFNEINELVTGDSSRGIPGTPY

SEQ ID NO: 1813 - protein, 455 aa, unidentified
  source 1..455: note = Related to KN323041.1; note = Burkholderia pseudomallei
MASQYPCRLFETHERGSESAVLDTAFLSARWVDDQLELRGLAIRPSSHHAERVKARNMKFSLHAYLKPLRENGASQEYIEALARSAKPLVDNGLPVLLTLGHLAHVCDVPYGMLVGIISRHTNPYRVFSIRKRSGGKRFICVPEPLLMQVQRWIHDQILCSPFALARLSRHATAYAPQNGPVPANQRRIADHVKNAERHLGATWIVKLDISNFFESISERQIYHVFREFGYRALVAFCLARLCTRVLPLTADKRLRSRAKRWHPGKEYKILATKVVGHLPQGAPTSPMLANLVCVELDRNLQSIAVREALTYSRYADDMTFSGEFHDRSDAVIVLRELSRVVAAQGFSINALKTNIAKNGGRKIVTGLSVDGDSIRVPRAYKDKIRQELYFIGKHGLTDHCNRIDQRNQLSYLLRLAGRIRYVSSVEAEAGNLMMKKLLSLFPTLLDTERILSEI

SEQ ID NO: 1814 - protein, 388 aa, unidentified
  source 1..388: note = Related to NZ_CP050013.1; note = Serratia marcescens
MNFSLHSYIKHLRDTDASEDYIKTVQRHARTLVNNNLPVILTLGHLAHSTNSFHNTLLNIVKREVDPYRVFSIGKKSGGKRLICAPELNLLNVQRWINQYILKSELALKKISSNTTAYVPGGSHIKNAERHVGASWIIKIDIVNFFESISERQVYYVFRELGYRALVAFNLARLCTRILPHKLDNRKYNKKRWRSKKQYAYCNSKVAGHLPQGAPTSPMLANLVCVMLDAKLQCIASEYGLSYTRYADDMTFSGHFDDKKTALIFMREISNTVINYGFSINSQKSSIAKDGGRKIVTGLSVDGEHIRLPRAYKDKIRQEIFYIKKYSLESHCSRTRKGNRFSYIMHLAGKIRYAILVEPTFGNKMMSEFVNIFPDFLDMEQILKSSIR

SEQ ID NO: 1815 - protein, 388 aa, unidentified
  source 1..388: note = Rhodospirillales bacterium; note = Related to JAFKLC010000111.1
MNFPLHAYVRALKRSGASEQFIQQVRDKAKPLVATGLPVILTLGQLSFATEIPYRILLSIIGRAVDPYRLFSIRKRAGGRRFICVPEPRMMFAQRWIHQNILSAPSVTAGMSCAAMAYKNSASHVANARAHLASDWILKLDVTRFFESVSERQVYHVFHSLGYPALVAFGLARLCTRVSFGSRGGRHPGASARWSSRDRYDFLGYPDLGHLPQGAPSSPMLANLVCIPLDSQIEKIAEEHNLVYTRYADDLTLSGSLIGADETLEVIRKVSNSLGQFGFGVNVRKTRVVRRGTRMIVTGLSVEGETLRVPRDYKDRLRQELYYIEKFGLREHCQRIGQRNYAAYLRRLSSRIGYVSCIEPATGKKLEAKFTNLFPGFGELKELILSFP

SEQ ID NO: 1816 - protein, 376 aa, unidentified
  source 1..376: note = Betaproteobacteria bacterium; note = Related to RFVU01000153.1
MEFPRPATAVPLPFDATLAQLAHATGMTTARLQGIVSRRIDPWHTFSIRKRGGGRRTICVPDADLLALQRWVHRHLLCHPQSLARLMPQATAYRPGGSHLANAEAHLGAGWLLKLDLVRFFESISERQVWHVFRALGFAPRTALLLTRACTRVLPLAVDRRYFDRTPRWRTGAERSPNEKFHPRPRVVGHLPQGAPSSPMLANLVCHALDAQLQQLAQSCSEHAVRYTRYADDITFSGPPMTAAALNALCGRLLREATRAITRYGFGVQWRKVQLVRRGARRIVTGLLVDGDALHVPRPSRDALRQALYHLEQQGIEGHCAWLRIDDTQAYLARLRGQLAYLRSIEPVRGARMLAQFDRLMAARGTVGTTGQMRNA

SEQ ID NO: 1817 - protein, 397 aa, unidentified
  source 1..397: note = Related to JAFEJZ010000162.1; note = Agrobacterium sp.
MTAFSLHDYLSVLRAEGSPSDYIEALRRNAQPLVSRGLPVLLTLGHLAFVTDVDYRYLNAVVRRTVDPYRIFSIAKRSGGKRYIVVADRKLALVQSWIHRNILTSAAAMRSISSAVTAYVPGSSHIANASRHRNASWLIKVDVARFFESISERQVYYVFRQLGYRALMAFALTRLCTRVLETKDFRARKKGRWQKRTVSPDRPLGIGHLPQGAATSPMLANLVCRKLDSSLSEIADDRGLIYTRYADDITMSGEFQDRMDAESTIGLISGLLGGVGFGINHQKTSIAKDGGRKIVTGLSVDGDKLRVPRSYKDNLRQHLYYIEKFGLNEHCVRIGQAHHLAFLLRLAGQIRYVRSVEPPLGAEMLNRLRRAVPEFDAIDGLVSAAYDTDTDPSQGGG

SEQ ID NO: 1818 - protein, 391 aa, Acinetobacter sp.
  source 1..391: note = Related to NZ_KB894370.1; note = Acinetobacter tjernbergiae
MSTHNYITELNTPGVNPTYKRVVRQLVTPLLQKNLPVILSLKHLSVLLDIPYIVVHKIVYRDGDFYKVFAIKKRSGGKRWITIPDYFLMKAQKWINNNILNAQEAQAMLSINSTAYKKKSSHIVNASMHLGEKQLIKLDILRFFESISERQVFNVFKKLGYKNSVSLILARICTRVIPIHLDKRFIKNEQRWTTKYNYKYDQQKNKIKRIGHLPQGAPTSPALANFVCCNLDADIEDLIDQFNLNSYTRYADDIIISGNFQDKNTAISCIFRVSRILRNYGFKTNYLKTKYCGSGDRKIVTGICINDENQLRVPIEYKNKIRQEIYYIDKFGLLNHCERLNISNPLNYLMRLEGKINYIKTVELDKGIYFMNKLEKAIPNMNEIRLLNDLP

SEQ ID NO: 1819 - protein, 365 aa, Acinetobacter sp.
  source 1..365: note = Related to NZ_NIWI01000032.1; note = Acinetobacter baumannii
MSTHNYLTELNKHDVNPSYKRVVRQLATPLLQKKLPVILSLKHLSVLLDIPYIVLHKIVYRDGDFYKVFAIKKRSGGKRWITVPNHFLMKAQKWINENILNIQSTQDFLSISSTAYKKSSSHIINASMHLGEKQLIKLDILNFFESISERQVFKVFKNLGYKNSISLILTRICTRLIPLNKDKRFFKKEKRWTTKYTYKYDNQNNKLKRIGHLPQGAPTSPILANLVCQDLDSEIQNLTDQLNLNYYTRYADDIIISGNFINKELAISCIHKVSKILREYGFKTNFLKTKYCGSGDRKIITGICINDENQLRVPIEYKRKVRQEIYYIKKFGLLNHCEKLKIYNPLNYVLRLDGKINYIKTIEPD

SEQ ID NO: 1820 - protein, 390 aa, Acinetobacter sp.
  source 1..390: note = Related to KB849902.1; note = Acinetobacter baumannii
MSNHNYLTSLRNSENINSEYKKSISKYARPLIREELPIILSLKHLSVLTDVPYNTLYNIVFRKIESYRIFAIKKRSGGKRWITVPTPYLMRVQKWINKNILSNSHVLSYISNNSMAYKKKSSHIKNALVHHGETKLIKLDITNFFESISERQVFHVFKKIGYKNSVAFILTRLCTRILSLNNDIRLLNKEKRWFSLYQYKHLDNEKTIKRLGHLPQGAPTSPMLANLVCLELDKQIEDMCLLEDFNYTRYADDIVISGDFSDKENAINHIYEISKILRTHGFKTNYLKTKYCGAGDRKIITGLCINDPSSLRVPSHYKKKIRQEIYYIKKYGLIEHCRKLNIKNPLNYLNRLEGKIYYLICVENENGKKALENLEDAIPNIHELRQLAEI

SEQ ID NO: 1821 - protein, 372 aa, unidentified
  source 1..372: note = Related to NZ_LPGQ01000067.1; note = Burkholderia ubonensis
MRKVPAVFTLMHLAHLTGTSWQSLRNTITRQQDDYRVFEIRKRSGGNRRICAPAPMLKSVQFWIHKNILCSLGARALLQEASTAYAPGSSIKKNAAIHAGAAWLIKLDIKDFFESISERQVYHVFRRLGYPALLSFEMARLCTRVVPPRDDKVPRRREKMWRWTNQTCKHFTPYPCETAVGHLPQGAPTSAMLANLVAVELDKKIQVIADANGASYTRYADDIVLTLAVATRVQCDTIFRAVADVVSHSGFRVNRIKSHVRGPGARKVVTGLVINDVRPRLARSMREDIKLALYHIKKHGLLGHAERRHSKNPLGYLNHLVGLIYFARSIEQDFGVWALSELRIAMDDHKDLLSILRTFDSSQDQRYSYRNI

SEQ ID NO: 1822 - protein, 352 aa, unidentified
  source 1..352: note = Related to nan
MRATVARSKDNYTTFEIRKRSGGNRRICVPAPALKLAQGWIHKHILCSPGALALLQQASTAYAPGSSIKMNASAHAGAAWLIKLDIKDFFESISERQVYHVFKSLFGYPALLSFEMARLCTRVVPPRNDGVARRRERMWRWTNRASKHFSPYSCVTAVGHLPQGAPTSAMLANLVAVEIDKQIQAIADANDATYTRYADDIVLTLSDGTRSHCDAILQKVAHVVNTAGFRVNRKKSYVRGPGARKVVTGLVINDDRPRLTKASREEIKLALYHIKKHGLLSHSERRHSKNPLGYLNHLVGLIYFARSIEEDFGARALIELRTIMADHRDLLSVLQTFEAMPAERESYSYRSI

SEQ ID NO: 1823 - protein, 381 aa, unidentified
  source 1..381: note = Related to NZ_BPUQ01000001.1; note = Caballeronia novacaledonica
MSIADQLTENKVPLIFSLIHLAHVSGVKWSLLRSFVRRDSDFYGCYEIRKRSGGNRRICVPEPALKLIQKWIHANILRSTGALARLHSASTAYAPGASIKKNADSHVGAAWLIKLDIKDFFESISERQVYWVFRDLGYPALLSFELARLTTRVAPPRRDGTMRHRDKMWRWSNNASQAYPAYKPGRVTGNLPQGAPTSAMLSNLAVRELDVQIQLIAARHHATYTRYADDITLTLVQGSRPACAEIFRSVADAITHAGFRVNKCKSRISGPGSRKIITGLVITSKAARVAKNVRSEIEIALHYIKKHGLLDHIERCGHKNPVGYLNYLYGRIYFVRSIEFDFGTRALEELNALIKTYEGLGWSSKPFKIVRSDLVFHSAKK

SEQ ID NO: 1824 - protein, 352 aa, unidentified
  source 1..352: note = Related to JADKFD010000029.1; note = Rhodanobacteraceae bacterium
MVERKIDDYRVFTIQKRSGGNRRICSPSSTLRRVQTWIHRNILCAAGSLAKIHAASTAYAPGSSIRANAKVHTGAAWIIKIDIKDFFESISERQAYYAFRSLAYPALLSFELARLCTRIAPPRDDGAQRKRDLLWRWNNDRAKTGNPYGLVQSVGHLPQGAPTSAMLANLVFAALDVRINAIAQKHGATYSRYADDIVLSLTSGCRVECAKIFRDVTSVISHAGYRINRSKSRITPPGARKIVTGLVTNDVTPRLPREMKEDIMLSIYHIKKHGLLSHMERRKSSSPLGYLNHLIGRILFAQSIENKFGSCALNELRVAMAPYRDLLDMARMLNPKTSGSNDFTALYLLVFP

SEQ ID NO: 1825 - protein, 404 aa, unidentified
  source 1..404: note = Related to NZ_CP034547.1; note = Burkholderia cenocepacia
MLGPSLHAIEFHARGFNEQYVKALVDTAKHLSAKRVPVVFTVMHLATLSKTSWSALMQTIVRQSENDYRVFSIRKKSGGFRRICVPAPHLMQTQRWIHDHILNSRGALDCLHGASTAYGKGSSILNNASAHAGSKWLIKIDIKDFFESISERQIYYVFRRFGYKALLAFELTRICTRAIPPRYDGRPRRRDKTWRWSNSQVVGKGPYLATATVGHLPQGAPTSAMLANYAVASLDEKIQAIADGVGATYTRYADDIVLSMTNSSRELCQTIFRQVCVEITTSGFRLNEKKCFVRGPGDRKIVTGLMVNDVKPRLTKSIKDEIEVSLHCIGKFGLLSHIKRKKIKSPLGYLNHLNGLIRFAYSIDDRFGNWATKELDRVLAPERETIELLKNFSGRPRPNRHMFG

SEQ ID NO: 1826 - protein, 404 aa, unidentified
  source 1..404: note = Related to NZ_BBQM01000001.1; note = Cupriavidus basilensis
MLGPSLHAIKAHAHGLNEQYVKVLVDTARQMSVKRVPVVFTLMHFATLSNTPWAALIQTIGRRAENDYRVFNIRKKSGGFRRICVPVPHLKRAQRWIHDQILKSRGALDYLHEASKAYGDGDSILNNASVHAGSEWIIKVDIKDFFESISERQVYHVFRKFGYRALLAFELARLCTRTAPRRYDGQPRRRDKTWRWGSPQVAGKVPYRSRTTVGHLPQGAPSSAMLANYVAASLDTKIQTIADAAGAAYTRYADDIVLSLTNSDRESCQEIFRQVCLAVTTAGFRLNEKKCLIRGPGSRKIVTGLVVNDVKPRLTKSIKDEIELSLYYIGKFGLLSHAKRRKTKSPLGYLNHLTGLIHFAHSVDDRFGAWAQKEFDRVLAPERETVELLRSFSGRPRPNRHMLG

SEQ ID NO: 1827 - protein, 367 aa, unidentified
  source 1..367: note = Related to NC_018020.1; note = Turneriella parva
MLLWTPHLFEKAGIQRKYDIPYIARLIDYGNQLSQRNLPVIFSLKHFSRLTDINYSYLRAVIDRTEYPYKTFKIRKKTEGFRRISVPDSRLLVIQQWLHKHILSKIQPHFSSTAFNPGCSIMRNAQPHCGANWLIKIDIENFFDSISERQVYTQFKALGYSKYLCFCFARLSTRLASREAKKYKKPRWQNKRHQYPEFIGNLPQGAPTSPILANLVCRQLDAQIHQLIQPMGLIYTRYADDIVISGNALTRKDASKLIQEISKILNRSGFQKNSLKTRILSPGARKIVTGLNVNGPNPTIPKKLKYSIRAELHYAKVFGVAEHCKKLGYHKIDGFRNQIRGKIDFVRSVNPKLADKFYAQLDDINWP

SEQ ID NO: 1828 - protein, 341 aa, Leptospira sp.
  source 1..341: note = Related to NZ_RQHG01000016.1; note = Leptospira adleri
MLPNIIPLQTIGELANITGVPYSYINNIIKLKEDSYRSFSISKRSSNTKRKIFVPKPMLMKVQKAINRYILQNIQPHPIATAYSYGSNPIKNAAYHCNSSILLKFDIKDFFHSFDERDVYYLFLSFGYNRLLSFQLARLCTKIVESTWFPNEYKDHYIYPSLTIKKKSTFLPQGCPTSPMLSNLLMRTFDNKLEMLANKFSLKCTRYSDDLTFSSESKMSQDSIKIVIAEVNKMLGKKFRMNREKQKVYHKGQRKIVTGLIVNNDTPKLTKAFKNDLRMHVHFIAKYGYVEHALKRNCDPFSFYNHFNGRMKWAELIEPAFVNKLKHLLVNISIPFTYSAE

SEQ ID NO: 1829 - protein, 331 aa, unidentified
  source 1..331: note = Related to NZ_CP028271.1; note = Mixta intestinalis
MTQWNPNLFRKEGLSKGYDSHYLTRLVEQGETINERNLPVVFSLAHLANLSHTLYSDLHGFVSRNELERKDFPYKNFSISKRTGGKRWISIPTPALMAVQYWINQNILNRVIPHAAAYAYVPKRKIIQHAQRHCGSGWLIKIDIKDFFGNISERQVFDVFLNLGYPKLLSFEMARLCTRVTPKRKGKRWCNTNNEHTITGYDSKFVGSLPQGAPTSPALSNLVCIGLDKQLTSLAISEGATYSRYADDICFSLPMGCRKSALHIKKEISKILHGYGFSDNSKKTRLIPPGARKVLTGLNVNNDTPRIPKEIRDSVRMHLYYAKKKWYRNSL

SEQ ID NO: 1830 - protein, 378 aa, unidentified
  source 1..378: note = Related to NZ_JUJG01000015.1; note = Pectobacterium carotovorum
MTQWNPNLYRKEGLSKGYNVHYLTSLVEQGEKSNEKNFPVVFSLAHLANLSRTLYSDLHIFVSRTAIKRKDFPYKNFPIAKRTGGKRWISIPTPALMAVQYWINQNILNKATPHSAAYAYVPNKKIIQHAQRHCGAAWLIKIDIKDFFGNISERQIFDVFLELGYPKLLSFEMARLCTRVTPKRKGKRWRNIVTEHTISDYDSRFVGSLPQGAPTSPALSNLVCMNLDKKLTSFAISQGATYSRYADDLCFSLSDGCRKDALYIKKEISKILREHGFSDNSKKTRIVPPGARKILTGLIINDELPKIPKEIRDSVRMHLYYAKKNGIASHCTIRGFRSVIGFKNYLSGMIGYISSINPQQGKKLRTEFNSLPWIDFDL

SEQ ID NO: 1831 - protein, 378 aa, unidentified
  source 1..378: note = Related to NZ_CP091099.1; note = Pantoea agglomerans
MTQWNPNLFRKEGKSKGFNPEYLTALVQQGEKTDGLGFPVVFSLAHLANLSRTLYSDLHSLVSRNELERKDFPYKNFPISKRTGGKRWISVPVPALMAVQSWINHNILSRTKPHAAAYAYVPKKKIIQHAQRHCGADWLVKIDIKDFFGSISERQVYNVFLGLGYPKLLSFEMARLCTRATPKRQGKKWRNEISTYSISSYNSEFVGSLPQGAPTSPALSNLVCFELDVALTSLATSLDATYSRYSDDLCFSLSEGNRKSALNIKRQASKILREHGFSDNSSKTRIVPPGARKMLTGLNVNNASPKIPKEVRDSVRMHLYYSKKLGIPQHCKNRGFRSIIGFKNHLSGVIGYIYSIDKDLGNKYKIEFDSLPWIDFGI

SEQ ID NO: 1832 - protein, 378 aa, unidentified
  source 1..378: note = Related to JAANQB010000011.1; note = Cronobacter sp.
MTQWNPNLFRKEGISKGYAPNYLAALIERAEKINENNVPVVFSLAHLANLSGTLYSDLHSFVSRNALEQKDFPYRNFPIKKRSGGKRWISVPVPPLMAVQSWINTNILNKITPHASAYAYVCNRNLIQHAQRHCGSDWIIKIDIKDFFGNISERQVYSVFVELGYPKLLSFEMARLCTRATPKRKGKKWINYANDHTIESYNTPYVGSLPQGAPTSPALSNLVFSIVDKKLSSLALSHGATYSRYADDLCFSLIQGNRHISLALKKEVSKILNEHGFSDNSKKTRIIPPGARKMVTGLCINSSSPKIPKEVRDAVRMHLYYAKKLGIASHCMSRGFRSVIGFKNYLAGMIAYVSSVDVKLGTKFRQQFNLLPWIDFDI

SEQ ID NO: 1833 - protein, 377 aa, unidentified
  source 1..377: note = Related to PPXQ01000003.1; note = Massilia sp.
MQWNPNLFRKEGNARGYDDLYLNALVSQGQRTAARGLPVVFSLAHLANLSRTLYADLHGFVSRSGIEYPDFPYKNFPIAKRTGGKRWISIPVPQLMAVQQWINQNILNKVVPHPAAFAYVPKRRLIEHASLHCGADWIIKIDIKDFFSNISEKQVFNVFLGLGYPALLSFEMARICTRVTPLRKGARWKNSFKAHSISSYDSRFVGSLPQGAPTSPALSNLVCMKMDEELTEWAISKSVTYSRYADDLCFSFVNSSRQSAYDLQREVTKILRKHGFSDNGKKTRIIPPGARKTLTGLNINAASPSIPKEVRDSIRLHLYFSEKNGISEHCEKRGFYSIIGFKHHLFGLISYVLSVDKSKGEKFRQQFNALPWLDFEN

SEQ ID NO: 1834 - protein, 378 aa, unidentified
  source 1..378: note = Related to JADJBR010000009.1; note = Zoogloea sp.
MTHWNPNLFRKEGSAKGYELAYLNALVEQGDKSTALGVPVVFSLAHLANLSRTLYSDLHGFVRRAEISRADFPYKNFPISKRTGGKRWISIPVPPLMAVQQWINQNILNRVVPHAAAFAYVPKRKLIDHAKRHCGADWLVKIDIKDFFSNISERQVFDVFLKLGYPKLLSFEMARLCTRVTPKRRGARWTHVTGEHAISDYSSQFVGSLPQGAPTSPALSNLVCIELDKELTQLATALSATYSRYADDLCFSFVGGSRQSAFDLKREVSKVLWKHGFSENTKKTRIVPPGARKVLTGLNVNASFPTVPKEVRDLVRMHLYYAKLRGIPDHCKERGFRSVIGFKNHLFGLIGYVATVDVTHGEIFLSQFNSLPWVNFDL

SEQ ID NO: 1835 - protein, 377 aa, Achromobacter sp.
  source 1..377: note = Related to CADILF010000059.1; note = Achromobacter deleyi
MRWNPHFFRREGVNKGYDSNYLEALVRQGNLSSGERLPVIFSLSHLANLSKTLYSDLHGFVSREDIFRENFPYKNFTIGKRSGGRRWISVPVPPLMAVQKWISQNIVNSVLPHPAAFAYVRNRRILDHAYRHCGADWMLKIDIKDFFGNISERQVFNVFLSLKYTRLLSFEMARLCTKASPNRQGERWCNVDLDYSVSGYSSKFIGSLPQGAPTSPGLSNLVFSPIDHQLSELAQAESAVYSRYADDLCFSFTGSSRSAAVKMKRAVAEILWNAGFSENLKKTRIIPPGARKILTGLNVNDSTPTIPREVRNLVRMHLHYARVNGIPQHCRERGFRSVIGFRNYLLGVIGYVASINDQAGKKFLYQFNELNWIDFGL

SEQ ID NO: 1836 - protein, 378 aa, unidentified
  source 1..378: note = Related to JAEUMY010000005.1; note = Betaproteobacteria bacterium
MTRWNPNLFRKDGLAKGFNPEYLGALIAQGESLVSNQMPVVFSLAHLASLSRTLYSDLHGFVSRSDIQRKDFPYRSFPIAKRSGGVRWISIPAPPLMAVQQWICQNVLNRVEPHAAAYAFVPRRRLLDHAQRHCGATWLVKVDIKDFFSNISERQAFQVFLRLGYPKLLSFEMARLCTRVTPRRKGAKWTNSNDDHSIPEYDCRFVGSLPQGAPTSPALSNLVCMDLDRDLTELAVSKSATFSRYADDLCFSLTSGSREAAFALKRDVSKVLWKHGFSENPKKTRVVPPGARMVLTGLLVNANVPTVPREVRDLVRMHLHYAKKNGIPMHCKARGFRSIFGFKNHLLGLIGYVASVDKKHGADFYAQFNQLPWIEFDL

SEQ ID NO: 1837 - protein, 384 aa, unidentified
  source 1..384: note = Related to NZ_ATWO01000001.1; note = Desulfotignum balticum
MTRWNPNSYYKEGKNKGYSSNYLNSLVVHGKKIAANNIPVIYSLKHLALLSGTNYNELYQIVSRLDIDPEGPSPNYPYKIFPIRKRRGGKRLIAIPYPTLMAVQRWVSQEILNKLPVHPAAFAYVAGKKNPLRDHAKLHCDADWILKLDIKNFFSNISERQIYKVFKTCNYYSLLSFEMARLCTMIVPSRRKRRWNNSKQFKNKNLYPCDHIGFLPQGAPTSPALSNLTCIDMDNELTKLALENGANYSRYADDLCFSFTISTRRDLLKFKRTACELLWKNGFSENKTKTKILPPGSKKVITGLIINSGKPMIPKELRDRVRMHLYFSKKLGIPEHCKRRGFRSIIGFRNHLYGLILYIKSIDPKKGEVFRAAFKDLPWVNFNI

SEQ ID NO: 1838 - protein, 380 aa, unidentified
  source 1..380: note = Related to CP033575.1; note = Shewanella algae
MNRWNPNFYYKEGIKRGFNTEYLDKLIEQGRKIQENNIPVLFSLAHLASCSRTQYSELHSFVARTEYGPEGYPYRNFPIRKRSGGKRWISVPAPPLMAVQSWINKNILNSIPTHPTAFAYVNGIKSPLKAHAEKHCDADWVLKVDIKNFFSNISERQVYRVFRSLSYSKLLSFEMARLCTRITPGRTGKRWNIDWNESGVEGYSCTCLGSLPQGAPSSPALSNLVCFELDTQLHELALSRNATYSRYADDLCFSFIKSSRDEVYQFKREVNKALWDNSFTENPKKSHIIPPGARKIVTGLIVNSDKPSIPRELIDAIRMHLFYSEKFGIPAHCRKRGFRSVIGFRNHLKGLIMYVYSIDPKKGNEFLEKYNRLPWLEFEI

SEQ ID NO: 1839 - protein, 381 aa, unidentified
  source 1..381: note = Related to NAHO01000032.1; note = Snodgrassella alvi
MKRWNPYFFRKQGEELNYNKNYLDKLIQIGSQIDSKLTPVIFSLSHLCKLASVSYQEMHDIIARKNFTSFGYPYRNFTIRKRSGGYRWISVPCPSLMIIQHWIASEILRQMKPHQAAYAYVNNLTSPIKSHVQNHCGAKWILKLDIEDFFGSISEKQVYKVFKNYQYPDLLSFEMARLCTKISRNRKGKKWVNDRKNNVELSSYFSKYIGCLPQGAPTSPALSNLVCINMDEELSLLSRNNDANYSRYADDLCFSFYTTNRRNVYMFKKQVCEILWKYGFQENIKKTHIVPPGARKIVTGLIINEHEPTIPREVKDNIKMHLYYAKKFGIPEHCKNKGFRSVIGFKNHLEGLINYVTSVNPEQGKKYEKAFLTLPWLNYKL

SEQ ID NO: 1840 - protein, 379 aa, unidentified
  source 1..379: note = Related to NZ_JAHNZV010000197.1; note = Psychromonas antarctica
MNRWNPNTYHRNGLEKGFDPDYLLTLVKSGKAIKSKHKPVIFTLSHLANCTDTQYSDLHAFVSRKGYFSDTNPHYRTFSIKKRTGGQRTIHAPHPVLKIVQSWIARNILADANIHEAAKAYKKGESIVDNASPHCEAEWLLKLDICDFFHNCSERQVYYVFKSMNYSSLLSLELARLCTKVDDKRPLHRWNNTNKQYKIEEYSSFRVGSLPQGAPTSPALSNLICETLDEILIMLSLKYSGCYTRYADDLTFSFNNSTRAKVMDFKRQVSNELKKFGFEINKQKTRVIPPGARKIVTGLNVNGSQPSLTRELRDKIKADLYYCKKYGVVNHCEKNKYKSIIGFSNHMKGMISFVYSVNPELAGKYKIKYDELDLPTLVL

SEQ ID NO: 1841 - protein, 379 aa, unidentified
  source 1..379: note = Related to NZ_KB905170.1; note = Colwellia piezophila
MNRWNPNIYHRNGVDKGFEPDYLLTLVQSGKAINSKHKPVIFTLSHLANVTDTQYSTLHEFVSRKGYFSNIEPHYRTFSIKKRTGGHRTIHAPHPVLKKVQSWIARNILADADVHEAAKAYKRGESIVDNALPHCESEWLLKLDICDFFHNCSERQVYYVFKYMNYSSLLSFELARLCTKIDDKRPLRRWNNTNKQYKIEEYGSFRVGSLPQGAPTSPALSNLICEKLDEILFMLSLKYSACYTRYADDLTFSFNNSSRAKVLGFKCQVSNELKKFGFEINKKKTRIIPPGARKIVTGLNVNGNKPSLTRELRDKIKADLYYCKKYGVVNHCEKNKYNSIVGFSNHMNGMISFVYSVNPSLAEKYKKQYEELDLPSLVL

SEQ ID NO: 1842 - protein, 379 aa, Vibrio sp.
  source 1..379: note = Related to CP010032.1; note = Vibrio anguillarum
MNRWNPNTYHKNGIEQGFNPDYLVTLVKSGNAIKSKRKPVIFTLAHLANCTDTQYSDLYAFVSRKGYFSESEPHYRTFSIKKRSGGNRIIHVPHPVLKIAQSWIARHILDDGDVHDCAKAYKSGESIIDNASPHCESEWLLKLDICDFFHNISERQVYYVFRKMQYSSLLSLELARLCTKIIDKRPNHRWNNNPKNYKIKEYSSDRVGSLPQGAPTSPSLSNIICKDLDETLFMLALESNACYTRYADDLTFSFNNTTRKDIVNFKRKVSNELIKYGFKINAKKTRIVAPGARKIVTGLIVNGPVPTIPRELKDKIKADLYYCKKFGVANHCIKNKYQSIIGFSNHMRGMISFVNSVDKKLALKYKKAYDELNLPTLIL

SEQ ID NO: 1843 - protein, 379 aa, Enterobacter sp.
  source 1..379: note = Related to VWWR01000002.1
MNRWIPNTYHRNGLIQGYDKTYLKNLVQTGNIISGTHHPVIFTLGHLSKCTNTQYDDLHSFVSRKDYLSEIEPHYRTFNIKKRTGGYRNIHVPHPVLKIVQSWIARNILRQVDVHDCAKAYKVGESIYDNALPHCGAQWLLKLDIKDFFSNISERQVYYVFRKMNYPALLSLEMAKLCTKVDHLRVGKRWSNTEKNYAVKEYLFDKVGSLPQGAPTSPALSNIVFKELDELLFMLSLNHEACYTRYADDLTFSFHSSSRAEIIAFKRLVSKELLKFGFNINPKKTRIVPPGARKIVTGLIVNTHKPSIPKEIRDKVKADLYYCEKYGVINHCVKNNYKSIIGFSNHISGMISFIYSIDPVQGGKFKKVYDKLNLPLFVL

SEQ ID NO: 1844 - protein, 380 aa, unidentified
  source 1..380: note = Related to NZ_CP078092.1; note = Geobacter sulfurreducens
MSIWSPLLFNAEGKKQGYDCRYLHKLTDQGNKLSDSGLPVIFTLAHLCAMAGVSFSLIHSCVSRKYDPYRSFTIKKRSGGYRQIVVPEPELMHLQRWINEFILKRAKVHSCAAAYISGSDIKMNASKHLGANWLIKLDIQRFFESISELQVYYIFHRLGYPKLLSFEMARICTRVDTQSNRHFRPRWNNRIHHFEILEYCDSRVGYLPQGAPTSPSLSNLTCRKLDKEIYDLSCRSDCRYTRYADDFAFSFIDLDREKASNFVNQVSRIISSYGFRKNARKTKIIPPGSKKIITGLVLGNGKVHLQKELKDYIRQNIYFATKYGVDEHCKKRGFVSIDGFYNHLEGIVNFALFIEPDFGEKAFEEFRAIKWPSLIVGLHA

SEQ ID NO: 1845 - protein, 370 aa, Leptospira sp.
  source 1..370: note = Related to NZ_NPDS01000002.1; note = Leptospira barantonii
MLNGGPFKYIKESLIKSNSILYKIKISIYVRKLSSKNLPILFNLKHLCNIINVSYVKSKDIVSRKYYAYKHFTIKKRSGGVRHIHIPKDELRLIQKWVHNNILLKNSYDDSAFAYISGRNIKMHAERHCMARWVLKIDLENFFENTTERKVFHIFKKMGYSNIMSFDLARLTTIPVNIKAKEKLKKWKNKSSINKSDRILGSLPQGAPSSPLLSNLCFADLDREIFSIANSAEFVYTRYSDDLIFSTFEGDRMKVLNLLKDVRKLLSIGGYRINNKKVKILSPGARKIITGLNINQGFPKVNKSYIMEVKKHLYYCLKFGPLSHCEKINFRNIVSFKAFLKGRINYIKLIDPVVGLKLSQKFELIHWPII

SEQ ID NO: 1846 - protein, 320 aa, Leptospira interrogans
  source 1..320: note = Related to CP043881.1
MNVSYTKTKDIVDRKSYPYKHFSIKKRNGGFRNIHIPQDELRLIQKWIHKNILLKNNYKDCAFAYIPGRNIKMHAERHCMARWLLKIDLENFFENTTERRVFHVFRNMGYSKKMSFDFARLSTIPMNIKKKESSGKWKNRFPIGRLDRILGSLPQGAPSSPLLSNLCFSELDRKIISIADSFEFVYTRYSDDLVFSCFEGDRIKVIKLLKSIRKLLSMYGYRINNKKIKIITPGARKIITGLNINQNTPKVSKSYITEVNKHLYYCKKFGPLSHCERIKFRNTVSYRDHLKGRIDYIRLIDPVEGTKLLQKFELINWPLI

SEQ ID NO: 1847 - protein, 392 aa, unidentified
  source 1..392: note = Bacteroidetes bacterium; note = Related to PSRA01000192.1
METWSTHQLYQSAVASLGLDAAADLRVYCQRLRLKGVAVVFTLGHLARITDVNYQTLRESVNRRRESANYRMYAVKKRSGGRRFIHSVCTDLFKVQRFINQEILQKCMPHPASFAFHNSGGIRKCAAMHCGARWLFQSDLTDFFYNVTEIDAYRVFQEIGYRHVLAFELARLCTTTHLPRSQMRRLYVEEWAYFNKHARKQTGDGEDDSVTMPYAARFGVAGVLPQGAPTSPMLSNLAAAKLDESLQNFASKNGFVYTRYADDITISASDLPKSVSSLHRSIVQIIRKSGFKENRKKTRIAGPGSKKVVLGLLVDGDQPRISKETYRRIDRHLHASLKYGLVETAVHEGFDSAFGFHNHLSGLVAFVKDVDTKRWEEFALRLSKVRVPWSEN

SEQ ID NO: 1848 - protein, 398 aa, unidentified
  source 1..398: note = Related to NZ_CP036298.1; note = Aureliella helgolandensis
METWSAHQLFTTAERSIGKSAAYALQSYAQSLEAKKLPVVFTLRHLSTITGVSYRVLHQTVNRKREACNYRMYAIKKRSGGRRIIHSVCEDLIRVQDFVNREILQRCQPHPASFAFHSSGGIKECASMHCGARWVFQFDLSDFFYDVTEIDVYRIFDDLGYRSLLAFELARLCTTTKLPRHLKHLLYHCANPDNLIQDFEDDFEKPGNGVRRLPYPERHGVVGVLPQGAPTSPMLSNLAARRMDELLQSFAFDSGFVYTRYADDLTFSAARLQDKHGVCSVRREVIGLIRKSGFKENSKKSRIAGPGSKKVVLGLLVDGDTPRISRETYRRIDRLLYGALQNGFESASAFNKFDSALGFYNHLGGLIAFVKSVDEKRWSEFSNRMRGIEQKWGDFGDI

SEQ ID NO: 1849 - protein, 394 aa, unidentified
  source 1..394: note = Chlorobiaceae bacterium; note = Related to JAAXWO010000007.1
MDAWSVHHLYENAKNQRDMQTAASLRDYAAQLRSSGLPVIFTLGHLAKIVGVETEILHETVNRQRESANYRMYAVAKRSGGRRFIHAVTPELFRVQQYLHKEILCGVKPHPAAFAFHSSGGIRQCASQHCGARWLFQYDLKDFFYEISEVDVYRIFNGLGYRKLLSFEIARLCTTTRLPISFKRYLRASYSEKPNFDNVELLDDAFSGYLKFKPYLHSQRTGVLPQGAPSSPMLSNLAARHLDESLHEYAFQLGFVYTRYADDISISAYDLPSKMSRGDIHRAIVHRIRKARFLENEKKTRIAGPGSKKLVLGLLVDGDSPRLSKETYMRIDRLLYAANKYGLVNTAKHENFYSAYGFYNHLSGLVAFVKDVDIKRWAEFKLRLSELDVPWETT

SEQ ID NO: 1850 - protein, 378 aa, unidentified
  source 1..378: note = Related to PNKZ01000003.1; note = Pirellula sp.
METWSAHQLVTAAEPSLGPAIAEQLRRYSTQLRRQELPVIFSLQHLAKITGVQYQTLHDTVRRRREAANYRMYAVSKRSGGRRFIHAVCGELKAVQQFINAEILQRCKPHPCSYAFHSSGGIRQCAAAHCGARWLFQFDLADFFYDVTEVDVYRIFHGLGYRRLLAFEMARLCTTTRLPKTFLQLPATRRRDLTQVGDHEVDRIRPYQRHQRGVLPQGAPSSPMLANLAAAALDCTITEYADNNGLVYTRYADDITLSARDLRYDRARIRRQVISMIRKCGFRENPNKCRIAGPGSKKVVLGLLVDGESPRASRETYRQIDRLVYGVRKFGGKAAAAHFGFESEYGFRNHLAGLVAFIKSVDLDRWNELSEVLRHVGI

SEQ ID NO: 1851 - protein, 374 aa, unidentified
  source 1..374: note = Related to CP045236.1; note = Burkholderia cepacia
MEDWSAHQLFQAASASLDRSTATALSAYARTLQSAKLPVVFSLRHLSGIVGVSYKMLRESVRRKREAANYRIYRIAKRDGTFRHIHEVTSDLFRVQTFLAHEILAKVSPHPAAFAFHAGGGIKKCAAQHCGARWIFQYDLSNFFYSINEADVYRLFCHLGYRPLLAFEFARLSTTIRMPPYMAGIINMVSPDHRGMPYADACNKLGVLPQGAPSSPAISNLVAKDLDDRLTKVAVHYKLVYTRYADDITISAMDVGKGRSRGEIHRSVIHAIRKSGFVENESKTRIAGPGSKKLVLGLLVDGPQPRLSRQMYERVDTRLYACRKFGLEATADFYKFDSAYGFYNHLAGLLSFIKDVDPLSWNSFAPRFKEIPPP

SEQ ID NO: 1852 - protein, 390 aa, unidentified
  source 1..390: note = Related to JAGRPC010000052.1; note = Verrucomicrobiae bacterium
METWSTHHLYNDALAVHDTDTALEIRSYAQNLITKGHPVVFSLEHLSRITHVSYAMLRATIERNRESANYRMFAVSKRSGGLRFIHAVTGDLQIVQRFINQEILQNCRNHPASFAFHSSGGIRKCAAQHCGAKWLFQFDLSDFFYAVNEAQVFRIFREMGYRELLAFELGRLCTTTRLPRNKHMYLKWRPGPPLFPRFGGEARGEGLPYPQSSGQLGVLPQGAPTSPMLSNLAAGKLDESLSAFANDLGFVYTRYADDITISATNIPRGVAIGTICHRVIDCIRKAGFTENREKIRIAGPGSKKVVLGLLVDGPQPRISRETYKRIDRHLHAAKIYGLEATAQHEGFDSAFGFHNHLTGLVRFVHDVDLKRWADFSQRLTSIEVPWQAMP

SEQ ID NO: 1853 - protein, 388 aa, unidentified
  source 1..388: note = Related to nan
MEVWSVHQLFEQAKADLGVDRSSELRKYAQYLIHSGLPVIFSLKHLSKITRVNYGVLRDTVGRRRESANYRMFPVKKRSGGRRFIHAVSGQLFSVQQFINADILQNVAPHTSSFAFHWNGGIQKCAAMHCGAKWLFQFDLSDFFYDINEIDVFRIFQQLGYRKLLAFELARICTTIHLPAHLKCTFKVHRYFPECHPPYGVSYDAGVLPQGAPTSPMLSNLAARELDERLFEFAVANGFVYTRYADDITLSARELPSRVSVGDIHRQSTHIIRTCGFRENKKKTRVAGPGSRKIVLGLLIDGDQPRISRETYNRIDRHLYAATKFGIVETASHEGFDSAYGFYNHLAGLISFVNDVDKKRWTEFHARLSKITVPWQTPSGTQYGEFSQ

SEQ ID NO: 1854 - protein, 394 aa, unidentified
  source 1..394: note = Related to NZ_LT907975.1; note = Pseudodesulfovibrio profundus
MEEWSVHQFQQGAIAASAPCVDDLVRYARLLKNNGLPVIFSLGHLCKITRSNYKFLHNIVNRKVDSQNYRLFPIKKRSGGIRHIHAVAGKLYKVHDYINNDILQSCSPHPSSYAFHRSGGIFKCAKQHCESRWIFQFDLKDFFYSISEAMVFTALKNLGYKKLLAFELARICTTRHLPANKIRYTARFSKSLPSYYNNKPYRETYHHGVLPQGAPSSPMLSNLVALRLDETLSAYADENGLTYTRYADDITLSTLALPSKVSVGGIKRAVIKIIRRAGFIENPKKIRVAGPGSRKTVLGLLVDQSSPRISRHTYKRIDRLLYSISQYKLAGVAEHDGFDSSFGLYNHLHGLINYVKDVDYSRWEEFSKQFQPIKEQFESEFDVSNTAQFMLSST

SEQ ID NO: 1855 - protein, 395 aa, unidentified
  source 1..395: note = Related to NZ_SJPT01000002.1; note = Novipirellula galeiformis
METWSAHQLYTEAESSLGEAAARNLQAYSEQLRAKGLPVIFSLRHLAELSGVRYWFLHETVNRMREVANYRMFAIKKRSGGRRHIHSVSNELGRVQQWINQHLLQNCKPHAASFAFHKEGGIRQCAERHCGARWLFQFDLVDFFYDVSERDCFNVFKGLGYRPLLAFELARICTTTRLPAWCPRAEFHGEQLRWENIWCEDDLNPVNPNTSRNFPYYERFGRLGALPQGAPTSPMLSNLAAKYLDESLQHFANKNGLIYTRYADDITFSACRLGVARGRVLWQVKDLIKRAHFAVNPKKTRIAGPGSKKLVLGLLVDGSTPRISRETYKRIERLLYGAKQFGFEAAASHFKFDSAYGFHNHLSGLVAFVKDVDRKRWQEFNAVLLNAKSSWGNDV

SEQ ID NO: 1856 - protein, 377 aa, unidentified
  source 1..377: note = Candidatus Acidulodesulfobacterium acidiphilum; note = Related to SHMQ01000020.1
MEDWSTHQLKENAIIKLGSEKANDLQKYTTNLKIQSLPVIFTLNHLGIITNTEYSFLYKTVCREREYVNYRMFPIKKRSGGTRFIHAVSKKLSIVQTFINNIILQSQQPHNCSYAYHPSGGIKKCAAMHCNAKWLFQFDLADFFYRINEIDVYNIFQRMGYRKLLSFELARLCTTIRLPRQLQSMLKQFKSFSLDDYPFYNNDFIGVLPQGSPTSPMLSNLAAMELDEDLYVFALKNGFIYTRYADDLTFSAINLPQGMSIGKIRWQIIQIIRKNCFKENSNKIRIAGPGAKKIVLGLLVDGNQPRISKEMYKRIEKIFYYVNRFKFENTAKHLGFNSTFGLINHLLGLISYLKDVDSDRYGLFNKKFNELMLSLGC

SEQ ID NO: 1857 - protein, 376 aa, unidentified
  source 1..376: note = Lachnospiraceae bacterium; note = Related to DNVK01000297.1
MEAWSTHHLAQQAAKTLGSDAAASLQSYAQVLISKGLAVVFTLGHLSRITGVSYQVLRDTVDRKRDSANYRMYAINKRSGGLRFIHSVSRDLLIVQRFINQHILQKCAPHPSSFAYHPSGGIKKCATMHCGARWLFHFDLKDFFYDITEIDVFHIFKAMGYRNLLAFELARLCTTTCLPKGQERLLFHSTNSKYNVYRDPNGIVGVLPQGAPTSPMLSNLAAQKLDEELSSFALMHGFVYTRYADDITFSASYIPKGLNIGNIQRQIIHIIRTTGFEENNQKIHIAGPGSKKVVLGLLVDGNEPRISREMYHRIERYLYAIEKYGLRNVACHEGFISAYGFFNHLTGLIAFVKDVDQKRWEEFSSRISRIQTPWHL

SEQ ID NO: 1858 - protein, 382 aa, unidentified
  source 1..382: note = Related to NZ_QGKL01000023.1; note = Leucothrix arctica
METWSAHQLYNDAKHRFKDIEKASSLRSYAQFLIDKNLPVIFSLKHLAKINDLNYSFLRLTVERRRESSNYRMYAVKKRAGGRRFIHSVTKKLLKVQTFINTEILQYCLPHPSSFAFHPSGGIRRCAEQHCSARWMFQFDILNFFHAINEVEVFNIFTGLGYRPLVAFEMARICTTTHVPNHLKPLLFRKSNNTPYNFYANKSGAIGVLPQGAPTSPMLANLVAKKLDEELSSFVRKHGFTYTRYADDITISAVDLPDNLSIGEIHRSVISIIRRCKFRENIKKTRVAGPGSKKLVLGLLVDGDKPRISREMYKRIDRNLHALEKYPIADVAKYEGFDSSFGFFNHVSGLVAFTKDVDTERWEKFKKRIDGIELPWESKLVT

SEQ ID NO: 1859 - protein, 380 aa, unidentified
  source 1..380: note = Related to CABVQD010000004.1; note = Burkholderia sp.
METWSVHHLSQQATSVLGKSIAQDLTSYAQRLRRSGLPVVFTLRHLSRIVGVDYSLLRASVERRRESANYRMFAIKKRSGGRRHIHAITGDLFKAQQFINAEILQKLNPHPASFAFHPGGGIRACAAAHCGARWLFQYDLSDFFHSISEADAYKVFFTAGYRPLLAFELARICTTTRLPDHLKHHLWAHRAWRDYKFYGDHTHAMGVLPQGAPTSPMLSNLAAHHLDIVLTEFADRHGMSYTRYADDLTLSTSSDLPDGMSIGNIHRAVIGIIRKSGFQENKKKIRIAGPGSKKIVLGLLVDGTAPRLSKETYKRIDRHLHATQKYGLANVASHEGFDSPLGFYNHLSGLIAFVKDVDLVRWKEFHDQFSKIESPMNGGV

SEQ ID NO: 1860 - protein, 383 aa, unidentified
  source 1..383: note = Gammaproteobacteria bacterium; note = Related to SSEJ01000200.1
MEAWSVHHLSQAVTPVLGKSAADHLKDYAQRLRRANLPVIFTLRHLAKITAVEYGVLRATVERRRESANYRIFAVKKRSGGRRHIHAVSGDLFKVQQFINLELLQKLRPHPASYAFHAEGGIHKCASVHCGARWLFQYDLENFFHALSESDAYRVFMKAGYRPLLAFELARLCTTTRLPAHLKHHLRPKRHAASMKAYQFYVERSGATGVLPQGAPTSPMLSNLAAFDLDEKLTAFADLHGFTYTRYADDLTFSAGGELPERMSIGDIHRTIVGVIRKCGFRENTKKTRVAGPGSKKVVLGLLVDGTVPRLPRETYKRIDRHLHATQKYGLVAVAAHESFDSAIGFHNHLAGLIAFVKDVDTARWEEFHRQFSMIPAPMSAGT

SEQ ID NO: 1861 - protein, 382 aa, Pseudomonas sp.
  source 1..382: note = Related to CVTP01000021.1
MEDWSVHHLHKAAELKLGASEAAQIRIYAQQLIRKKMPVIFTLKHLSMIAGVDYLALRRTVERRREAANYRMFAIKKRSGGRRFIHSVTEPLHRTQQFINSEILQKIEPHPASFAFHSSGGIRKCAEVHCGARWIFSFDLADFFFKISEAKAYEIFHKAGYRPLLAFELARICTTTRLPKKLHYLLRNTDNAWCQNENWGKYQIYSRHAYSIGVLPQGAPTSPMLSNLAALKLDVALTEFADKYGFSYTRYADDLSISSCSDLPSSLSIARICRIVIGIIRKCGFEENQKKTRIAGPGAKKIVLGLLVDGPTPRISKETYKRIDRHLHAIQKYGFAEVATHEKFDSPIGLYNHIHGLISFVKDVDPKRWGEFNCQLLAMPAP

SEQ ID NO: 1862 - protein, 382 aa, unidentified
  source 1..382: note = Related to NC_008786.1; note = Verminephrobacter eiseniae
MEAWSVHHLSQKAEPILGQAAADDLKTYALRLRQAGLPVIFSLGHLSRITGVDYSLLRATVERRRESANYRMFAIKKRSGGRRHIHAVTGELFKAHQFINTEILQKLEPHVASFAFHADGGIRTCASEHCGAQWLFQFDLANFFYSVNEADVYGVFVGLGYRPLLAFEMARICTTTRLPKHLLPHLWTHRSHKSHGYQFYADRSGAMGVLPQGAPTSPMLSNLVARRLDEKLTEFSTQYGFVYTRYADDLTLSCGGNLPRGMAIGNLHRKVTGIIRKNGFRENLDKTRIAGPGSKKVVLGLLVDGEGPRISKETFKRIDRHLHASEKYGLPDVAKHEKFDSPSGFYNHLAGLIAFVKDVDKVRWEEFHARFSRLQSPMNSSA

SEQ ID NO: 1863 - protein, 382 aa, Pseudomonas sp.
  source 1..382: note = Related to DAFPEA010000002.1; note = Pseudomonas aeruginosa
MEAWSVHHLSQKAEPLLGQAAADDLKAYALRLRQAGLPVIFSLGHLSKIVGVDYSLLRASVERRREAANYRMFAIKKCSGGRRHIHAVTGELFKVQQFINSEILQKRKPHAASFAFHPDGGIRACASEHCGARWLFQFDLSNFFYSVSEADVYGVLAELGYSPLLAFEMARICTTTRLPEHLKRYLWSALSHKVRDYRLYVDRSGAMGVLPQGAPTSPMLSNLAARNLDKALTAFSTQYGFVYTRYADDITLSSGGNLPEGMSIGSIHRSVIGVIRKNGFRENPDKTRIAGPGSKKLVLGLLVDGEVPRISKETFKRIDRHLHAAERYGLVDVAKHEKFDSPIGFYNHLEGLIAFVKDVERERWKVLYDRFSKLQAPMNVGS

SEQ ID NO: 1864 - protein, 394 aa, unidentified
  source 1..394: note = Related to JADZHH010000033.1; note = Shewanella algae
METWSVHQLSTAAKSTLDESSVVHLKSYAQSLKRSGLPVIFTLGHLSKIIDIDYSFLRATVERRRESANYRMFAIKKRSGGRRHIHSVTGGLLQAQQFINSEILQKIEPHSASFAFHKKGGIRACASMHCGARWMFQYDLADFFYSVNEANVYGIFSALGYRPLLAFEMARICTTLRLPNHLGHLLIDPRTKVKGKFYNLYQRYMEVPGFGTMPYMSSMGVLPQGAPTSPMLSNLAARNLDVELTDYADQNGLIYTRYADDLTLSSSENFPEGLSIGDIHRSIVGIIRRNKFKENRKKTRVAGPGSKKLVLGLLVDGDSPRLSKETYKRIDRHLYSIQKYGILSVSKHEKFDSPLGFYNHLSGLIAYVKDVDTNRWKEFHRRLLEISYPIEMNY

SEQ ID NO: 1865 - protein, 387 aa, unidentified
  source 1..387: note = Related to NZ_CP012264.1; note = Cronobacter condimenti
MEIWSAHQLYQNAESSLGKTQALNLRNYASNLKKNNLPVIFTLRHLSKITGVDYRLLRSTVSRRRESANYRMFAIKKRSGGRRHIHAVTGEIFKVQHFINSEILKKLVPHNTSFAFHPNGGIRKCAEQHCGAKWLFQFDISDFFYSINESDVYMVFKNAGYRPLIAFELSRLCTTIRLPQHLQSLISVPKHSTKEYKLYGQNKEKNLFWDISEPWPLGVLPQGAPSSPMLSNLATVKLDISLSEYANKYGFTYTRYADDITLSCGGTLPDSVSVGKIKNNIISIIRKHHFKENVSKIRVAGPGSKKIVLGLLVDGNVPRLSKQTYKRIERHLYSIKKFGLSEVARHEKFDSPIGFYNHVAGLIAFVKDVDNARWLEFSQKFVSIEHP

SEQ ID NO: 1866 - protein, 387 aa, unidentified
  source 1..387: note = Related to JAAQVQ010000001.1; note = Providencia heimbachae
MEIWSVHQLYQEAEASLDKESALNLRNYANNLKKRNFPVIFSLRHLSIITGVDYSVLRSTVARRRESANYRMFAIKKRSGGRRHIHAVTSELFKVQHFINSVILQKIKPHNASYAFHSDGGVRKCAEQHCGARWLFQFDIADFFYSINESDIYNIFVSAGYRPLLAFELSRLCTTLRLPTHLRSLILLPKYSVKEYKFYNQYNTNHNSRIIPEPFPLGVLPQGAPSSPMLSNLASEKLDVSLADYADKNGFIYTRYADDITFSCGNDLADGVSVKKVRRDVISIIRKHHFIENTNKIRISGPGSKKVVLGLLVDGNAPRLSKETYKRIDRHLYAIQKFGLNEVAKYEKFDSPIGFYNHVAGLIAYVKDVDNARWLQFHQRFSIINHP

SEQ ID NO: 1867 - protein, 390 aa, Salmonella sp.
  source 1..390: note = Related to AAMXLY010000014.1; note = Salmonella enterica
METWSTHHLSQEAEVLLGKESALKLTRYSNKLKRNDLPVIFTLRHLSKIVKVDYKLLRSTVNRQRESANYRMFAIKKRSGGRRHIHAVTGELFKVQHFINSEILQKIKPHNLSFAFHTNGGIRKCAEMHCGARWLFQFDIENFFYSINESDVYKIFLAAGYRPLLSFELARICTTLCLPAHLASLIQRNAHSRKKYKLYNPNKNCSSSFLDEYRPKPMGVLPQGAPSSPMISNLVAKELDISMEEYADKNSLIYTRYADDITLSSSSDLPKGVSTGKIRRDIIEIIRKNHFKENRNKTRIAGPGSKKIVLGLLVDSERPRLSKETYKRITRHIYAIEKFGIEEVAKYEKFDSALGFYNHICGLISFVKDVDHERWNDFHKKISKITPPTN

SEQ ID NO: 1868 - protein, 391 aa, Pseudomonas fluorescens
  source 1..391: note = Related to JAGGOG010000019.1
MVSWSAHQLYMEAKSKLGTQQATNLRQYARVLQRKNLPVVFTLNHLAKITGISHTLLRDTVERGRERKNSRIYSIKKSSGGERFIHVINDDLAFVQKFINSEILQKLTPHPCSYAFHESGGVRECAEIHCGARWLFKFDLCDFFYHINERHVFEVFLNAGYRNLIAFEMARLCTTTRMPSNLHYLLKPNKSGIETQDKKYRFYNQHNEKLGLLPQGAPTSPMLSNLVAFKLDQKLETFAREHGLTYTRYADDITFSTSDDLPEKTSIGYIQRSVIKIISQCGFRNNTGKMHVAGPGSRKIVLGLLVDGEKARISKATFKRVDRLLHSIKVYGLDAVSVHEQFKSPVGLYEHLRGLLAFVKDVDTARWDEFKIQFHQVTSPWTDEPIVSGSL

SEQ ID NO: 1869 - protein, 382 aa, Pasteurella sp.
  source 1..382: note = Related to BQFX01000025.1; note = Pasteurella canis
METWSAHQLFNKATDKLDNAASKKLRSYALALKNRKLPVIFTLRHLSHITDVDYSLLRKTVMRRREMANYRMFPVRKHSGGWRYIHQVSRDLFKVQQFINSEILQKLSPHPSSFAFHSNGGIKACASQHCNARWLFQYDLKDFFYFINEKNIYTLFKDSGYRSLLAFELARLCTTTHLPNHLLHYIKQDSHFFNNYNFYNDIKSRIGVLPQGAPTSPMLSNLVAYKLDELLTKLSEEYGLVYTRYADDITFSSIDDYSVQHSRFRLHREIVKIIRQNGFCENTKKTRISGPGARKLVLGLLVDGCEPRLSKEMYKRIERLLYASNKYGIIEVAKNEKFDTPYGLYNHLAGLVSFVNDVDKNRWQEFNDLFSKINNPFDLKTI

SEQ ID NO: 1870 - protein, 381 aa, unidentified
  source 1..381: note = Related to NZ_UEWY01000045.1; note = Haemophilus influenzae
METWSAHQLLKKTSLKFDDITAQSLLKYCQELQNKNLPVIFTLRHLSKITNTDYLVLRKTIMRRRELANYRIFSIRKRSGGRRYIHQVTKELFQVQQFINTEILQKIQPHPASFAFYSNRGIKSCALKHCGARWLFQYDLKDFFYTINEKNIYKIFYKHGYRSLLAFELARICTTTHLPKHLLCYIHQEYNYFNLDSYKFYADSQQGVLPQGAPTSPMLSNLVAFNLDESLSKFANERGLIYTRYADDITLSSYKKSYTKYERFNIHKNIVKIIRQHDFLVNPKKTRIIGPGARKIVLGLLVDGDVPRIPKETYKRIERLLYASNKYGLLETARHEKFDTPYGFYNHLSGLLAFIKDVDNSRWIYLSKLFSNIENPFYKKI

SEQ ID NO: 1871 - protein, 378 aa, unidentified
  source 1..378: note = Related to QEPO01000001.1; note = Haemophilus parainfluenzae
MEIFSAHQLFNKASSKLGDVSAKKLVSYYQNLQTQNLPIIFTLRHLSKITSTHYLVLRKTIMRRRERVNYRIFSIRKRSGGYRYIHQVNKELFKVQQFINSEILQKTLPHPASFAFHSNGGVKRCALKHCGAKWLFQYDLKDFFYTINEKNVYEIFYNLGYRSLLAFELARICTTTRLPKCLKNYINSYSNCINYKFYNNHLLGILPQGAPTSPMLSNLAAFELDTLLTDLAKKHDLVYTRYADDITFSTYLDKRKEKFTIHKDIVKTIVESGFIINNKKTRIAGPGARKIVLGLLVDGEKPRVPKETYKRIERLLYASNKYGLIETAKHENFDTPYGFYNHISGLMAFVKDVDFERWKYLNNVFSKIEDPLNIFIQN

SEQ ID NO: 1872 - protein, 388 aa, unidentified
  source 1..388: note = Related to NZ_CAJZCI010000001.1; note = Snodgrassella alvi
MENWSAHHLFQKSIPILGNRSSQELKNYAISLHRRKLPVIFTLRHLSKITNVDYLLLRKTVMRHREMANYRVFTIKKRSGGRRYIHRVSKELFKVQQFINFEILQKITPHHASFAFHSKGGIHACALSHCGARWLFQYDLKDFFYSINEIDIYNIFKDNGYRPLLAFELARICTTTALPKDFFKLQNYLNYISNYKFNNLQNYKFYNNRSGLIGVLPQGAPTSPMLSNLAAFKLDNSLTELADKYGLIYTRYADDITFSSSSSLPRGKIITDIHKAIINAIRKNDFYENAKKTRIAGPGARKLVLGLLVDGAVPRIPKETYKRIERLLYAIKEYNLLEVAKHEKFDTPYGLYNHLSGLLAFVKDVDIVRWRKFQQLFLEIAPPNNQTI

SEQ ID NO: 1873 - protein, 377 aa, unidentified
  source 1..377: note = Related to FR900422.1; note = Fusobacterium sp.
MEAWSIHHLIKEANRQGNLSKESIIDLQCYAQNLIKNDVPVIFTLMHLAFITNLNYDFLYGTVSRRFDKSNYRMFSIRKRNGKHRFIHAAIKNLHILHNYINKEILKNIPIHPCAYAFNRNGGILKCAQKHCGCEWLLQFDLKDFFFSITESNVYNVFKSIGYKDILAFELARICTTTRLPRSYNMPRNKNAYNYKQYKYDLIGVLPQGAATSPALSNLVAKNLDEELQEYAKNLGFVYTRYADDLTFSTVSLPNNLSIDTIRRQIIKIIRKNHFIENKEKSRIAGPGAKKLVLGLLVDGKQPRISKEGFKRIEGLLYIIKKFGLQSVAKERGFYSTYGLMNHLIGLMAYLKDVDIAKYNKIEPLFSEIKSRYGELF

SEQ ID NO: 1874 - protein, 376 aa, unidentified
  source 1..376: note = Related to JAGZDN010000040.1; note = Akkermansia sp.
METWSAHHLFQEASKQLDCDTIFLLQNYALDLRSKKLPVIFSLGHLGKITGIDYDFLYRSVNRKYESINYNMFSIRKRSGGNRFIHAVNGKLFKLQKYLNEEILQKINPHPSSFAFHASGGIRQCANQHCGCRWLFQFDLKDFFYTIAEPHVFKIFKEIGYKKILAFELARLCTTIRLPKTKSSYIKYNKYVSENTPYFPQNYIGVLPQGAPTSPMLSNLAARRLDEMLYDYSQNYGLVYTRYADDLAFSASVLPPHKSIARIKRDIISIIRRNNFFENNKKIRIAGPGSRKTILGLLVDGEKPRLTKQLRNRIERNIFSIEKFGIREVANHDKFESVYGFFNHLSGLMSFIHDVDLTLWNKLQPRFATIKKLVEL

SEQ ID NO: 1875 - protein, 374 aa, unidentified
  source 1..374: note = Related to NZ_SMLM01000002.1; note = Ramlibacter henchirensis
METWSAHHLFSAAATKIGVARAGRLAAYVAKLQRRNLPVITTLGHLAEIVGVSYSFLRQTVERKREAANYKLFAISKRSGGRRFIHEVGTQLLIVQRFLNQEVLQGIAPHPASFAFHSTGGIRKCAQMHCGASWLLHFDLKDFFYSISEWSVYEVFASLQYRPLLSFELARLCTTLHLPGASQAYLRPSTAAQRYSFYRKDVMGVLPQGAPTSPMLANLAAHDLDARLQDFADAAGMIYTRYADDLTFSTVRLSAPISQLQYEVSRQIGLTGFSENKRKRRVAGPGSRRTVLGLLVDGAEPKLSRQFIARVDRHLYAAKKYGLEAAASRAAFDSAFGFHNHLGGLVAYSMDAERKRGAMFLERLREIPVPWQTA

SEQ ID NO: 1876 - protein, 380 aa, unidentified
  source 1..380: note = Related to NC_010334.1; note = Shewanella halifaxensis
MESWSAHHLNKKALETLSNDEVKDLTFYARNLISKNTPVIFTLKHLSEIMEKRYTFLRSTVERKREHSNYKMFSISKRSGGRRFIHAVSNQLQPVQQWINTEILQKQKPHNASFAFHANGGIKKCAAMHCGARWILKFDISNFFYCINETDVYQFFVSLGYRPLLAFELARICTTLRLPIQHQKYIRSRNSSRLEYKFYYQPEGCRGVLPQGAPTSPMLSNLIATKLDEQLTQYALENGFTYTRYADDLAFSAIDLPEKKSIGKIQFEITGIMKAQGFKENEKKTSVAGPGSKKMILGLLVDGEQPRLSKQMYKKLDRYLYAIEKFGLDSVATHEKFDSTFGFYNHLCGYISFVKSVDAPRGEEFEKRMNNITPPWTSHP

SEQ ID NO: 1877 - protein, 381 aa, Acinetobacter sp.
  source 1..381: note = Related to NZ_BKIP01000082.1; note = Acinetobacter lactucae
MEIWSLHQLHSASVEKLGLSQANSLRQYSENLKENNLPTIFTLNHLAKITGVTYHFLRSTVLRNRELANYKMYAINKKSGGRRHIHSVNGKLLKVQTFINEEILQNIITSKSSYAFSKGKGIKSCAQAHCGARWIFKFDLENFFYSINEAQVYTIFNSLGYTSLLSFELARICTTTRLPVELSKLLKRGTFDPFNSINSYTIYNKNCFLGVLPQGAPTSPMLSNLVAKSLDTVLKELASTYGLTYTRYADDLTFSTSMDLPKNLSIGELQRQIIQQIRKQGFKENSKKTVVLGPGSRKIVLGLLVDTAEPRLSKAMLKRIDRLVYASSKFGIIEAAEHEGFDSPIGFFNHVSGLISFVKHIDNRKYQYFSSKFPDFDLHLT

SEQ ID NO: 1878 - protein, 378 aa, Acinetobacter sp.
  source 1..378: note = Related to NZ_LMED01000026.1
METWSLHRLYTCSAEKLGADKATKLKRYSENLKRKNLPTIFTLNHLAKITGVDYHFLRSTVLRNREIANYKMYAIRKRSGGRRHIHSVNGKLLKVQTFINEEILQNIPVSSSSYAFKKNSGIKECAQAHCEAKWIFKFDLENFFYSINEHQVYKIFKDLGYTSLLSFEIAKICTTTRLPTNLSNLLKVKNNSDFNSYRFYQNNYCLGVLPQGSPTSPMLSNLVAQNLDNALIGLASNYNLTYTRYADDLTFSTPINLPQNLSIGKLQREIFYEIRRHGFKENKKKTVILGPGSRKIVLGLLVDTSEPRLSKAMLKRIDRLVYAAHKFGIIEAAEHEGFESPIGFFNHVNGLISFVKHIDINKYHYFSSKFPIFEFDNF

SEQ ID NO: 1879 - protein, 379 aa, Acinetobacter sp.
  source 1..379: note = Related to CP029610.1; note = Acinetobacter pittii
MEVWSLHQLYTESVEKLGANKAKQLRKYSTNLKENNLPTIFTLNHLAKITGVTYHFLRSTVLRNREIANYKMYAIHKRNGGLRHIHSVNGKLLKVQTFLNEEILQHTTVSRSSYAFSKNGGIKPCAQVHCGAKWIFKFDLENFFYSINEYQVYKIFKDLGYTPLLSFELARICTTIRLPTNMHSLLKESNNTFFKDYKFYQNNSRLGVLPQGAPTSPMLSNLVARHLDNALKELADNWGLTYTRYADDLTFSTPTNLPSNLSIGELQRKVISTIRKHGFKENKEKTVVLGPGSRKIVLGLLVDTHEPRLSKVMLKRIDRLVHASNKYGIVAVAKHEGFKSPIGFFNHVSGLISFVKHIDMNKYQYFSSKFPDFKFNDLS

SEQ ID NO: 1880 - protein, 380 aa, unidentified
  source 1..380: note = Deltaproteobacteria bacterium; note = Related to QMMV01000171.1
METWSAHHLFKKATAQLNDSVALDLSRYAQCLRNQELPVIFTLGHLAKITGIDYRFLHATVNREREAANYRMFAIRKRSGGKRFIHAVSNTLSSVHEFLNREVLSKVDPHPASYAYHRSGGIRACAQRHCGARWLLHFDLKDFFFTIHEAKVYQIFREMGYRELLSFELARLCTTTRLPRHLSHLTKPSDPCFKLNELPYRRYHSIGVLPQGASTSPMLSNLAARHLDQDLYLFAKELGLVYTRYADDLTFSAYDLPRGWSIGKLKFYVEKTIRKHGFRTNPSKFSVCGPGSRKIVLGLLVDGDHPRLSKWTRHRIDRLLYSVDKFGWEKVAEFDEFDSLYGFFNHLRGLIAYAKDADPMHGEQYRSRFEELIERFPVEL

SEQ ID NO: 1881 - protein, 369 aa, unidentified
  source 1..369: note = Related to SDPD01000012.1; note = Haemophilus haemolyticus
MENWSLHTLNQKLEEDFSDEQLNTWIQYARNLRKQNLPIIFNLKHLSKITNINQHLLYSVICRFKEKDYYKIFRIKKKTGGYRFIHSPNNELKKVQYFINKYILSKLDIHKSCFSYHKDGGVLRCAEQHTNAKILFKYDLKDFFFCINEMSVYHLFKSLGYTKKLSFQMARLCTIILIKDHGKYIKKYKVKDKEIELGVLPQGAPTSPMLSNLLANQLDVKLSQLADTNNLIYTRYADDLTFSSNKKLSKIEIRTINSKILKIIKYEKFIINKNKISISRQGSRKQVLGLIVNNDTPKLSKDRKKKIDTFLYAIEKFGWESTTEHYGFRDSLGFFHHLDGIIIYAEHIDKDLGKKYRNKLDKLLPKLFR

SEQ ID NO: 1882 - protein, 380 aa, Enterobacter sp.
  source 1..380: note = Related to CP039452.1; note = Enterobacter bugandensis
MTIVPSHLYYLGGIKAKRIPAVLSATMAKAAKFLINDVVYIHNLQHLVKLSSVDKVYLDDIILRRKNEYEHYTVEKKSGGSRFISAPKEDLKQLQRWINYYILRNLKPHPCCYSYHKNSSIYSCAMVHCSSQWLVKLDVENFFDMTSERSVYEQFILIGYSPIVSFALARICTYQPTFLTKNHSKWVLYKRKNRELAYSRDNIKYIGRLPQGAPTSPMLSNMVFFELDKIIFKLVQSHGGLYTRYADDLFISFPKKDMNRSDISKIIGRVVDYLRKKGYSLNKTKIKVSPPGAKKIVLGLNVDKHIPHLSKEFKKSIDSHLYALSEFGPVAHARFRGFNSVYGMLEHIKGKIFFAKTISQDYGLKCIQEFYAALEKHGFN

SEQ ID NO: 1883 - protein, 380 aa, Escherichia coli
  source 1..380: note = Related to JAIOVT010000001.1
MTIVPSHLYYLGGVKARRTPAVLSAIMAKSAQFHTNDIVYIHNLQHLVKLTSVEKTYFDRVILREVHEYEHYSIAKKSGGYRYISAPKEDLKKLQRWINFYVLKNLNPHPCCFSYHKNSSIYNCALAHCASKWLIKLDIENFFDMTSERNVYDQFRLIGYSPIVSFALARICTYQPKYLNKNHDRWVLYKRDTQELVYSKKNVKYLGRLPQGAPTSPMLSNVVFYELDELIYKLVQENGGLYTRYADDIFISFPKKEMGRNDVSKIIGRVIGYLRKKGYSLNKTKIKVSPPGAKKIILGLNVNGDTPQLSKDFKNSINSHLYSLETYGPVLHAQYRGFDSVYGMLEHIKGKISFAKNISYDYGVKCYDEFYSALEKHGFN

SEQ ID NO: 1884 - protein, 380 aa, unidentified
  source 1..380: note = Related to NZ_JAKCWE010000004.1; note = Serratia marcescens
MTIVPSHLYYLEGIQARRTPSVLSAVMAKSARFHIDGITYIHNLQHLVKLSLIDKKYLNDLILRKTHDYEHFSIKKKSGGHRYISAPKEDLKRLQKWVNFYVLKNLSPHPCCYSYHKNSSIYKCALAHCSSKWLIKLDIESFFDMTSELSVYKQFKSIGYSPIVSFALTRICTYQPKFLTNNHDRWILYKRKNKDFIYPREGIKYIGRLPQGAPTSPMLSNMIFYKTDELIYNFIKKRGGIYTRYADDIFISFSEEEFTRDDVSNIIGRIVGYLKSNGYSLNKTKIKISPPGARKTILSFNVNESTPKLSKEFKKSIESHLYALNTFGPVLHAQYRGFDSVYGMLEHIKGKIFFAKSIYLEYGIACFNEFNSALEKHGFN

SEQ ID NO: 1885 - protein, 380 aa, unidentified
  source 1..380: note = Related to DAGCNY010000007.1; note = Klebsiella aerogenes
MTIVPSHLYFIGGVEARREPAVLKSLMAKSSKFHDHGLTYIHSIQHLSKLIYTDENYLKSIILRKSSEYDHYSIPKKSGGSRFISAPRDELKKIQHWINFNVLKNLTPHPCCYSYHKKASIYKCAAIHCSSKWLLKLDLETFFDMTSEVHVYKQFTSIGYSPIVSFALARICTYQPKKLTAHYSTWKLHSRVNRKEPFSRSGISYIGRLPQGSPTSPMLSNMAFYNLDEKIYSLVKYYGGLYSRYADDIFISFSSADINRTLISKLVGRLINHLKKEGYKLNKTKIKLSPPGSRKIVLGLNVDSETPKLSKEFKRSIDSHLYALAKHGPKLHALERNFQSVFGMLEHIKGKILFARSISREYGDKKLNEFYSALESHGFN

SEQ ID NO: 1886 - protein, 379 aa, Salmonella sp.
  source 1..379: note = Related to AAOBLA010000002.1; note = Salmonella enterica
MTIVPTHLYYIEGVKKGRPSSLLKKLVYKSGLLAERNLPYIHSVKHLSLLTGCDENYLLSIINRSNRTYSFYTVPKRSGGVRFIHAPDEELKKLQQWINAQILINVPVHPCCYSFHKDSSIKKCAEKHCGVKWLIKIDIENFFEMVSEIEIYKVFIKLGYKPIISLALARICTYEPRYLTGFYNKWVIYKKSKRLPFTSENARFFGRLPQGAPTSPMLSNLVLSSLDERINRLIKYKNGVYSRYADDIFISFGDKDINRVYLEKVIGRVTRYLEDFGYKANKTKIRLISPRALKIILGLNVGGEIVKLNSNYKKDLQCHFYGINKFGLISHASHRKFNSVLGMLEHIKGKVNFACQIEPDYGIPLKEELKNILNKNGLY

SEQ ID NO: 1887 - protein, 380 aa, unidentified
  source 1..380: note = Related to JAJVKY010000009.1; note = Klebsiella michiganensis
MTIVPSHLYYIEGVKKGRSPSILKSLIVKSSFFNYKNIPYIHDVKHLSHLLGCSQIDLTSIIKRNYSGYRFYTVPKYSGGVRFINSPNDFLKKIQRWINFNILSKVEVHPSCYSFHKNSSIKNCAEKHCGAKWLVKIDIENFFEMVSEVEVYKQFRKLGYKPIVSFALSRICTYEPTHLVNFQHKWINYNSRTDSLPFSRRNVNFFGRLPQGAPTSPMLSNLVLSSLDEKVTRLIRNKNGIYTRYADDIFISFSEMAVDRKFLRQIIGKLISYLNSFGYQANKTKIKIISPRSTKLVLGLNVAEDKVFLQKKYKNNLESHIYGMKKFGLVLHAKHRKFNSVLGMIDHINGMVNYASYIEPMYGNKLKEKIKHIVNINGLG

SEQ ID NO: 1888 - protein, 380 aa, Vibrio parahaemolyticus
  source 1..380: note = Related to MIRR01000104.1
MTIVSTHSYFQGGIKKGHSAKHLYSLMSKAHKLECYDIPYVHSIYHLAMLSRLPVHLLHSFTDRKSIHYTSYSIPKRSGGCRFLHAPSDELKSAQRWINDKILSQLPVHSSCYSYHSKGSILECAQKHCSSKWLIKLDIENFFDEISEVDVYKVFRTIGYKPMVAFILARICTYEPYTVRNNKHSWVQYNKNSDDLPYGKKHIKLFGRVPQGAPTSPMLSNLVLYKLDEKLSHFAQSRGGIYSRYADDLFISFGSDDFDRTKASQVIGSCLSSVRSYGYKLNRTKIKVVPPGSNKVVLGLNVNGDEVRLTKTYKKKIESHIYGIKKFGIDKHALHRGFDSVFSMIDHIIGLINHAKRVEPEFGADKHVEFQRILTNLGLG

SEQ ID NO: 1889 - protein, 356 aa, Vibrio sp.
  source 1..356: note = Related to DACRBQ010000013.1; note = Vibrio vulnificus
MAQAHKLECLGIPYIHSFLHFAHLTKLPESYLRSVVNRHNASYTSYAIPKRSGGSRYLQIPSDELKGLQRWINCEILNRLPVHSSCYSYHKNSSIVQCAERHCSSNWLIKLDIENFFDTINEVEVYKVFRKIGYKPLIAFGLARICTYQPISVLQNKKNWVQFNKNSDEMPFQKKHIRHFGRVPQGAPTSPMLSNLVLADLDEKLSSYAQKRGGIYTRYADDLFISFSQNNFDRQQASQVIGSVLGHVKSYGYNLKKSKIKVIPPGSNKVILGLSVNDKQVRLTKQYRQKINSHIYGIVKFGVDKHAIHRGFDSVFGMIDHVFGLINYAKTVEPDFGHTKYQELQDSLRSSGLSCT

SEQ ID NO: 1890 - protein, 354 aa, Vibrio sp.
  source 1..354: note = Related to DACRBO010000012.1; note = Vibrio vulnificus
MYKAHKMERWGIPYVHSIYHLAILSGLSVNKLNSIVGRQKQYYTAYAIPKRSGGSRFLHAPDDELKKLQRWINSEILIKLPVHPSCFSYHTGSSIVGCAEKHCSSSWLIKFDIENFFDSISEVDVYKVFRKFGYKPMISLILARICTYQSESISGDILHWVQYNKNSDELPFKKKHIRFFGRVPQGAPTSPMISNLVLSSLDEMLSQYAQKRGGIYSRYADDLFISFSQKDFDRVQASQVIGRVLNYVKSYGYKLNKTKIKVIPPGSNKVVLGLNVNGDSVLLTKTYKKRIESHIYGVGKFGIEQHALHRGFDSVFSMIDHITGLINHARLIEPTFGEKKHEEFKRLLSTLGLS

SEQ ID NO: 1891 - protein, 355 aa, Aeromonas sp.
  source 1..355: note = Related to CP023141.1; note = Aeromonas dhakensis
MSKAHHMQRWGTPYIHSIVHLSHLSNSRIELIKSIVDRKEDFYTAYTIPKRSGGSRFIHAPNAELKSLQRWINTEILYRLPVHNCCFSYHRDSSIIDCAKKHCASRWLIKFDIENFFHTIKDVDVYKVFRMYGYKPLISFMLARICTYQPKVVIENKLNWILFNTKSDDLVYSKKHVNFFGRVPQGAPTSPMLSNLVLRELDETLNQYAQKRGGIYSRYADDMFISFSQDNFDRKQASQVIGRVFTHVRKYGYNLNKTKIKVIPPGQNKVILGLNVNGRDVLLTREFKQRIESHIYGIKKFGVKEHMKYRGFNSIYGMIEHIFGLINYARQVDFSYGEIKHIELTEQLQATGLWS

SEQ ID NO: 1892 - protein, 380 aa, Vibrio parahaemolyticus
  source 1..380: note = Related to CP006008.1
MTIVSSQPYFSQGIIKGRNPQKLNALMSKARKMQAQGLPYIHSLHHLALLTNTTVDYLNTIVCRAYDDYTSYRIQKRSGGSRFINAPSDELKLLQRWINNNILYNVPSHWCCFSYHKNASIIDCAQRHCQSKWLIKLDIENFFDTINEVQVYETFHSLGYKPMIAFFLARICTYEPNWISTDKKYWVSYNTNSDELPYSKKNIKYFGRVPQGAPTSPIISNMVMFSLDDEISNLIQNKGGIYTRYSDDIFVSFSQPNFNRNDVSKVIGKIFQKSKRYGYKINKTKIKVLPPGSKKIILGLNVNQRKPELTKEYKNRIESHLYGMSKFGISNHAQHRKFDSIFSMIEHIKGLINYARQISPKYGTSKYTELSDILMKEGLS

SEQ ID NO: 1893 - protein, 384 aa, unidentified
  source 1..384: note = Related to NZ_MVBD01000002.1; note = Marinicella sediminis
MGINLSHAYLNQGASLGYSIEKIESLLIESYELIKSGFPPLFSLNHLAKNSDVDFYNLRKVIQRKCTDFKYLYDIHKIPKRSGGFRFIHSPGSQIKRVQRWINECILYNSKPHWRCFSFHPGGSILDCASIHCESKWLIKIDIERFFDSITEKQVYEVFVELGYKPLISFELARICTVNHKKKIKKHYYKKWVMFNTDKGMPYKKDEIKTIGYLPQGAPTSPQLSNLVFKKHDEHIFEVAKKNDLQYTRYADDMTFSTVKKNFSREKAVTFVKELYSYLSKYGFSPNHTKLKIVPPGAHKVVLGLNVNSNTPRLSRVFKNRVENHLRCIEKYGLESHRIHIQFNSIFALIDHIRGLINYALQIDTNYGHKLSHRYLELLRSNGF

SEQ ID NO: 1894 - protein, 428 aa, unidentified
  source 1..428: note = Related to FYAJ01000004.1; note = Photobacterium andalusiense
MLSVFYEKCLALIRSPLLHQSLVRSLPSINEAVLGSIKGSCMTIGPTHTYIQEGLEKGISEQKLKGIVYESLKRINPSVPYLFSLNQICHITGVSYPYLREIVRRNSTPYNFHRIPKKSGGHRFLTIPRTELKLVQTWIHKEILASQAPHFRCYSYHSQSSIFNCAREHCSSKWLIKMDIESFFDSISEVMVYKVFRKLGYKPLVAFELGRICTYQPTHLRISNTLKWRNFNTNSAEYPYKRKGVSFFGRLPQGAPTSPMLSNLVFQEIDEQLHSYATENGLVYTRYADDLTFSTIDNRFSRERAIKFVSYVKKVLRTENFNTNKTKLKIIPPGSRKIVLGLNVEAQEPLLSKGFKKRVEGHLRGIEKFGILQHVEHRRFDTIFGMLSHINGLIGYAKQIDNAYGFRLEAWFSSILTQNGIVNESFQE

SEQ ID NO: 1895 - protein, 387 aa, Proteus sp.
  source 1..387: note = Related to JACKXR010000006.1; note = Proteus mirabilis
MTIGPTHTYIQEGLEKGIPENKLRSIVRESLSRSNTSVPFVFSLKHVCHFTGASYPYLREIIRRRQTPYSFHKIPKKRGGHRFLTVPDIKLKRVQNWINRDILASQIPHFRCYSYHSKSSIFNCAREHCSSKWLIKIDVENFFDSISEVMVYKVFRSLGYKPLLAFELGRICTYQPTHLSIKNTLRWCNFNKNSSSYPYKRIEINFFGRLPQGAPTSPMLSNLVFQDIDEELHSYASSNGVVYTRYADDLTFSTSNRQFSRKKALIFVNKVKKILRTRNFSTNKSKLKIIPPGSRKVVLGLNIDGPNPLLLKGFKKRLEGHLRGIEKFGIQQHLEHKHFQTVFGMISHINGLIGYASQIDYEYGNRLKAKFSDILTQNGIVNESFQS

SEQ ID NO: 1896 - protein, 387 aa, Vibrio sp.
  source 1..387: note = Related to JAKJKN010000004.1; note = Vibrio diabolicus
MTIGPTHTYIQEGLEKGISEKRLQGIVYESLKRSNTSVPFVFSLNHICHITGASYPSLREIVRRNETPYCFHRIRKKSGGHRFLTVPNAELKVVQTWINKEILASQAPHFRCYSYHSKSSIFKCAEEHCSSKWLIKIDIENFFDSISEVMVYKVFRKLGYKPLLAFELGRICTYQPTHLRIKNTLKWRSFNTNSAEYPYKRKGVSFFGRLPQGAPTSPMLSNLVFQEIDEELHSYASENGLVYTRYADDLTFSTIDRRFSRERAIKFVRHVKKVLRAGNFSTNKSKLKIIPPGCRKVVLGLNIDGQKPLLSKGFKKRLEGHLRGIEKFGIPQHLEHKRFQTVFGMVSHLNGLIGYAKQIDYEYGNRMEARFSNVLTQNGIVNESFQT

SEQ ID NO: 1897 - protein, 382 aa, unidentified
  source 1..382: note = Related to NZ_BDDU01000001.1; note = Pseudoalteromonas mariniglutinosa
MAIGPAHIYLKKGIEKGIEKENLLAIYNSSLPQKRNFQTYIHSLGHLCHFSGVNYHYLRRVIKREIDCYDVYPIAKRSGGSRYISAPEDELKDVQRWINRYVLSNVKPHWRCFSYHAEASIYNAAKEHCGSKWIIKLDIENFFDSVSEIAVYKLFRELGYNPLLSFELARVSTIEPLRINKKMAAKWVNYNTSSDELPYSRRNVKYFGRLPQGAPTSPSISNLVFKGIDEEFQFFSEKNNLIYTRYADDICFSSHEKSFNRESAQQVVSYCSSVLRANGYATKKLKTKIIPPGVRKVVLGFNVDHDEPKLTKAYKKRLESHIRGVEKFGAIAHAKHKKFDSVLGMLEHVLGLVNHAKLVEYGYAVGLKNKLDTAKQRQGFIG

SEQ ID NO: 1898 - protein, 356 aa, unidentified
  source 1..356: note = Related to JADYWQ010000015.1; note = Pseudoalteromonas sp.
MTINSTHSYIATGLSKNIDLTFLENIISESNSQKFNNRTYIHGLNHISHLTGVDYFFLHDIMTRKENPYKIFFIRKNLGNREIKEPNQRLKLVQRTINQQVLSKIPVHWRCFSYHKGASIVKCASEHLGAKSLVKFDISDFFGNINELLVYKSLIKLKYSGSSSYAMARLCTHPNSENDNFGVLPQGAPTSPSLSNLVFFDVDCKLQRLAHKNNLIYSRYADDITFSSFNDLSRQEFLDLKLSVVKILKYHNFELNRDKIKFISSSTPKFVLGINVGGETLKLSKRYKNDIDCHIYGLKKYGLVEHMRHREFTSVFGMIQELFGKINHAKSVEESFGLSRESELRNFIQTKGLFFN

SEQ ID NO: 1899 - protein, 354 aa, unidentified
  source 1..354: note = Related to WOBC01000017.1; note = Aliivibrio fischeri
MAISSTHSYHSVGLRKNINPALLKKIILESNSQKLHNRTYIHDLNHISHLSGVDSLFLYDVMMRNNKPYHSFEMKKKNGTRTIKVPNDKLKVVQRVINQEVLSKIPVHWRCFSYHKGASIVKCASEHLGAQSLIKLDISDFFGSIDEFTVYKALLKLKYSPPSSFAMARLCTHPNKSGEVSVLPQGAPTSPSLSNIIFFDIDCKLQKLASKNNLIYSRYADDITFSSFYKMDRSTFLEIKLSVVKILNYYRFSLNKKKVRFIHSGMPKFVLGINVSGTTLKLSKKYKNDIDCHIYGVIKYGLHHHSLHREFASVFCMIQHVFGKIYHAKSVDYDFGISREQEFRNYLHTQGLFF

SEQ ID NO: 1900 - protein, 381 aa, unidentified
  source 1..381: note = Related to NZ_DF820596.1; note = Pseudoalteromonas sp.
MTIGPTHSYLKTGLSKGFSKEKLLTILESSHEKESKSLSYIHSLKHISHITGVHYIVLRNIVLRNSNPYLVYNLKKKVSGYRDISSPNDDLKLVQKWIAQNILINIEPHWRCYSYHKGASIIKCAQEHVESKWLIKLDINNFFGSIQESQVYDVFKSQNYNSLVSFEMARLCTINTEFDHSSSIKHWVKYRNKRSTSPYSSLKIKRFGHLPQGSPTSPHLSNIIFKSADIELQSIAQRYSLVYTRYSDDLSFSTGDKKFNRKHAKAFITEVSKILKKHHYQLNSKKTKIIPPSKSKVILGLNVDGDTPKLTKSFKQRLNFHIRGIQEFGIIEHSQHSHFNSIFGMINIISGKINFAKSVDINYGNKTELIFKKILQQEGLI

SEQ ID NO: 1901 - protein, 404 aa, unidentified
  source 1..404: note = Related to WMCQ01000027.1; note = Photobacterium phosphoreum
MVFSYSNSSVVVSVIVGVAEQNLSIKGSFVTIGPTHTYIYEGIRKGYSENQLLEIISRSSIQKSNGVSYLHSLNHISYITGTHYLFLRSVVDRTTLPYKQFTIPKKNGGERNVSSPVKQLKIVQRWICTHILADKIPHWRCFSFHKKASILNCAREHSGAKWLIKIDIENFFDSIKENQIYSVFKSMGYNSLVSFELARLCTLSSEISTSELINSNTKQLPYKRQENFTTGRLPQGSPTSPMLSNLVFDSLDVIFQRLAEKKSFVYTRYADDICFSSCQRSLGREECLQIIKIVSRILRSNNYQINRKKLKIIPPATTKSVLGLNVDWDTPKLSKQFKKRCQFHVRGITTFGLAEHAKYRRFESVYGMIKHVYGLINYCKQVEPSYGARLEILLITALEKEGFS

SEQ ID NO: 1902 - protein, 379 aa, unidentified
  source 1..379: note = Gammaproteobacteria bacterium; note = Related to JAHKBA010000014.1
MTIGPTHTYIQEGIRNGYSEAQLSDLLKLSSLQKEKGISYLHSLNHISHITGAHYLFLRAIVDRTSSPYKQFSIPKKNGGTRNVSAPDEQLKIVQRWICSNILSKAPPHWRCFSFHKKASIIKCAREHSGAKWLVKIDIENFFDSIKETQIYSVFKSMGYNSLVSFELARLSTALSESPADETNNEFSRASIESLPYKRQQGLLGGRLPQGAPTSPMLSNLVFEKLDNIFQRLAEKKSFVYTRYADDLCFSSCKTSLKRNDCLQIIKIVSRVLRANSYQINQKKLKIIPPGTTKSVLGLNVDWNSPKLSKQYKKRCQFHVRGIAEFGLAEHAKYRRFESVFGMINHVYGLINYCKDVEPSFGANLETLFTNALEKEGVR

SEQ ID NO: 1903 - protein, 392 aa, unidentified
  source 1..392: note = Related to NZ_KE150238.1; note = Bilophila wadsworthia
MQRVSPNQIHRCAELKSSNEEFIQKLVKDSRKLYSKGLPIIFTLRHLSKLTDVNFKYLHSIVGKKINPYNNFSINKARGGKRNISSPNFYLRRVQDFIKQEILDTNYVSSQISESVFSYRKALSIVDNAKFHIGAKWIIKTDIENFFDSIKEYHIYHFFHSLGYASLLSLELSRLVTWPSFDINFDLGLSQDRSLNEDITFTSKYKFYCSSDVIGSLPQGAPTSPQLSNIIFSPIDEKFKILSEEYGYIYTRYADDLFFSTRNNIDINSARNLLNEVRYILNSSNYKMNNKKTKIILPRAKKVITGIVITDDKILLDRKFKDEIKMNIFFAEKNGLEAQRKFIKFHGNTHTFLKYLLGKLNFANQVEPDFANIWKKRLLNLAKNSGFTMIYY

SEQ ID NO: 1904 - protein, 390 aa, Desulfovibrio sp.
  source 1..390: note = Related to JAJQDW010000013.1
MQQLSPYTFLDLAEARGYSEAYKDAISNTADALSRSGCPIIFTLGHLAALADADYSYLHSIVSRTIDPYCHFSIPKRNGDRRAISAPHDKLKSIQKFILDTILNSSGVVAKISQFSFSYREKISIYSHAEKHVGAKWVVKIDIKDFFPSFTEIDVYRLMCSLGYAPLLSLEISRILTWPKNDLFLQDEEAETNHQKLLESKYKLYNGSVKKIGVLPQGAPTSPMLSNLLFKECDLLINEAAKEYGCLYTRYADDLIFSANRLSKQKAKELISYLRIILKCNKFEMNDSKTRVYFPGSKKIITGLYVNNNRPTLGKKYRDAIKKHIFFIEKFGIQKQADHAGSKDANTFLAHLIGKINFALHIEPNFALSQLQKLKNALKKANYINQKFYP

SEQ ID NO: 1905 - protein, 380 aa, unidentified
  source 1..380: note = Related to NZ_JHVB01000001.1; note = Treponema sp.
MKIWQPALYRKTALKKGLSLSIINNAIKIYTHFSKTPFPCILTINHLSKILNIPYPALKRYTYNQIDNYKHFSIRKRSGGTRRIYSPNYNLLRIQQWINREILQKDTNISDFSYAFRKGLSIRDCASIHCNQSWLIKFDIKNYFESISEIDVYNYFHKLGYNKLLSFQLARICTVNDSRNKTIDTLPSKFIYHKNKQYKFLQNSEIGFLPQGAATSPMLANLITSQLDEDINNFLQSIDLDFNYSRYADDIFISTNSKQIDDTHIRKVLNSVYSIIISHGFEPNKNKTKIFRPGKCKNILGINVNSSDVKLTKHFRNILECHLFYFKKDKIQHTLNRGFNTVFGATAYIHGLLSYAEQIDSNYVKKLKKKYQIDTDFFNI

SEQ ID NO: 1906 - protein, 335 aa, unidentified
  source 1..335: note = Related to QDFT01000100.1; note = Microbacterium testaceum
LTLSHLARETETKWGYLRSIVQRQIDDYTAIRRLKRDGTYRAIWAPMPSLMHVQRWILSNVLSGLKFHDAAYAYRRGRCIRDCAEQHIGARWLLKMDLHNFFGTIEEARVYGALRGMGYPALLAFEMARICTKPLWLDADKRWLEGRGVDAYGSPLRGVLPQGAPTSGALANAVAFSMDAMLRRLADSNGLSYTRYSDDLTFSSSGPFERASIVKLVTEVERAISLAGFVVHRKKTRVVPPGARKIVLGLMLTEREVRLVPEFRSRLDNHIRCVDKYGPAGHAAARRFDSALSMINYVDGCLAFALDIEPEWTADRNQRWLDALYRHGHPVNRDG

SEQ ID NO: 1907 - protein, 312 aa, unidentified
  source 1..312: note = Related to JAFIBQ010000001.1; note = Arthrobacter sp.
MNEYSSIRRRKQDGSFREISAPNPNLMHVQRWMLSNVLTGLQFHDAAFAYRRGLSIKHCAEVHVGANWLLKMDLHNFFGSIEESRVYGVLRRLGYPALLALEMARICTKPITLPGMTKPRLSGRGVEAYSTPNRGVLPQGAPTSGALANAIAFRLDTMLASIADEGGLTYTRYSDDLTFSSYEGLSRTAVSKLILQIEHAISLAGFDVHNGKTRIVTPGARQIVLGLMLTPEAVRLLPEFRHQLDNHIRCVERYGPAAHANTRRFDSALSMINYVDGCLAFAVDIEPDWTARRKIRWRAALGQHGHPVAQDA

SEQ ID NO: 1908 - protein, 375 aa, unidentified
  source 1..375: note = Related to SOHL01000027.1; note = Cryobacterium sp.
MSTPSPHLYQKAAIAAGVSASVARRAGSVSRDIQASGAFPVLTLRHLAHETGASYGYLRRIVKRYADEYQSIRRIKRDGTFRLISAPNPMLMDVQRWILEHILNTLPRHPGSFAYHRGIGIRQCAELHVGSRWLVKMDLHNFFGEIRENRVYRVFRQLNYPALLSFEMARLCTRLDRIDPFTEAVERGVGSYDDGRLGRLPQGAPTSGALANRVATDLDNELQNLADGSGFIYSRYSDDLTFSSPAPFSRPEGMRLISAVSRAASLAGFEPHRRKTRLVPPGARKIVLGLLVSDTGVKLLPEFRRQTQNHIRAAGKFGIQQHSSKRNFHSVLSMINHVDGRLAFAYGIDPEWTIPEMLAWTEVLEMNGYPSVAKA

SEQ ID NO: 1909 - protein, 374 aa, unidentified
  source 1..374: note = Related to NZ_PJJL01000059.1; note = Cryobacterium sp.
MTKLSSHLYLANGTQLGRDAEVLRRASIANAAMVKSGVRPILTLRHFARDSELSYDYLRKVVRRGVDDYETIKRKKDDGSFRFISSPRPDLMHAQRWLLEHVLGNLDLHEAAFAYRKGVSIVHCAEVHVGAKWLVKMDLHNFFGEISESRVYSVFRNLNLSPLLSFEIARICTRVPSEAEMTGKVRLFSAYSQHAEGVLPQGAPTSGAIANAVATALDVKLDAIASRRGFVYTRYSDDLTMSTHEKISRDDASKLIADFARAIHGAGFRVHSNKTRVITPGARKVVLGLLVGDRNVRLLPEFKRQVLNHIRGVRNNGLVAHAAHRRFRSSLSMVNYLDGCLAFAHGVDREWAAAATSSWREALTNDGFLDSAGV

SEQ ID NO: 1910 - protein, 337 aa, unidentified
  source 1..337: note = Related to NZ_QETB01000005.1; note = Proposed Ancrocorticia populi
MSKDPASVASLGELATLTETPYWYLRSIVERRTDPYMSLQRAKRGGGVRPISAPEPPLMHVQRWILHNVLDGLDEHSASYAYRRGRSIAHCAKAHVGARWLVKMDIHNFFGTVTEQRVYKVFRDLGYERLISLEMARLCTREEMKSSTRAPGFRYTAVPSYVSGTIGVLPQGAPTSGALANAVATRIDRALSGLLGDRGITYTRYSDDLTFSTRDGFDRVRASDLISQVTGVVQSCGFQVHKKKTHVVPPGARHVVLGLLVTENNVRLLPEIRRRIEQHVRGVEGFGVRHHADHRGFDDPSAMIGYVGGCLSFALSVDPDWAAPMYRRWMKALSAPW

SEQ ID NO: 1911 - protein, 376 aa, unidentified
  source 1..376: note = Related to RKHG01000001.1; note = Luteococcus japonicus
MSIDAPHLYRKAALAAGRSNAAVEATLSRAHTTALRGAVPIFSLGHLARLSNVDYQFLHDVVCRKVDPYQSITMRKPSGKIRPISAPNQELKAVQQVILYRALRNLDPNPSSFAYTKNLSVLDCAKRHVGARWVIKMDLRDFFSSVDERSAYRTFIKRGYASLMAFEMARICTRDRSPRRGAREYVDRYPRIPGYACGSVGMLPQGAPTSGALANEAARPLDRKLASLAASSGGIYTRYSDDLAFSWAQDVDRSHLHGFVSNVTELCALQGFSVHRRKTRILSPGSRKVILGLLVDESSVRLLPEFKRRVDNHIRCVAKFGASKHAEERGFMSIFEMVNHVDGCLAYSHGIEPGWTEVRNTKWKEALSKSGIQSAT

SEQ ID NO: 1912 - protein, 363 aa, unidentified
  source 1..363: note = Related to JAJSDW010000001.1; note = Microbacterium sp.
MADGGDPSVVNRATAELARLKAQGAYPVLSLAHLAHETGASYSYLREIVNRTRDAYASVALPKRSGGTRPISVPEPILMDVQRWLLSNVLNRVPEHPASFAYRQGVSIVQCAEQHVGAQWMVKMDLHNFFGTVLESSVYRVFRTLGYSKLVAFELARITTRAEGNIRASGSEHVIGDYSMHNQGVLPQGGPTSGQLANAAAGRLDRLLQAYATRSGLVYTRYSDDLAFSGHSTFSRMKASGVIGEVSGLVRRAGFEAHRTKSRLVPPGARKIVLGLLVDDSVRLLPEDRRRIEVHLRGCEIFGLAKHAAHRGFDSVFSFIDHLDGWISFALGVERARATVWRQRLRQILSADGLPADLLRRVA

SEQ ID NO: 1913 - protein, 374 aa, unidentified
  source 1..374: note = Related to NZ_VSSB01000001.1; note = Agromyces mariniharenae
MRPPHLYYRDGIALGVDPDVLERAADERARLRAQGAYPLLSLAHLAHETGASYTYLREVVSRTRDPYQDVAIPKADGGTRPISAPEPILMDVQRWILKHLLERTPTHPASFAYRPGTSIVHCAEQHAGASWMVKMDLHDFFGTVTETSVYRVFRRLGYAKLVSFELARITTRAQNARYAPWLAGNRTIRAYSVDAEGVLPQGGPSSGQLANAAATRLDRLIQSFALEAGLTYTRYSDDLMFSSHAAFRRVDAVNVIRRVSGLTRAAGFSPHRNKSRIVPPGARRVVLGLLVDDSVRLLPEHRRRIEVHIRACEKFGLAEHAAHRGFDSVFSFVDHLDGWISFALGVERDRAMVWRSRFNHVLSGAGLLSAIQRV

SEQ ID NO: 1914 - protein, 374 aa, unidentified
  source 1..374: note = Related to NZ_AP024651.1; note = Arthrobacter sp.
MIPPHLYHQQGVNLGIEPSALKRASAERARLRAQGAYPILSLGHLASETGASYSYLREIVSRSRDPYRSIAIPKATGGTRPISAPEPILMDVQRWILRNILDKLPMHPASYAYRSKTSIVQCASQHMGARWLVKMDLHDFFGTVGEQSVYRVFRKLGYNKLVSFELARITTRTEDLERAPWLAANTVIGSYAVAGMGVLPQGGPTSGSLANAAATRLDQLLQKFSLQRSLNYTRYSDDLTFSSLDAFDRLTAESVVQEVSGLVRKAGFVTHRAKTRIVPPGSRKVVLGLLVDDSVRLMPEHRRRIEVHLRGCEKFGLANHAEHRKFNSVFALVDHLAGWLAFALGVDKVVALSWCRRFNKILEREGLPPMPHLV

SEQ ID NO: 1915 - protein, 376 aa, unidentified
  source 1..376: note = Related to JYIY01000074.1; note = Microbacterium ginsengisoli
MADASPHLYIAQGLAQGHAAEVVSRASIVRSRLLANGVPPILSLRHLAQLTGVSYGYLREIVGRVRDPYLDINRRKRDGGIREISSPEPVLMDVQRWLLHNVFSSVPMHPASFAYQRDRSIVQCAEQHVGARWLVKLDLHDFFGSIQEKRIFDLLLRLGYSKLVSLEIARICTRLRGPRYEGYQNFWAYNAIPSYVVGSQGVLPQGAPTSGALANTVASNLDAKLHDLAASRGLGYTRYSDDLTFSAGPDYDRKQATALIAQVRNIVRDQHFVLHEKKTHVVPPGARTVVLGLLVDSQGVRLLPEYKRRLQVHVRGVGKFGLVEHASHRGFESVLSFVNHVDGLIAFAAGVEREYAQHARRAWNDALARSGYPLEV

SEQ ID NO: 1916 - protein, 380 aa, unidentified
  source 1..380: note = Related to CP096184.1; note = Demequina sp.
MTRDSPHLYFKTGRALGRDEATLNSAIERSRLIQETNRRPVLSLGHLAALTGTRYAYLREIVERTSDPYSEHTRAKSGGGSRPISVPDPLLMQVQRWILEHVLGSTRTHPNSFAYTTGVSIKDCANVHLGASWLIKLDLRNFFGSIDENAVYSAFRRLGYGPLVSLEMARICTRPAGPRMQSLGGKRRYASVPSYAVESRGVLPQGAPTSGALANLVALRLDQQLSELATTRGVAVTRYSDDIAISAGPGFTRRDASELIARVARIAAGNGFELQDTKTRVIPPGARHVVLGLLVDGDSVRLVPEFKRRISTHVRGVSEFGLVAHTNHRGFRSAFSLINHVDGCIAFSQGIEPAYAASVRARWTAALNATNYPAGIGSER

SEQ ID NO: 1917 - protein, 374 aa, unidentified
  source 1..374: note = Related to WOXZ01000002.1; note = Rhodococcus sp.
MNPSTLHQYVEAGRSAGVPLDVLRASVAQASATRSRGAGPILSLGHLAHLTGTPYLYLREIVQRQRDPYDDVILSKRSGGTRSISAPEPVLMDVHRTVLHRALSNLPLHPFSYAYTAGRSVQQCAEQHLGAQWMIKFDLHDFFGQIQERDVFRVFEGRGYSKLVSFELARLCTRLTVFDRPERGSGRYQAIPGYEVQVSGCLPQGAPTSGALSNMVATPLDYDMAGFAARSGFTYTRYSDDMVLSTTLNGFDRTQAKSIIREVSEIIGFHRFQLHQKKTRVVPPGARRIVLGLLVDGDRLRLTPEFRRRVEVHIRGVSKFGIAHHATHRRFDSMLSFVSHIDGCIAYAHSVQPDWADARQHEWLVALRKHGFPT

SEQ ID NO: 1918 - protein, 372 aa, unidentified
  source 1..372: note = Related to CP043474.1; note = Mycobacterium grossiae
MNHPAPHRYFRLGQESGVPEQVLQASAARNAITQAHGAEPILSLGHLAHLSGAPYLYLRQIVQRTRDPYGDISRQKKTGGIRLISAPEPVLMDVQRLILRRALRNLPLHPFCYAYREGRTIQACAQQHLGAKWMIKFDLHNFFGQIEERDVYRVFDSCGYSALVSFELARICTRSRVADFHSRSGRYSAITTYDVDVTGRLPQGAPTSGALSNAVATPLDYTLHEFATGAGFVYTRYSDDMVLSTCQDFNRAQAVTIIREVSHLVATHRFRLHRKKTRVIPPGARHVVLGLLVDGGEVRLTPEFRRRVEVHIRGVREFGLSEHSDHRKFRSLLSFINHVEGSLAFARSIQPAWADEKRAEWRSILGSLGLTL

SEQ ID NO: 1919 - protein, 372 aa, unidentified
  source 1..372: note = Related to JAAVUN010000029.1; note = Kocuria subflava
MNHSSPHHYSRAGREAGVSESVVRAALAQSHLIEESGSFPILSLGHLAHLSGAPYLYLREIVQRVRDPYQDISQRKKSGGTRPISAPEPVLMDVHRFILDRALASVPLHPASFAYTRGRNIKQCAERHLGAKWLFKFDITNFFGQVKEPSVFRVFRRQGYSRLVSLELTRICTRAPLSKNLGSRSRYDVIPSYSVDQRGWLPQGAPTSGALSNAVAAPLDHDLTSLADRHGLVYSRYSDDMFFSAGQGFSRPKAKALVREVDRTVQRHRFLLHRKKTRVIPPGARHIVLGLLVDSGQVRLLPEFRRRVEVHIRGVGRFGLDSHVEHRGFRSMFSFISHVDGCLAFASSVEPDWAESCRVRWEAVLKDQGFPI

SEQ ID NO: 1920 - protein, 374 aa, unidentified
  source 1..374: note = Related to SOCP01000015.1; note = Actinophytocola oryzae
MDHSSPHLYRQAGLAAGVERAVLDHALEQMVRNEARDALPILSLKHLAHLTGAPYLYLRDIVARVADPYTDIVAPKRSGGKRHISAPEPGLMDVQRVILKRALGNIPQHPSSFAYRQGISIVECARRHLGARWLVKLDLHDFFGSISERQVYLVFRARGYSRLMSLELARLCTRAGLSGSQRVGSTRYSAIPSYAVNTVGYLPQGGPTSGALANAVATPMDYALAGLAQEWGLVYTRYSDDLVFSAGHGFNRAIAVRIIGKATSAVRSQGFILHERKTRIIPPGARHIVLGLLVDGDVVRLTPEFRRRINVHLRGVDKFGLRSHAIHRGFRSLFSFVNHIDGCLAFAMSVEPEWARETVSAWRQILRAQAFPVN

SEQ ID NO: 1921 - protein, 375 aa, unidentified
  source 1..375: note = Related to NZ_LMQC01000012.1; note = Modestobacter sp.
MSQPPPHRYLARGRADGVSETVLRAAVKNTTKTDAHDALSILSLGHLSHLTGAPYLYLRGIVQRTSDPYDDIMRKKQTGGSRLISAPEPVLMDVQRLILERALTGTPMHPASFAYRRKRSTLMCAQQHVGARWMLKFDLHDFFGSITEVQVYKVFRSRGYEPLVSFELARLCTRSTTMPSWSTRHQVRYPVIQSYNGRTLGSLPQGGPTSGALANAVATPLDNSLSDLSHDHGFTYTRYSDDLVFSSANKFDRTVARAIINAVRRCVSGQGFRLHAKKTRIIPPGARHIVLGLMLSDDGVRLTPEFRRRIEVHVHGVSTFGLLAHAEFRRFRSVFSFINHVDGCLAFAESVESPWALRLRGEWQRVLRKEGFPAM

SEQ ID NO: 1922 - protein, 369 aa, Corynebacterium sp.
  source 1..369: note = Related to NZ_CP009220.1; note = Corynebacterium deserti
MNNFSPNLYINQRPNEMPGRVAKIAWRGIVSQRDRGLTPILTLGHLASATGIDHAFLRSVVDRSWDPYQEIKISKKRGGTRKLARPHPLLMEAQRWILYNVLPNLELNDASFAYTSGRSIVDCAQRHVGARWILKLDLKDFFDSVSEKSIYRIFLNLGYEKLVSLELARLCTRVTPNSPRFGGNLDKYETIFDYRHPAQGQLPQGAPTSGALANAAMFRIDCALQKLARKHSYTYTRYSDDLVFSTGEKASRSQLITLKKKIQHEIVSTRFQLRKDKTRIITPGARKIVLGLLITESEVRLTPEFKRRILVHLRGVEKFGLYSHVQHRNFDSTLSFINHLEGLIEFASNVEPEFAHESLRNWREMVPLI

SEQ ID NO: 1923 - protein, 380 aa, unidentified
  source 1..380: note = Related to PVTL01000007.1; note = Glaciihabitans tibetensis
MTSAPHLNWARTVDFGAAPGIADAMFHRSEILRRTGAPVILSLKHLALSASVDYGFLLGVIRRSAPAYRAIRIPKNTGGFRDLLSPSESLMAVQRWILHEVLTHQPRHRNNFAYFPGVTARECAARHAGAKWMIKTDLHNYFPSITEKKVFEVFEGLGYSRLVAFELARLCTWTISQTPTAVTTVQQRARSSTGLPYPVMLEGVLPQGAPTSGALANASTFSLDEKLSDLAIKSNLVYTRYSDDMTFSSASPLDRDVARLVIRHIRTIVGKSGLELHDKKTKLIPHGARKIVLGMLITEDGVSVLPEQRRMIDLHIHAVGKFGPVAYATQRRFESVLSFVNHVEGWLAYLSHIDRDWTAQRRLAWNAALDRHHVSVMSLG

SEQ ID NO: 1924 - protein, 380 aa, unidentified
  source 1..380: note = Related to NZ_QHLY01000005.1; note = Cryobacterium arcticum
MRNEAHLSWAITSMSGERPALADAMMRQSETLRRTGAPVLYSLKHLALTTGVEYGYLRHVIQRNAPAYKAIRIPKNTGGYRDLLSPTDSLKHVQRWILHEILDTVPRHINNFAYFRDVTARECAIRHAGATWMIKTDLHQYFPSISEKLVYEVFQGLGYSRLLSFELARLCTWNKLGRLAPTGAVPRSHGSVRSLPYPPAPLGFLPQGAPTSGALANAATRRLDDALSDFAIANHLIYTRYSDDMTFSSPSAFSRTVASEFVVQIRKIVTASGLALHSQKTKVIPPGARKIVLGMLITPGGVGILPEQRRTIDLYVHAVSTYGPVDYAARRGFDSVFSFINHVEGWLAYLSHIDALWTAGRSRSWNDALRKHLIEVSSLG

SEQ ID NO: 1925 - protein, 378 aa, unidentified
  source 1..378: note = Related to NZ_UXAU01000021.1; note = Arthrobacter ulcerisalmonis
MSTDAHLSWAPPVISGGDGPALANAMMFREETLRQHGAPVLYSLKHLALSTGVDYGFLRGVIRRNTQAYKAIRIPKNTGGFRDLLSPAPALMQVQRWILHEILSKVPRQINSFAYFAKITPKECVERHAGASWLIKTDLHNYFPSISEKSVYTVFLNMGYSDLVSFELSRICTWVRPGVQLEATESAITDSEIPYPRTPLGYLPQGSPTSGALANACTRQLDNDLSTLALNAHLRYTRYSDDMTFSSRGPLDRARAAEFIGQVRRLVTASGLTLHAKKTKIIPPGARKIVLGMLVTDTGVGILREQRRMVDLHIHAVAKYGPIDYAERRNFDSVLSYINHVEGWLAYLSHIDGDWTSRRRRDWTSALSVHNVSVTSLG

SEQ ID NO: 1926 - protein, 309 aa, unidentified
  source 1..309: note = Related to JADKSK010000002.1; note = Plantibacter sp.
MRIPKNTGGHRTLHAPADSLRIVQRWILHEILHVIDRHENNYAYFPQVTVKECASRHIGASWMIKTDIHNYFPSVSARSVYGVFLGLGYAPLVAYELSRLCTWPIGGPDLSHLATLEPPTDSDLVYPSLWSEALPQGAPTSGALANACTREMDARLSSFAIKNRLVYTRYSDDMVFSGIGSFSRSLISELMTEVRKIVVSNGFALHLKKTRVVSPGSRKIVLGLLVQEESIALLPEHRRMIDLYIHATSRYGPVGYAGVRKFESVISFINHVEGWLSYSSHIDEEWTRERSVRWRAALDKHQVYVDSLG

SEQ ID NO: 1927 - protein, 514 aa, unidentified
  source 1..514: note = Related to NZ_CP080029.1; note = Streptomyces anulatus
MVSASPHLYLRSVPERRSARTAKRALRQAADVRAHGLPPLVTLGHLAHVTGVPYGTLRRVVERRGFLYDPVHKPGKADRGPRKLLAPDPELMTVQRWLLHHVLDPLPVHPDAYAYVRGRSVADCARRHLGARWLIKIDIRDFFGSVGERRVHRVFRTHGYQPLVAFELARLCTWDDRHAGIDPARRDRYPKVTAYQGGWGGFLPQGAPTSGALANLAVRPMDDRLSHIAARHGLVYTRYSDDMVFSAGTTFVRRSAVAMLREFTHAIQGYGFAVHPRKTRIVAPGARRSVLGLLVDGDTPRLTPDFKSRVLSHVYGVEKFGLPSHQQHRGFASLAGLVHHVDGLIAYARGTEPEWAEPLRARWRAALEAQGWSSAYADDRAEGPPGGNPCRRPSGGGPHILGSVRPVFAAVAAVAGGGGAEGAVAVVAGLEGRDGDAGAGECGEVVDARRRRRKQFGEPVLEEFGGVLEGVGRVVGEGVADGVGAGAAFEPGRDAGDQLTDVVLGERELRCVTA

SEQ ID NO: 1928 - protein, 375 aa, unidentified
  source 1..375: note = Related to BMRN01000021.1; note = Streptomyces atratus
MVSASPHLYLRSVPASRSLGTARRALSQSADAGTRGLPPVVTLGHLAHLTGIPYRTLRGAVERRGYHYTPIHLPGKPDRGPRKLLVPQPELMAAQRWLLHHLLDLLPVHPHAFAYVKGRSVAECARRHLGAQWLIKIDIQDFFGAIGERRVHQVFRAQGYQPLVAYELSRLCTWDDRRDDVDPVRKDRYPKITAYQGGWGGSLPQGAPTSGVLANLAVRPMDDRLSDIAARHGLVYTRYSDDMILSSGDPFSRPAAVAALRELTHAVQGYGFEPHARKTRIVPPGARRAVLGLLVDGDVLRLTPAFKSRLLAHLYGIEKFGLRAHQQHRDFASLAGLVHHVDGLVAYALGAETDWAHPVQERWRGMLRAQGWSLD

SEQ ID NO: 1929 - protein, 384 aa, unidentified
  source 1..384: note = Related to NZ_FMCR01000007.1; note = Micromonospora saelicesensis
MTIGSPHLYRRDGRAEGKPEALLDAALAQAYAVEANGLAAVLTLNHLAVRTGVSYNYLRGIVSRTFDPYADLVIERRNGRKMRPISVPDPPLMRVQRWILHRIASRIPVHTDSYAYQAGSSIRACAMRHAGARWLVKLDIRNFFETINERQVFSLFHEAGYVRLVSLELARLCTRSAAHASHVDVRHFGGDVRDRVIQSYNQPVLGFVPQGAPTSGALANAIFHELDVTFSTLAHRERMVYTRYADDLTFSSIEEFDRSRAAQLIRKVGSELRSEGFSLHQQKTRIVPPGGRKLVLGLLVDRDDVRLSRSMRSRIAENVRGVEKFGLATHVLHRRFSSLDGFVRHVSGLLAFATDVEPGWARHMSKRWQAALRANNWLDFTFNR

SEQ ID NO: 1930 - protein, 382 aa, unidentified
  source 1..382: note = Related to NZ_BOML01000042.1; note = Actinoplanes durhamensis
MTTGSPHLYRREGRARGKPEALLDAALTQTQSVEANGLAAVLTLNHLAVRTGVSYNYLRGIVERKWDPYDDIVLKRRNGRGMRPISAPHSPLMRVQRWILHRIVDRVPVHADSYAYQAGSSIRSCASRHAGARWLVKLDIRNFFETIDERRVYTVFHKAGYVQLVALELARLCTRSAAHASHVDSHRFLSNMRDRVISPYSQAVLGFLPQGAPTSGALANLIFYELDTTFSRIAQLERMVYTRYADDLTFSTIEEFSRSQATSLIREVGTELRRAGFSLHEKKTRIVPPGARKAVLGLLVDNNKVRLNRIVRGRITDNVRGVEKFGLAAHVAHRRFSSLDGFVRHVSGLLAFAADVEPEWAHALGEQWRTALHANNWSEPSF

SEQ ID NO: 1931 - protein, 385 aa, unidentified
  source 1..385: note = Related to JAAGNB010000860.1; note = Amycolatopsis sp.
MITDSPHLYRRNGVINSVPEEVLSNSLMQAGRVEQYGLASILTLKHLAVQARSSYGFLRGIVERKFDPYTDIKIKRTNGRIMRPVSSPSPGLMPIQRWILAHIVSRLGTHPNSFAYTRNKSIKSCASKHLGANWLVRLDVQNFFESIDESSVYRVFAEAGYQPLAAFELARICTRYAPHAHHVDAERFRSKSHYATIRQYNMPYMGFVPQGAPTSGALANLVAKDLDLTLTQVAEKYGAAYTRYSDDMTFSSTSKFTRSKALSLIEESRTALFMNGFRLHDKKTQIQPPGARKTILGLLVDGDSVHLNKRIRSRIENHVRGAEKFGLRSHYSHVNFASLEGFVNHVSGLIAFWLDIDPENSQDIQKRWKETLRRDGWHQVDYWRM

SEQ ID NO: 1932 - protein, 413 aa, unidentified
  source 1..413: note = Related to NZ_LIRL01000059.1; note = Streptomyces niveiscabiei
MITGSPHLYRSRGIKRNVATSVIDNAIAAAERVEKNGLAAVLTLNHLAHSTGADYGYLRQIVTRSIDPYTDIVIARRNGRKMRTVSSPEPSLLQVQQWILRSIAEKIPTHSSSYAYSPGRSVKQCASRHVGAKWLIKLDIRNFFESITEVPVYRVFRRVGYEPLPALELARVCTRYDERDPGMRLDRVLVRAKEYSSIQVYRKPLLGFLPQGAPTSGALANQVAMPLDERLSAIADSRGLIYTRYADDMTFSSGGPFTRSAALTLINQVSGAIRQRGFAVHDQKTRIVTPGARKVVLGLLVDGDRVRLTKKMRQRISLHVRGVETFGFIDHAKHVKFSSVDGLVLHVSGLISYASDIEPAWADEFKQRWRNVVAEKLDVELPSFNRDVGGKSYKSGQIRHLVPLSARLHRREN

SEQ ID NO: 1933 - protein, 409 aa, unidentified
  source 1..409: note = Related to NZ_BLPF01000004.1; note = Phytohabitans houttuyneae
MRTDSPHLYRREGRRRGLSNEVIDRVEMASARLLAHGVAVVLTLGHLAWRSGAPYPYLRKVVERSIDPYHAFAINRRAGKNPRLISSPSPLLMDVQRWILARILDHVTPHPASYAYRRGVSIRMCAEQHLGARWLVKMDLHNFFHTIDERQVFKVFADLGYAPLLALELARLCTRRAWDGFPHPTRFQVRNHRHSVIPTYSADAIGFVPQGAPTSGAIANLAVRPLDEALAALGSAHRLVYTRYADDIVFSSAGAFDRRAAASLMHKARHEIAACGFAAHDKKTRLTPPGARRIVLGLLVDGDKVRLPSEMRSRIATHVHAAEKFGLREHQLSRGFTSVLGLARHVDGLLAFASDVDPAWTDDLRTRWRRTLLRDASALGAFEISDVYRQRDDGTTAAYTVAATPWDAL

SEQ ID NO: 1934 - protein, 399 aa, unidentified
  source 1..399: note = Related to BOPG01000023.1; note = Virgisporangium aurantiacum
MTIGPPHLYRLHGRVRQQDEHMLQAAIEQAARVERRGLAHVLTLNHLAHRTGAPYPYLREIVERKRDPYHVFEIRRRVGGSGRVISSPDPTLMHVQRWILSRILNHVPVHPASFAYRTGFSIRACASQHLGADWLVKLDLHNFFHTIDERQVYQVIRQAGYTRLVALEIARLCTRQSTGTFPGSRRFHAMRIHDRVIANYTTNCLGFLPQGAPTSGALANLVARPLDDRLTAIADDHQLVYTRYADDIVLSGLGPFNRAHAASIIRLAGTAIRESGFEPHDGKTRVVPPGARRIVLGLLIDGERLRVPRDTRSRIEAHVYGAERFGLVHHQINRKFASALGLVRYVDGLLAFAHDVDPTWATPWWERWRRLVLDQAAAIAPFGPDSIVRAPTSADSPDQ

SEQ ID NO: 1935 - protein, 416 aa, unidentified
  source 1..416: note = Related to CP063844.1; note = Streptomyces sp.
MDKLSNAWMVRGARAPTGVWRATRTSPPGRDTPKVGHPIDSPALYRSLGRRNGVTSSVIDEALEQMRRVRRQGLTPVLTLGHLAHQTGAPYLYLRRVVQRRQDPYTEFSRPKREPGKSRTIAAPAPVLMDVQRWLLANVVSPIPPHGASYAYQQGRSAVQCAQLHLGASWLLKFDLHDFFHSVNERAVQSILRSVGYNSLISFEIARVCTRVPGGITWPHFRSAYQAIPGYSAPVLGYLPQGGPASGALANLAARPLDEALSSVADRYRMTYTRYADDMTFSTLRSLDRSTLTRCVSEISATVSAARFRLHRKKTRIVPPGARKIVLGLLADGERLRLPRHTRRGLEDHIRGVAKFGLGAHKEHAGYSSVQGFVHHIDGLLAYGHGVDPVWTKPLAAQWERLMNAAGLTAQERRLW

SEQ ID NO: 1936 - protein, 340 aa, unidentified
  source 1..340: note = Related to NZ_BMVE01000002.1; note = Streptomyces goshikiensis
MLTLAHLAHQTGAPYIYLREIVQRVRDPYAEFSRPKREPGKARVIAAPDGVLMDVQRWLLAGLFGRIQPHRASYAYQQGRSAVQCAQRHLGASWLLKFDLHDFFHSIDERAVQALVRESGYNRLVSFEIARVCTRLPGGNTVPYTRSAYQGIPTYRTGTLGFLPQGAPTSGAIANLIARTLDDSLVAIADRYDMTYTRYADDMTLSTSRNLDRSVLTRCVAEISATVARTRFRLHRKKTRIVPPGARKIVLGLLVDGDRVRLPRHTRRRLEDHIRGTTSFGLTAHVAHAGYSSLQGFVNHIDGLLSYARGVDAAWADQLKAKWEDAMAAEGLNGLERHAW

SEQ ID NO: 1937 - protein, 351 aa, unidentified
  source 1..351: note = Related to FWZW01000013.1; note = Streptomyces sp.
MRGLDARGLTPVLTLAHLAHLTGAPYLYLREIVQRRRDPYTEFSRPKREIGKTRTIAAPDPVLMDVQRWLLRHVFGRLTPHQASYAYQQGRSAVQCAQRHLGATWLLKFDLHNFFPSINERAVQAVVHAAGYNKLISFEIARLCTRVPWVVEWPYSGSSYQTIDTYRTPRVGRLPQGAPTSGALANLVARPLDETLSALAERYDLTYTRYADDMTFSAFRRFERPALTRCVAEITQAVAATSFTLHRKKTRVVPPGARKIVLGLLVDGDEVRLPRQTRKRLEDHIRGVAKFGFTAHVEHIRFSSLQGFTHHVDGLLAYAQGVDAAWARPLTRQWEDLLTAEGFSILERSRW

SEQ ID NO: 1938 - protein, 389 aa, unidentified
  source 1..389: note = Related to SISL01000011.1; note = Verrucosispora sp.
MSTDSPAAYQRIGRQRGVPDVVVEAALEQIRRVRAVNLTPVLSLKHLAHLTGASYIYLRETVQRKRDPYVEFSRPKRAEGQLRTISAPDPPLMAVQRWILQRIFSRLHPHSASYAYQAGRSARQCAEQHLGARWLLKFDLHSFFHSINERAVFGILAGQGYNRLVSFEIARLCTRYAGHVRGLNFSKFRATASWPHHFTIPSYSVPWLGFLPQGAPTSGAIANMTALQLDELLSDVADRYGLVYTRYADDLTFSTVGRLARSAARRCVGEVQAATAQAGFQLHQRKTRVVPPGSRKIVLGLLVDSDCVRLPADARSRLETHVRGVARFGLVAHAQHWKYNSLTGLIHRVDGLLAHARDVDPLWVAPLWRSWNDALEAQGFSDVEFRQWS

SEQ ID NO: 1939 - protein, 364 aa, unidentified
  source 1..364: note = Related to NZ_BEGX01000067.1; note = Pseudonocardia sp.
MEGAGRAAILTLGHLAHLTGVSSHFLRQVVERRRDPYHAFSISKRSPERGKRTISAPSAEMMSVQKWLLKRVLNPAIGHPNSFAYEPGRSIRQCAARHCGARWIVSLDLHDFFHSVDEKRVFQVFETLGYNRLVSFELSRICTRLIGRNIKPSNVRPETYSISAYVSENLGFLPQGAPTSGKLANLVAADLDERLLSLATEYRLVYTRYADDLFFSSSGDFDRAVAVRLIREIGDLVAVSGFEIHRKKTRVLTPGSRKQILGLLVDDLAGPRLTRRTRAQIEAHLRGVETFGVVAHREHRRFDSTWGFVAHVWGLLAFAASIEPDWARPARFRWENALSRDGWGSDVFRPDLYFVNSHLAERES

SEQ ID NO: 1940 - protein, 375 aa, unidentified
  source 1..375: note = Related to SSXE01000007.1; note = Nonomuraea sp.
MITDSPHLYVRNGLAAGLPIELLDLFVRRAQATEQQGIRAVLTLKHLAHQTGADHRYLRDIVGREIDPYTEFELRGKRRISSPRAPLLAVQKWMLTHILNHVPCHPSSFAYERQKSVAQCARRHLGANWLVKLDMHDFFASIDERQIFHVFSELGFGRLVSFELARLCTRPGIGARHSVAAEKAASSADYTVIDKYQTAVGLGFLPQGSPTSGALANLVMRDADMQIAEAVAGTGIVYTRYADDIAFSTSRKFSRREASELIRMTDHILGRSGFLRHNKKTQVIPPGARKIVLGLLVDGDRLRIPVDARNRIINDIWGAERFGLPAHARHRGFSSTISFGERLAGMLAYCHDVDPKWTAPLWRRWAKILSDYEIR

SEQ ID NO: 1941 - protein, 382 aa, unidentified
  source 1..382: note = Related to SAUN01000001.1; note = Nonomuraea polychroma
MITDSPHLYRVRGLLADHSTALIENAIAQAHQVEARGLEAVLSLNHLARRTGATRNYLRDIVERRLDPYTEFQKTSSTRARTISAPRQPLMEVQRWILRNILGRVPAGPFSFAYEHNKSITMCARRHLGCKWLIKVDLHDFFSSIDEVAVYAIFHGLGYQALPSLELARICTRQGVGASHKRHFPSASRVDRYQRIPAYLSRALGFLPQGSPTSGALANLVMKSLDEHIAALSHPFGFVYTRYADDLVFSSADRFDRKIAIGLIHRVTDLLRTHEFIVHRAKTRVVPPGAKKIVLGLQVDGDRVRLPPDARRRITENIRGVERFGLTDHVAHRHYSSVVGFVERMRGLLAFSYDVDKEWTAPVWIRWGEALERAGYWERTAW

SEQ ID NO: 1942 - protein, 379 aa, unidentified
  source 1..379: note = Related to NZ_CP084582.1; note = Micromonospora aurantiaca
MTLDSPHLYRAAAARLGISAETANNAIRETELLRDAGATPVLTLGHLAHLTGAKHSYLRAIVERRIDPYEEFTRMRRNGGKMRMISSPEPVLMEVQRWILTNVLTRAKPHHASYAYTRDRSVAACARRHVGARFMIKLDLHDFFHSINEYRVYSLYRNLGYNRLVSLELSRITTRYSEFALQTPIPAPRTGDYPMIPRYRVNYLGFLPQGGASSGAVANLVVRRMDHEIQSMASDHSLTYTRYADDLVLSGAGEFSRDTCRDVVRLIRRIVSHNGFHLHEKKTRLTSPGGRKVVLGVTVTDSGIKLSREIKARLANHLYGAGKFGIGRHASSRGFTSTVGFVRHMRGLLAYAHDIDPDFAAPLAARWREVEVRDGTRIA

SEQ ID NO: 1943 - protein, 377 aa, unidentified
  source 1..377: note = Related to NZ_JAFEUC010000033.1; note = Micromonospora humida
MTYDSPHLYRKLGRERGVDDQVLDRAMRQISRLRAAGVTPVLTLNHLAHLTGAKYGYLRRIVARELDPYTEFTRQRRTGGKMRLISAPQPVLRDVQRWVLDRILHRIPVHPAAYAYVPGRSVAACARCHIGARYLLKFDLHDFFQSISEYRVFSVYRSLGYQPLISLELARLCTRDSAAVFGRRTLTAPQVERYQAIPAYRSGSLGFVPQGSPTSGAIANLVTRRLDTGLQRLAVSAGLTYTRYADDIVLGGSDAFDREHCRKLVREVRKIVRHNGFCLQEKKLRIIPPGARRIVLGVVLTDDGITISREVKDRLAKHLFGADRFGIHRHAEHYGFTSVFGFANHVTGLLAFAADIDPGYARPLIRQWQAIESRSGV

SEQ ID NO: 1944 - protein, 318 aa, unidentified
  source 1..318: note = Related to JACASO010000007.1; note = Pseudonocardia pini
MISDSPHQYRLQGASREVPAQVIENSIAQAQVTESRNLRAVLSLKHLAHQTGCSYIYLREIVQRVRDPYSTFSRRRRSGVRMRSISSPNPPLMAVQRWILRNILNHVDPHPSSFAYQRNRSIVQCASRHIGADWLLKLDLFDYFPSISEEVVYWEFRRSGYSRLVAFELARICTRPTNESPPIRSRSKYRAIPSYASAKEAGILPQGAPTSGAIANLVSRQLDISLTRLANASGLTYTRYSDDLVFSGTGPLNRDTATQKIREIDNIISSCGFETHRKKTRIVTPGGSKDCSGPSSNSVRSPTASRVQAKDQDTHSRR

SEQ ID NO: 1945 - protein, 373 aa, unidentified
  source 1..373: note = Related to NC_014666.1; note = Frankia inefficax
MVIDSPHAYRLRGLQQGHDPELLRRAVAEADRVEGRGLTSVLTLKHLAHQTGATYIYLREIVQRKRDPYTEILRSRANGRPMRLISAPDPVLMSVQRWILENIVGRLTVHPASAAYGKGNSVAACARRHVGASWLVKMDVHNFFHSIDERAIYKIFQNVGYSSLVAFELSRICTRPVPGSPHIHPVRRDRVIESYSTANLGILPQGAPTSGVLANISFFACDEILSSLAESCGLVYTRYADDIVFSAGESFTRRDADALIEIARDALLAHGLTPHRGKTQVVPPGGRHIVLGLLVDGDRVRLTREFRQRVQTHIRGVENFGLATHRRHRKFASTAGLINHVNGLLAFAFDVDPAWAGEIRAHWASILAAQMNR

SEQ ID NO: 1946 - protein, 382 aa, unidentified
  source 1..382: note = Related to SAQH01000043.1; note = Mesorhizobium sp.
MTVASPHLYRRHAPENTDRQLVERALAQSSAPLSKGLPSILTLRHLGHLTGADYKYLRSVVQREYDGYRTFSIRKRSGGTRLIASPEPVLGEVQRWIASKVLNKVSVHKNSFAYKPGSNPKKCASVHLGASWLIKIDIHDFFESITERRVYYSFLDCGYQPLVAFELSRLCTRVFTGKPNVGPQWSTRRRHGSRVYATSELGHLPQGAPTSPMLSNMVSFELDHKLSTLANDYGFVYTRYSDDLAFSSGEKFTHKAAGEFVQNIDRILKSFGHVIHQRKTTIAPPGARKVVLGLLVDGSSPRLSKELRARVSDHVRGIEKFGLAMHASERHFASIWGMVNHVNGLISHVRGVDPELGSNLRSRLTTALAIQGWSAETIAGHP

SEQ ID NO: 1947 - protein, 388 aa, unidentified
  source 1..388: note = Related to JAFKIC010000112.1; note = Mesorhizobium sp.
MTSIPPHLYRKLAPKELDPVIVDRALDQLLAVEANRLPGILSLRHLAALTRSDYLYLRSIVARETDAYRTFTIRKRSGGGRLIAAPQPELMALQRWISKEILANITPHVASHAYARKSSPLKCANLHVGASWLIKVDIHDFFESITERRVFFAFRQMGYQPIVAFELARICTRVRIDLPLRDRRFAAARRTVGIAKYGHSQMGYLPQGAPTSPMLANLVSFEMDRKLTEFGAEKGLTYTRYSDDLIFSSGRSLSHKTAETYVAIISRIINSFGHDVHERKTTIAPPGARKVVLGLLVDDTGVRLLRETRDRAADHVRGIEKFGLAAHATERHFASLWGMVRHIHGLLRHMNSVQPEVAGPLLARLEAVLAREKWQGSLDDNFWLNDLL

SEQ ID NO: 1948 - protein, 382 aa, unidentified
  source 1..382: note = Related to NZ_LNSC01000016.1; note = Sphingopyxis sp.
MISASPHQYRASALARGITQQTVQHALDQAEQAEKRGAPAILTLRHLAHVTGADYKYLRLIVSRSEDGYKPFTIRKKSGGGRLIAAPEPQLLSVQRWISRNVLANRPVHSSSMAYAPGASPLKCAARHVGARWLLKFDIHDFFESISEDRVYWAFRSCGYQPLIAFELARICTRVHSPYVQIDSRWRSGRTHGPAEITAYSDDRLGHLAQGAPTSPMLSNLVSEPMDDLLAKIARERGLVYTRYSDDVVFSTGTTITRREVRNLVHDVKRVFNSFGHLLHRKKVVIAPPGARKLVLGLLVDGDEVRLSREYRARVESHVRGIEKFGLAEHAASRHFTSVWGMVRHVGGLIAHSRAVDQTYGDSMQLRLSAALEASGWSDASP

SEQ ID NO: 1949 - protein, 410 aa, unidentified
  source 1..410: note = Related to NZ_JAGIOU010000001.1; note = Sphingomonas sp.
MISASPNLYRSEGAERSIDPLIVEHALQQALPVERKRLPAILTLGHLAHLTGINYAYLRAIVERHADPYTPFRIGKRKGGSRLISAPEPLLLALQRWLARNVLNNIEVHHASCAYAQDCSPARCATRHLGAAWLIKVDIHDFFESITERAAWRVFRSAGYQPLISLELARLCTRQPHGREIVNPKWHVEDAGSYSIRPYRTRMMGHLPQGAPTSPMLANLASFRLDEALEALGGRYGMVYTRYSDDIAFSTGGTFDRKRAGQLIIEVERIFRSFGHALHRKKISVAPPGARKVVLGLLVHGSRLRLTGPYRRRLADHVRGVEQFGLSAHKAHRHFASLWGMVRHIQGLLGYAESVEGKAAHADMRARLDAALARDGWPDGMPPETPMPAQQPPPDVGSAAVTSSALPPAG

SEQ ID NO: 1950 - protein, 383 aa, unidentified
  source 1..383: note = Related to NZ_CP016591.1; note = Tsuneonella dongtanensis
MISASPHQYRADGRARGRPEPVLDAALAQAAGPELQGAPAILTLMHLAKRMDVSYKFLRSVIASKEGTHYRDFHISKRDGGGRRIAVPSPELMAVQRWIVREILRDRPVHRASFAYARGCSIYACARRHASAGWLLKLDIHDFFESIPEKAVYRVFREIGYARLVSFELARLCTRPWVAPPRGKRAERTVANPSRRGIEIYRRELTGYLPQGAPTSPMLSNLVFRVLDEHLSQLATRHGLIYTRYSDDLTFSGPASGFSRDRATEIISEVRDLLATRRFRLHERKITIVPPGGRKVVLDLLVDRAAPRLSRELRGRLEDHVRGIEKFGIAPHAAARGFASATGMINHIAGLLRFAGHIQPAFADPLRARFAAALARWRWSPVD

SEQ ID NO: 1951 - protein, 342 aa, unidentified
  source 1..342: note = Related to NZ_WRPK01000013.1; note = Sphingomonas formosensis
MISASPHQYRADGRALGRPEPVLDAALAQAGRAEASGAPAILTLMHLAKRMDVSHTFLRSVVGSKEGTHYREFHISKRDGGGRRIAVPSPELMAVQRWIVREILRDRPVHPASFAYARGSSIYACARQHAGAGWLLKLDIHDFFESISEKSIYRVFREIGYGRLVAFELARLCTRPWVAPPRGTRAARSVANASRRGIEFYRRDLTGYLPQGAPTSPMLSNLVFRVLDERLSQLAARNGLIYTRYSDDLTFSGPASGFSRANAAAFIGQVRELLATRRFRLHERKINIVPPGGRKVVLGLLVDRSVPRLSRELRNRLEDHVRSAIPPAMVVRIGPPISTFSS

SEQ ID NO: 1952 - protein, 389 aa, unidentified
  source 1..389: note = Related to NZ_LMQP01000002.1; note = Sphingomonas sp.
MIGASPHRYVVDGRASGRSDELLVRALAQARSVEVAGAPAIVTLRHLAARMGVDYRYLRSVIANRSGDRYRDFSISKRGGGGRRIAVPEPTLMAVQRWIVREILRGRPVHPDSHAYAAGSSIVACARRHCMAGWLLKLDIHDFFESVPERSVYDVFRTIGYQPLVSFELARLCTRPWVDPPQDRRAARTVSNHANRGIDLYRRELTGFLPQGAPTSPMLSNLACVGLDGRLSSLARSAGLTYTRYSDDLTFSGPPGTFDRSHAVAMVDGVRDVLRDHGFRMHERKISIVPPGGRKVVLGLLVDRDRPRLPGGLRQRLSDHVRGIEGFGIAAHAAERNFEAVTGMVNHIAGLLRFARDVEPAFADRLRVRFEAALARHGWGAAPESGSEP

SEQ ID NO: 1953 - protein, 705 aa, unidentified
  source 1..705: note = Related to JACHJE010000006.1; note = Streptomyces albaduncus
MTTTDDFADLTPEQFLEAVVSGSIHPYTEHRIPKRRGGLRTLHAPVPRLSEIQQAVLARLETLPAEVQPHPAAFAYRRGRSVVDCATVHLRAHTVIRLDIADFFGSIRERHVHAALKDAWTRPTEPEYRVGLVKDDNGRRKIGLRRDGRTLDTYITARLVTVSPPEPSQTWTNRGTGRRSVYLAATGQEFSVRRPHLVYRHTREGFLPQGAPTSGYLSNIVMRDVDEVVAHQAESLGLRYTRYSDDMYFSSRGLVRHDDVDRLVAGVKEALEPLGMKLNAEKTYVARPGARRSVLGILVDGPTPRLTREYKRRITKHVRGAASFGIEQHRRHQEFEDLAELDAHVTGLLSFAHMIEPAWAEKQLTAWKRLRGIPLEHEEPVSAQHGLDLPWEEEMEVSQADLAKDSIDDLIRGAQRYRSSSDYLQMLEFVGRFKRYAPFNAMVVHIQKPGARYVLPSSEWESKYRRVLKPGAKPLLIFQPRGPYLLVYDVGDTEALPGALPLPRGITAPVSVSSRAGEREVLEVWHHTETNLAPLGIRLTLVDHGASSCGRTYRSRSGGSVKRPGGRRGDPPETYPTLFEIEVNGNLPLLDRYATLAHELGHLFCGHLGAGPGETWPDRQLRPLSEEDAVKAHARNEVEAESIAYMVLKRLDPDVRMGDYITGHLGPDRQVPETVALNLTFKAAGLIIEMGKKRLSSAKLQKPKK

SEQ ID NO: 1954 - protein, 705 aa, unidentified
  source 1..705: note = Related to NZ_JNXG01000009.1; note = Streptomyces atroolivaceus
MTAADDFWDLRPEAFIHAVVSGSIYPYTEHRIPKPRGGLRTLHAPIRRLSWIQQEILARLGTLPARFQPHPAAFAYRKGRSVVDCAAVHLRAHTVIRLDVADFFGSIRERHVHAALKGAWPRTAGPEYRIELVEGDDGSPEIGLRRVGRTLGAYTTARLVTVSPPESNHTWPNRGTGRRDVRLEATGQRFSVRRPTLVHQHTHEGFLPQGAPTSGYLSNMVMRDVDAVLAHKAESWGLRYTRYSDDLYFSSRGPVRPERVDRLVTEVKRALEPLGMRLNAKKTYVARPGARRSVLGILVDGSTPRLTRAYKRRITLHVRGAASFGVMQHCYHQKFEDLAELDAHVTGLLSFAHMVEPRWAGEQLAAWKRLREIPLEHEEPVMTQHGLDLLFDEEVDVSQADLAKASIDDLVRGAQRYRSSADYVQLLDFVGRFKRYAPFNAMVVHIQRPGARYVLSSAEWKSKFLRVLRPGAQPLLIFQPRGPYMLVYDVGDTEALPGARPLPREVTSPVAVTSRAGAKKVAEVWHHTEANLAPLGVRLTLVDHAASSYGRTYPSRSDGFVSRPGGRPGDRPEKYPILFEIEVNRNLSLLDRYTTLAHELGHLFCGHLGAGPGDAWPDRRWRPRSDEERIAAHARDEVEAESIAYMVLKRLDPDVQMGDYITGHLGPDQQVPDSVALNLTFRAAGLIIEMGQKRVPAAKLQKTKK

SEQ ID NO: 1955 - protein, 705 aa, unidentified
  source 1..705: note = Related to NZ_KL585423.1; note = Streptomyces sp.
MTTADDFVDLDPAQFLKAVVSGSIFPYTEHRIPKHSGGIRTLHAPVPRLSELQQGILARLETLPARFQPHPAAFAYRGGRSVVDCAAIHLRAHTVIRLDIADFFGSIRERHIHAALKDAWARPTEREYRIDLVKDGDGCREVGLRRIGRTLSTYTTARLVTVSPPGSSRTWTNRGTGRRSVYLEATGQSFTVSRPELLYKDTREGFLPQGAPTSGYLSNIVMRDVDAAVTHLAESLGLRYTRYSDDMYFSSRRLVRHEKADRLVDGVKKALIPLGMRLNTKKTYVARPGARRSVLGILVDGPTPRLTREYKRRITKHVRGAASFGIEQHSRHQGFKGLAELDAHVTGLLSFAHMVEPGWAEEQLADWKRLREIPFEHEEPVIAQHGLDWYGDEEVEVSQSDLAKASIDDLVRGAQRYRSSADYLQMLEFVGRFKRYAPFNAMVVHIQKPGARHVLSSSEWMSKYRRVLKPGAQPLLIFQPRGPYMLVYDVGDTEALPGAQPLPRTVTAPASVSSRVGEKKLVEIWHHTGTNLAPLGIRLTLVNDGASSYGRTYRTRSDGFVQRPGSRPGDRPERYPRLFEIEVNRNLPLLDRYATLAHELGHLFCGHLGAGPGDFWPDRRSRPSSDEERVTAHARNEVEAESIAYMVLKRLDPDVQMGDYIIGHLGVGQQVPESVALNLTFKAAGLIIEMGGRRLSATKLQKPKK

SEQ ID NO: 1956 - protein, 698 aa, unidentified
  source 1..698: note = Related to NZ_JACYXT010000015.1; note = Streptomyces caniscabiei
MADDFADLSQAQFRKAVVSGSIYPYTEHQIPKRRGGLRILHTPVRRLSEMQRGILARLEHLPAGFQPHPAACAYRSGRSVVDCAAVHLRAHTVIRLDIADFFGSIRERHIHAALKDAWSHLAGREYRIDLVEDGNGRQEIGLRRTGRTLRTFTLARLVTVSPPGPNRTWTNRGTGRRSVHLEATGQSFSVSRPDLVYKHTREGFLPQGAPTSGYVSNLVMRDFDAVITHLAESLGLRYTRYSDDMYFSSRRLVRHEHVDRLLAGVKEALESLGMRLNTKKTYVARPGARRSVLGILVDGPAPRLTREYKRRITKHLRGAAAFGIEQHRRHQEFKDLVELDAHVTGLLSFAHMVEPGWAGEQLEDWKRLREIPLGHDEPVTVQHGLDLPWAAEVEASQAELAKTSIDDLVRGAQRYRSSSDYLEMLEFVGRFKRYAPFNAMVVHIQKPGARYVLPSSEWKSKYQRVLRPGAQPLLIFQPRGPYLLVYDVGDTEALPGALPLPKAITAPVSVASRASEKELAEVWHYTQVNLAPLGIRLTLVGHGASSCGRTYRSTSDGFVERPGSRPGDHPEKYPTLFEIEVNWNLPLLDRYVTLAHELGHLLCGHLGSGPEDAWPDRFLPKTVEVHARNEVEAESIAYMVLKRLDPDVQMGDYITGHLGPNQQVPETVALDLAFKAAGLIIEMGKRRIPATKLQKPKK

SEQ ID NO: 1957 - protein, 700 aa, unidentified
  source 1..700: note = Related to NZ_FONG01000017.1; note = Streptomyces alni
MADDFADLAPAQFLEAIVSGSIYPYTEHRIPKRRGGIRTLHAPIPRLSRIQQEILTCLEALPARLQPHPAAFAYRSGRSVADCAAVHLRAHTVIRLDIADFFGNIRERHVHAALKDAWTRPTEREYRIDLVEDDHGGQEIGLRRTGRTLGTYAMARLVTVSPPEPSETWTNRGTGRRIVRLEATGQDFSVHRPSLVYQHTREGFLPQGAPTSGYLSNMVMREVDAAVTNLAESMQLRYTRYSDDMYFSSRRLVRHDDVDRLVAGVKRALVSLGMKLNAKKTYVARPGARRSVLGILVDGPTPRLTREYKRRITNHVRGAAAFGIEQHRDHQKFKDLAALDAHVTGLLSFAHVVEPGWADKQLTDWKRLRRIPEQEEPVIVQHGLELPWDEEVEVSQENLAKASIDDLVRGAQRYRSSSEYLHMLEFVGRFKRYAPFNAMVVHIQRPGARYVLPSSEWRSKYRRVLKPGAQPLLIFQPRGPYMLVYDVGDTEALPGAWPLPKAITAPVSVSSRADERDVAELWHNTETNLAPLGIRLTLVDNAASSCGRTYPSRSRGFVERPGSRPGDRSETYPTLFEIEVNRNLPRLDRYATLAHELGHLFCGHLGAGPGETWPDRRLRSSSEATNVHARNEVEAESIAYMVLKRVDPEVRMGDYITGHLGPDQRVPELVALNLTFKAAGLIIEMGKKRIPASKLQKAKK

SEQ ID NO: 1958 - protein, 660 aa, unidentified
  source 1..660: note = Related to NZ_VEBQ01000002.1; note = Cellulosimicrobium sp.
MRLVGFRSHEYGECITVVTDAAHKEFLSAVVSGAVYPYVEHVVAKRTSGVRTLHAPVEQLAREQRMILTQLRERGGSVHPAAYAYRTGYSVVDCAQVHMNAHTVVRLDIADFFGSIRERHVYEVFEELRDGPTRSYELTRLTTVSPPTSTAWRNRGTGPSVKSGVIERSPRYMHNREGFLPQGAPTSGILSNLVMRAVDAHLHSYAERQGWRYTRYSDDLYFSSRKLADHRQIDRLIREVKRRLGLLGLHLNDKKTWVARPGARRSVLGILVDGPVLRLPQSYKRRITMHVRGVSSFGIAHHADHAGFITVDDLDSHVTGLLSFAHQVEPEWAAEQLHKWRRLRRLALTPSVSTDAADLVLAGATEAKASIDALVAGAHRYRSARSYADLLSFVGAFKRYSPFNAMLISLQRPGARYVLTEARWRSDFRRVLEPGAQPLVILQPGGPFMVVYDVGDTEALPGALALPPEVTDPVSVRATITAADLQQRWDWTVNNLAPLGIRLTSVDHANSSCGSTYRARTQGTVNRLAATGRTQPEEFPLLFEIEVNKNLKPIDRYATVVHELAHLFCGHLGTSPITKWPDRRGGAQSRNEVEAESITHMVLSRLDPDVAMGDYILGYVRRADDMPDVALNLMFKAAGEIIELGSGRIPTTKLRAERRA

SEQ ID NO: 1959 - protein, 657 aa, unidentified
  source 1..657: note = Related to NZ_VEIN01000001.1; note = Cellulosimicrobium sp.
MHYMTMASAVGKSAPDRGATERFLAQVVRGEVFPYTEFPVAKRTSGIRVLHAPVPELAAKQLEILGRLQRTAVTDPAAFAYRAGYSVVDCARVHLRAHTVVRLDVANFFGSILERHVYSALQEVDDAPWSNYTTTRLTTVSPPGSPAWRNRGTGELVKDGSVERSDRYMHNREGFLPQGAPTSGMLSNLVMRKVDEALRAYAEHEGLRYTRYSDDLYFSSRTFVAHRQVDALVRKVRQSLAELGLRLNDRKTWVARPGHRRSVLGILVDGPTPRLSRDYKRKVTVHLRGAAAFGVADHASFRGFSAAEQLDAHLTGLLSFAHQVEPAWAAERLATWKRLRSLGTSHGTEALADPAHQLSGAAEAKASIDALVAGAHRYRGSQAYVELLKFVGTFKRYSPYNAMLINLQKPGARYALTEPRWRTEYGRVLEPGAQPLVILQPGGPFMVVYDVGDTEALRGAHPLPPEITNPVAVQSRISDPELKQRWDWTLNNLAPLGVRLTLVSHANSSCGSTYPARRSGTVTRLSATGKTRPEEFSLLFEIEVNTHLALVDKYATLVHELAHLFCGHAGPSPVASWPDRRGGSKARNEVEAESVAHMVLGRLDPDVTMGDYILGHLDKDGDMPEVALNVMFKVAGDIIELGSGRIATNKLRKELGR

SEQ ID NO: 1960 - protein, 445 aa, unidentified
  source 1..445: note = Related to CP075371.1; note = Nocardioides aquaticus
MAVVHISNQGGASRRPTPTAFVQQVARRVDVPVTYARDVLTRSIFPYRRVEVRKRTGGQRILHSPELPLMRMQRLLLDDLLPSAPTHASSYGYVPGASVLDCASVHLRSHTVVRIDIADFFSSITERHIFRALSTTGWPSHIGGPVAGARTSHVGPRMSRLLAYELAVLTTVSPPGSATWPNRGTGSRVIDEDSAIPRAHPYSGQTEGFLPQGSPTSGALSNLVMRPIDDLVHDVARRMHLRFSRYSDDLFFSSTRPITPDTVARLVHEVRAALQIIGLHVNDSKTRVARPGSRRTVLGVLVDQSAPRVGRDVHRRIDMHLHGSRRFGIDEHAEHRGFIDPEDFRSHMQGLISWIQIVEPGRGHRYAEDWARAIRHSRLYASPDLALGESIAALSPVNPPTESAAKQSIDDLIVAGVRYRSTVEYLELLRFIERFHHYAPSTRCS

SEQ ID NO: 1961 - protein, 648 aa, unidentified
  source 1..648: note = Related to NZ_FMZF01000003.1; note = Geodermatophilus telluris
MAADSGLDGDRLTALLNRSTWPYSVLQHRKPGGGSRTLLTPAPDLMRLQRRVLDEVLAHHAVHPAAYAYRPRRSVVECAQVHCRAHTVVRLDVAGFFDNIRERHVYASLRRRPAIGGPLSAVQAYELTLLCTTTPPDSESWINRGTGARRLGQRSTDPLVARAYPYQDQREGFLPQGAPTSGALSNLVMYEVDVELSGLADRLGLRYTRYADDLIWSSRALVPRRIIAQLVTDVRTVLATKVGLHLNDAKTRVSRPGSRRLVLGLLVDGSAPRVPRETYRRLECHVRGVRIAGLRAHAAHMGFETPEAARNAVDGLLSWVRFVEPAKGRLLTDAWSRALEVGDVELLGDPTSTELPSDLDTGEARESIAALLRHGSEYRSSAEFADLMRFIGGFHRYAPFNAMVVRLQRPGSTFVLTEARWRREYRRVPKPGAQRIMIFQPRGPYMVTYDVGDTEPLREAPPLPHGVTDPVSIRTAIPVQALETAWSTLLDNSVRWGVRVTLVDHAASACGRTYRTQMTDQLVRRPGPRGKGEDVRPLRFEVEVNRNLPVPDRLATLVHELAHLSCGHLGKHPELPWLDRRGGTRRRDEVEAEATTYLVLSRLDPTLTTDDYLLGHLGEGTELPDDLRLDLMVSCASRLLEMLLSRQP

SEQ ID NO: 1962 - protein, 638 aa, unidentified
  source 1..638: note = Related to NZ_PYXZ01000001.1; note = Nocardioides currus
MRDVLARRRSPYRQFAIPKRAGGMRVIHAPEPELQILLRRVLRTALDQLPQHPMAFAYRNRTSIVECAHVHLRADTVIRLDIADFFTSVRERYVFEALMALTDDEWLPLGRPSRLAAHEMARLTTVTPDDSGAWLNRGTGTLTVDDRARPRSYPYKGQREGFLPQGAPTSGAISNLVMRPVDEAIFQVAEKLGLRYTRYSDDLYFSSRRRVLHHTVDALVSGVRPPLAELGLHLNAHKTRVARGGARRTVLGMLVDGHTLRLPREQHRNIELHLRGADRHGLEHHAESRGFDSVESLERHVSGLIGWAQHVEPMKGATYRSHWHRTRSRSSAAANPQVEHADPTVSVDDSARASIDRLLAQGHAFRQSKDYAEFIGFIGRFRGYSPFNAAMVRLQKPGSRFVATEQKWRTKYRRVIRPGGQPLVMLRPGGPYMVVYDVSDTEALPGSKPLPRHVTDPLAADSSLNSATVERLWKVTIDNAIRHGIRVTLVDNSPAHAGSARWSRLEGHVTRPGKKSGATPETYSLTHEIEVSRKLSAVDQYVTLVHELAHIYCGHLGTPDVALWPSRRGGVVRDEVEAESVAFIVMCRLDPQFTMGDYLLGYLSNSTEIPDGVSLQRMMQVASDIMQMGQRRLKAGEI

SEQ ID NO: 1963 - protein, 362 aa, unidentified
  source 1..362: note = Related to PDJD01000001.1; note = Serinibacter salmoneus
MWLADPRDFLLGLKLARLLGDAGLGAERTRAIIRREVDPYRVLTVPRIRAAAREIRKPDADLMAFQRALLAEWTPGHVAHPRAFAYARGRSIVDCARLHLGAELVVRLDISNFFHSITERHVFRALPGPHSRNSFDAAQITRLVTAPSTSPLSWNQRRTGAIQLCNPRQCRCWPLRCEKVRANYFGHAPEGFLPQGAPTSGLLSNLVMREFDQRMYEWAEANRWVYSRYSDDMHFSSRRPRAHTDTDRLVTHVRRELGRLGMHLNDKKTTVARRGARRQVLGLLVDGHHLRLTREYKRELELHTRGVSEFGLEPHAHHWGFENAGALVTHVNGRLAHATHAEPDWGVPARERWLAATTHYSV

SEQ ID NO: 1964 - protein, 373 aa, unidentified
  source 1..373: note = Related to NZ_JACGWX010000001.1; note = Yonghaparkia alkaliphila
MVERLDPNLRSYFDLSSLVQVSGADSGFIEDVVDRRLSPYYVSAVPKRTGGKRHIEKPNAEILAIQQPILRDILMTRSPSEKVFSYVKGRSPVQCARQHLGARWLLRVDLKAFFYSISEVDIYYLFLKEFGFKQLTAFQLARLVTVVSDDSLEVSEVDLLKAHPHVSKYRSRYVAGYTPQVLGHLPHGAPTSGALSNLVSRQLDHAIAALAVQHELVFARYSDDIYLSARRPITRTQSTKVLSDLSGVIRGNGFVVNQTKTRMSFEDDKKLVLGIHVDGDRLRLRREYRDRIDYELHMIETHGAESHAQKRGDKGVAFLLGRVSGLIAHAQDVDPEWGRGRRARFRAILMDGKSTEALLHKHLTERRERLRST

SEQ ID NO: 1965 - protein, 397 aa, unidentified
  source 1..397: note = Related to LT629734.1; note = Agrococcus carbonis
MESPHLYRSKAPIGLDPAVIERAIRLSTTQSANGVQPILTLKHLANQAGVGFVFLERVCDRSIDPYVIYGVRKRVGSSRRMIAAPEEQLRVVQRWLLDHVFTNMHVHSSAFAYVKGRSAPMAARLHLGANWMLKLDVRNFFHAFDERQVYDVLAGTGYSDLVRLQVARISTRHVREYLPWLPEKYRESRSQEGASAARFAHTAAEIDAFELTALPHDGGSRLGYLPQGAPSSGAISNLLSRELDRDLAELGISRGLVYTRYADDIALSASTPFSRKEAEALMHDASRALRKHGLEPNHTKTRIVRPGLPIELLGVRVDGEYTRVSRRVREKIEFHIRAIEKFGLAAHAAHAGFGDAIGCANHVIGLVRYAHDVEPQRAGAYFARIERAIPGLQVRPL

SEQ ID NO: 1966 - protein, 397 aa, unidentified
  source 1..397: note = Related to QKSO01000004.1; note = Curtobacterium sp.
MESPHLYRRNAPTDTEASVIDRAIQLMSLQSRSGATPILTLKHLAVQSGVRLSFLERIADRELDAYDVHEVKKRGRSSKRLIAAPHDELLRAQRWLLDNVFAHASIHSASYAYQTGRSAKLCAQQHLGARWAIKLDAKDFFHQYDEFQVFNLLRGFGYSPLVRLEIARICTRHVSTDQDWLPDKYRQPTRLRSIPELPPAEYMWSGPDLIDVEAYAHLPHSQGRRLGYLPQGAPTSGAISNALAYDLDQSFEKLAEANRMTYTRYADDIFLSSYSIFERPSAEQIVHQAHSIFEQHELQPHARKSRILTPGRPIELLGIRVDGESTQLPKRIKSKIEFHIRGVESFGVHVHASHSGFREGLGFVNYLEGMIRYAINIEPERGRRWNRRLRHALSGRV

SEQ ID NO: 1967 - protein, 396 aa, unidentified
  source 1..396: note = Related to JAINWC010000029.1; note = Agromyces mediolanus
MESPHLYRKNAPSDLDPAVVERAIQLSQAQEAAGVAPILSLNHLAVQANAPLKVLERIAARAVDAYHIHEIRKRDRVSKRMIAAPTPELRQVQRWLLDNVFARVPVSPYAFAYVEGRSAPQCARRHVGATWLVKLDVKDFFHEFDEAQVFSVLRSVQYSALVSLEISRIVTRHVSTPQAWLPKKYASTSPRRPMPDAELVPDLFDHADDAPEYLSHPQGVRLGYLPQGSPSSGAISNILSRQLDEELAALASARGLTFTRYADDITLSSGEIFNRGRAEKILHEATAILHRNRLTPNRRKSRIVTPGLPLEVVGVRVDGDESRLPRRLRDRIEFHLRGIEQFGFAAHSRHVGFDDVLGFSNFLYGLIRYAHDVQPSLAAAYFARADAHFPAAQVGS

SEQ ID NO: 1968 - protein, 328 aa, unidentified
  source 1..328: note = Related to NZ_RKQW01000003.1; note = Frondihabitans sp.
MSGVSYAFLRRVVERESDPYNIYTIRKRDGKSLRSIAAPSEALAAVQRWLLDQTFARMPSTPWSFAYEKDNSSVKCAQEHLGATWLLKMDLKDFFHQTDERDVYHLLRKYRYSELVAFELARIVTRSVRDPQDWLPPKYASTVEWRRGAGFPYGKRVRLGYLPQGASTSGAIANVLASGLDRALHELAISHGTTYTRYADDLTFSGGPYDRASAREFASSVTSAIFAAGYTPNKKKTRLIAPGRRLEVLGVLVNGSKLRVPARFRKRVEAHLYGLESHGVMGHLHSRGFRDIDGMSRHILGLIAHVHAVDSSLAKVYYTRFASAFPNP

SEQ ID NO: 1969 - protein, 384 aa, unidentified
  source 1..384: note = Related to PSVB01000001.1; note = Rathayibacter sp.
MNLSPHLYRKNAPSGLDGAVVERAIKLTSEQRARGVEPILTLNHLAALSGTSGNYLHAVVDRQVDGYDLFNIRKRASGRRRSIAVPHPELAKVQKWLLTDVFSKVTVHSDCFSYRHGISIKDCASRHLHAEWMLKVDLSDFFHQIDERHVFGVASSLYEPLVAFEVSRIVTRQPHVGQPWLPKKYLRTVHQIPTKSSYPYKRSEKIGYLPQGASTSGYISNLVAKPLDTALSSIAAALELTYTRYSDDLAFSSARVLSRSQGLDVLREVARMVGKTGFHINESKTRFSTRANGLNLLGLTVDGESLRLQRHLRTRIEFHVSGVERFGANAHSIHCGFRDVLGMSHHILGLLAYASHIEPAKASIWRARLDASRDALLFGAPLAE

SEQ ID NO: 1970 - protein, 342 aa, unidentified
  source 1..342: note = Related to NZ_BPFW01000004.1; note = Arthrobacter sp.
MFISKRPIPDLEHLALAVGLRPEYLRDVAARRSDPYHEFQVAKARGSVRTIAAPEPDLAKAQRWILDNMFLGSHAGGRSFAYRKGVSVKDCATVHVGARWLVKLDLQDFFHSIDSRRVARIFRKVGCDEVTSVQLARLCTRRNSGSIGQLAGPTPLDYLPQGAPTSGMLANLAAENLDRSMSRLASRTALKYTRYSDDLTFSSEEDFSRASAFALIRGARGEIARNHFSMHEDKIRISPPGSRLVVLGLLVDSDRVRLRGDFKKTLKWHVYGCARFGPNEYSASRGYASVEDYQSHVGGLFAHAVDIEPEWAAPLQRSWKELTAAQAEAASAGSLVVSASGD

SEQ ID NO: 1971 - protein, 326 aa, unidentified
  source 1..326: note = Related to NZ_BMKV01000004.1; note = Pseudarthrobacter scleromae
MLINKRPIPDLEHLALAVGLRPAYLRDVAARSIDPYREFQVAKARGSVRTIAAPEPDLAKAQRWILEHMFLGSHAGASSFAYRKGVSVGDCARVHVGARWLVKLDLKDFFHSVDARRVATIFRKVGCDDVTSVLLAKLCTRRKNGSRGTLTGATPLDYLPQGAPTSGMLANLAAENLDRSMSRLASRYRLMYTRYSDDLTFSSNRDFSRASAFALVRSARGEIARNHFSMHEDKIRISPPGSRLVVLGLLVDSERVRMRGDFKKTLNWHVYGCTRFGPDKYSASLGFSSISEYQAHVNGLFAHAIDIEPEWAGALHARWKEITAPR

SEQ ID NO: 1972 - protein, 326 aa, unidentified
  source 1..326: note = Related to NZ_WVUN01000028.1; note = Arthrobacter sp.
MELTNLQQLMQKTQVSETALFDLMRGQVDPYTEFRIPKGRNGAFRIIAAPSRDLGKLQRSILDNILSAPQRASQSFAYHRGVSITDCARVHSPARWLVKLDLKDFFGSVSAVRVAAAFSSIGLTEEFSSQLAFICTRRAGEEGTRFLPQGAPTSGLLANLVAAALDESLVLFAQHLNLRYSRYSDDLIFSSSGTFSRSKALRIVRQVRSKVAAHGFTLNEDKIRIRPPGSRLLVLGMLVDSEYPRLRHDFKRLIEWHVYGSERFGIAEYSASRGFASIESYLRHVDGLLAHALDVQPDWAAPMRQKWNFISSAPAGGLLRPPREVP

SEQ ID NO: 1973 - protein, 409 aa, unidentified
  source 1..409: note = Related to NZ_FNWI01000004.1; note = Varibaculum massiliense
MELLPFNPIVKPSRVAPAQINSLRYLLRLHNLENPEESILYPSAHVAISSHNTAEIWLDHEKTTSLRKVPLYYKYRSVPKHSGGRRILSEPSSSLKSLQRWILRHCFTDDMVSPAAYAYRPGRSIQDCAAVHIGAKWLLKLDLKDFFGGISEARVYELFRAIGYKELVAFELARLTTFLPDKNIRRNIQALYNEKFEITPAARNYTKLEISIDSSSGPYPRYRGSAGKIIRGVLPQGAPTSGIIANICAGELDKELASLALYNGLRYSRYCDDLFFSPRPDHEHFDRSFAGLIIRDVNRAVLKHGFRINQGKTRVVPPGSKKLILGLQVDDSVRLDTAFKKNIDYHIRGIAKFGLQQHVAHTKGTPPPVLSFLNHLQGLIAFAKGIEYWYGETRETNLKRALSVGEVTR

SEQ ID NO: 1974 - protein, 355 aa, unidentified
  source 1..355: note = Related to NZ_PDDL01000005.1; note = Kocuria sp.
MSNRGGSRNLFREIQKVNHDCSKFGVSPIYTLTHLCVVAKVAHKDARDVIFNHQAHYKSRRIKKKSGSGYRTIYEPSPQLKSLQKTILHNCLPTAPASELSFAFETGRNTLAAAGQHVGARAMIHVDVRDFFTSVASKQIYSVFHNLGYPELLSLEMALISTVGHTVTLRQFVEDGLVYEILDPGYLPQGASTSGKLSNMVCADLDEKLSAISHKWGGVITRYADDITFSSPVPLSRSKCTSIYHDLRKALLQSGFVTNSRKTKIFPNVREFKMLGLCVGQENVWLNKSYKKTLRAHLYSLEKFGIFKHSVSRNFDSDLEFMSYMWGHYAYCANVDKKFAGELRSRLEAAGIRKI

SEQ ID NO: 1975 - protein, 324 aa, unidentified
  source 1..324: note = Related to CP018863.1; note = Arthrobacter crystallopoietes
MTHLCVIARVSHEVARDVIFNHRVHYKSRRLAKRPGHGYRTIYEPSAPLKSLQRAILQNCLPKASLTDLSFAFETGRSTSGAARRHIGARSMIHVDIQDFFDSIRSRRVYSVFAQLGYPELLALEMAVIASVGHEVALRGENDKGFTYEFLEEGRLPQGASTSGKLSNLVCLRLDDLLLQISDRWGGVVTRYADDISFSTPRPLSRKECASIYFEIQDAVHRSGFQLNPRKTRILPRGNEFRMLGLCVGQKHVWLNKNYKSAIRAHLYGVEEFGISAHAISRGFDSDYEFMNFIWGHYAYCVDVDVTFARELRSRLEIAGVSRI

SEQ ID NO: 1976 - protein, 334 aa, unidentified
  source 1..334: note = Related to NZ_CP047898.1; note = Pseudarthrobacter psychrotolerans
MTHNVVPVYTLAHLCVIAKVPYEAARDVIFNHRAHYTSRKLVKRSGLGFRTIHEPSPQLKSLQRAILQNCLPRDASSALSFAFEAGRNTSQAARHHIGARAMIHVDIQDFFGSIGSRRVYSIFAKLGYPELLALEMAFITSVGHEVTLRGPDDRGVPYEFLKEGRLPQGASTSGKISNLLCRELDNLLSEIAVKRGGVVTRYADDISFSWPNPLIRSESGTILAEIDRAVSEAGFSLNRKKTRVIPKSHEFRMLGLCVGQEGIWLNRNYKSHIRAHLYGVEEFGLSEHAISRGFHSDLEFISFIWGHYAYSAYIDPSFASEVRARLEMAGVPDV

SEQ ID NO: 1977 - protein, 355 aa, unidentified
  source 1..355: note = Related to JAHRED010000024.1; note = Paeniglutamicibacter sp.
MKRRNATEALIRSVRRIENDCSRSGVLPIFTLVHLCVVSKTPYNTARDVIFDPRVHYSTRRMAKRSGSGFRSIHEPSPPLKALHRAILENCLPVSGVSDMAYAFHPGRDTLAAVRAHVGAQSMIRVDIKDFFGSIGTRRVAAIFMNLGYPELLALEMALLTTVGHEVILRGEHDSGPIYEIHKEGRLPQGASTSGLLANLICAPLDQLLSMVALQWDGVITRYADDICFSSHTPTSREKCQDILRDIICAIESQGFKLNSKKTRIHPKGKVFRILGLCVGESDVWLNRNYKRSLESHIHGVKKFGLINHSYSRGYGSDLEFIEFMWGHYAYSIHVDPTFGIYLKNQLQENNIVSI

SEQ ID NO: 1978 - protein, 368 aa, unidentified
  source 1..368: note = Related to VAHO01000005.1; note = Pseudarthrobacter sp.
MVGIASPHAYSAALSARGGSPQLLREIREIDRLTRSSHVIPLYTLTHLCTVAKVPYEAARDVIFNHRAHYSARKLKKHSGKGFRTIHAPSPHLKSLQLAILENCLPKRPTSDLSYAYEPRRNTLEAARRHIGAKTMIQLDLADFFGSISSTALYKTFVGFGYPKLLAFEMSLISSVGHEVTLRGPDEKGVVYELLKSGRLPQGASTSGKLSNLVCIGLDQLLGEVATAWGGIITRYADDITFSTGHAVSRSECNSILRDLKSAIHVSGFTMNERKTRVTRSGQEHRVLGLCVGQDSVWLNRNYKNSIRAHLYGLEKNGLADHGIHRGFSSDQEFMSFIWGHYAYCVYVDPDFGAEMRARLELAGVERV

SEQ ID NO: 1979 - protein, 370 aa, unidentified
  source 1..370: note = Related to QFNW01000102.1; note = Kocuria rhizophila
MVEKIAPHEYFKELSERGGSRQLQKVITKVNQECAENNVLPVYTLNHLSVISKIPLFVTKDIIFDHSKYYTRQKVAKRSSPGFRTIYAPKFPLKQLQRAILSNCLPNNGQVGISYAFQKGSNAISACRQHLGARGMVKLDVANFYGSISTPSIYRIFHSLGYPELMSIEMALICSVGQVVEMRPDDQSGKIYKIKKRGRLTQGSPASGLLSNIHCRKLDRTLELIARDHGAIVTRYADDITFSTREPMSQYVVNSIIGSSIHALKRQRLNLNRRKTSVIRNGRSFNLLGLRVADDGLHLNSGYKSTVRNHLKKASLQGVSKYSLSLGYSSDLEFIFMLWGHYAYSMGVEKDFAAEISSKLHTLGIPRLTA

SEQ ID NO: 1980 - protein, 377 aa, unidentified
  source 1..377: note = Related to NZ_BMFW01000055.1; note = Arthrobacter liuii
MSVSSHAFTEGLFAAGGSPALLRQIHRVNFDCGNAGVTPLYTLGHLAFLSAVPHGVLRRMLLETKSHYTEQRLAKKKPGTGYRTIRIPSPALLKVQRFILGRCLPPGPSSPISYAYTRGRGIRDAAERHVGARTVIKLDYSDFFSSVGSKAVYRVFESAGYPELLAFEMAMLCTYGATIQLNNEVNGNRPYKNVSRRFLAQGAPTSGALSNFALRSLDKSLGEFELSGFTLTRYADDITISSPRTMTQKEVGSLIRNITELSSTYNLSLNKSKTQVLRNKNSFRILGLSVTSSGVGLTRPYKRSFESELFGIKKGGLSNQAIYRGYSSPMDYIAFLWGHVAFAKGIDPIWSQRMSERLESMGVPFIDAIGVFGSSLP

SEQ ID NO: 1981 - protein, 361 aa, unidentified
  source 1..361: note = Related to JACFRS010000007.1; note = Bifidobacterium apousia
MEAQHRGLDKDTIEASIRQYQSMLDCGILPILSLKHFAKLVNVDYSYLRRIVGRKIDPYKTIEQQKRSGGTRLISAPEKHLQDTQRWILDYVLSDAKTHPLSFAYENGKSILKCAKIHVGMRWMIKLDLRNFFDSIKENRIYKVFRELGYPSLVSFEMTRICTRSQGFNSIKKVANKYPVIHTYLYGASGCLPQGAPTSGKLANIVCYGLDEEINRLAIRNRFTYSRYSDDIFLSTCDSFNRKKAQQIISCVNNFIHKEGFSLQKKKTHIITPGARKIVLGLTVTDQGVKPMRGFRKQIESDIHGVKKFGLVQHVQHRHYHSIFSFINHVDGCIAFVYGIDSQLGDRYKKQWGEALSRYNL

SEQ ID NO: 1982 - protein, 369 aa, Micrococcus sp.
  source 1..369: note = Related to NRSP01000001.1; note = Micrococcus luteus
MSPPHLSSANEETSCEEAAIVSRMREISGIIESNDAHPIFTLNHLAYEAGVSYGFIRSVVARRINPYRHYEMRKRRGGYRVISSPVPDLARVQRFILRKILSVQRDNPASYAYREGKSIKDCASRHIGSRWMIKMDIEDFFGSVNSKQVYFLFRDLGYSSLVSFELSRLVTWGCSPTAMNWQPYDYKISDYRHSIVGSLPQGAPTSGKIANLIARDLDKSLHGLAKTYGAIYTRYSDDIIFSFRRNITRPEARVIVKKSYDLMRANGFSPNLKKTAVIPPGARKIAVGLVVSDNVYLSREFKRRTERLVHGVYKEGVVPFSERAKFRSPIGLINYIEGSLAFAAHIDRKWAEGQQQKLLSSMRKNTKIR

SEQ ID NO: 1983 - protein, 340 aa, Pseudomonas fluorescens
  source 1..340: note = Related to NZ_JSAL01000022.1
MRSVEEWKHFFLSRGIANELIERYLKQISLLSNTKSPIIFELEHLSLLVGVKYEVLLNMIRGSSSYYRTFSIKKRAGGERVIEAPYPSLLQCQTWIYHQILLKSPVHDCAHGYVPGRSIFTNATVHLGCKTLLKMDFKNFFPSVGIGWVIKFFSELGYDKNVAYALAALCCNRGRVVQGASTSPYLTNILLYNLDDRLFKLSSRSGLRYTRYADDLTFSGGYISTKFVDLVSSMVSEFGLVINDSKTRLLIEKNKKLVTGLSVSGSSLRITREMRRSITKDVFYIEKYGLFSHVSQMKIKDPFYLESIAGKVAFWIQAEPLNSFALRCRDILAGNFSRVE

SEQ ID NO: 1984 - protein, 360 aa, Pseudomonas sp.
  source 1..360: note = Related to NZ_CP010979.1; note = Pseudomonas putida
MKKIDEWKRFFEKRGVIPELIEKYLDQIARLNKSGAPIIFEVEHLSLLIGIKYDTLLKMIHGGSSFYRKFTIKKKSGGDRVIEAPYPSLMQCQNWIYENILLKCEVHPSAHGYVRGKSIFTNASPHLNRSSLLKMDFENFFPSIKIGWVVSFFSRLGYSKKVSFALASLCCNDGCLVQGAPTSPYLTNILLRRLDKKLFQLAAKSDIAYTRYADDITFSAQLIPSYFPGLVASICARYALKINSNKTQLLVNKNKRVVTGLSVSGESLRITRELRRKIKQDLFYIEKYGLLSHISSQKIKDPFYLDSILGKVNFWLQAEPANEEALSYKEILLSYFSNSKVDVLLKRKSTRRSVGLLAAE

SEQ ID NO: 1985 - protein, 341 aa, Pseudomonas sp.
  source 1..341: note = Related to NZ_UTCV01000052.1; note = Pseudomonas viridiflava
MKKLSEWKQFFLSRGLSQELIQRYLDQIKMLAGSGSPVIFELEHLSLLVGIDSKTVLAMVHGSSSFYRAFTIKKRSGGERIINAPYPSLLQCQNWIYTNILLNCPVHDNAHGYVRGRSIFTNASPHLNCAVLLKMDLKDFFPSIGINWVINFFSDLGYSKVVAQLLAALCCNRGALVQGASTSPYLTNILLRRLDERFSRLAQKNNLNYTRYADDMTFSGGYISKNLPQLISSITLDYGLTVNDAKTRLMINKNKKIVTGLSVAGTSLKITRDLKRTIKQDVFYIERYGFLSHVSQQKITDPFYLDSIFGKVNFWLQTEPGNAEAIRCRDILHPNFGISRL

SEQ ID NO: 1986 - protein, 342 aa, Pseudomonas sp.
  source 1..342: note = Related to JAEKDB010000004.1; note = Pseudomonas haemolytica
MKKINEWKRFFLSRGIPQKTIDQYLDQIKLLTVSNSPIIFEVEHLSLLLGIEYLTIQAMINGTPKFYREFIIKKRAGGNRTIHAPYPSLLHCQDWIYQNILLNCAVHNNAHGYIPKRSIFTNASPHLNCKVLLKMDLKDFFPSIGIGWVVNLFSGLGYSHGVSYALASLCCNNGCLVQGASTSPYLTNVLLHGLDERLTKLASKSNLKYTRYADDMTFSGGYISNKMPALIESIVNDYGLVVNATKTKLMINKNKKIVTGLSVAADALRITRELRRSIKQAVHYIERYGFLSHVSQEKIKDPFYLDSILGKVNFWLQAEPHSSDAKNCRDVLLPYFGKNYQA

SEQ ID NO: 1987 - protein, 359 aa, Pseudomonas sp.
  source 1..359: note = Related to NZ_JAGYGI010000002.1
MNEAVVKTWRKHFERRGISRELIESYLPYIQKLCKTSSPVIFEFEHLSLLIGVEQHELRKMVNAPHAFYRSFQIKKRSGGLRKICAPYPSMLMCQDWIYNNILINKPVHSAAHGFVPGRSIFSNASAHLNSKCLMKMDLKDFFPSIPINWVVNYFLSLGYADNVSFYLAALCCSEGRLVQGSSTSPYLTNILLKNLDERISLLAKSYNLNFTRYADDLTFSGEYIPHKLIGVVTKIIVQYGLAVNDKKTRLQIGSNQRIVTGLSVAGSMLAVPRTFKRDLKLELHFIKKYGYGSHVSKMKIRNPYYIESLIGKLNFWLQVEPSNMDALSGIKLLKGIQQGEISLLQRSVGDSDQLNLHA

SEQ ID NO: 1988 - protein, 348 aa, Pseudomonas sp.
  source 1..348: note = Related to NZ_LHUU01000009.1; note = Pseudomonas protegens
MTKSVKDWLKHFERRGISRDLVESYLPYIKKLNQTSSPVIFEFEHLSLLIGVDQHELRKMVNAPHAFYHSFQIKKRSGGMRKIHAPYPSMLMCQDWIYKNVLINKPVHSAAHGFVPGRSIFTNASVHLGSKCLMKMDLKDFFPSVPINWVINYFLSLGYADNVSFYLGALCCCEGRLVQGSATSPYLTNILLKGLDERISLLAKAYGLRFTRYADDLTFSGNYIPHKLIGVVSEIIVQYGLRVNDKKTKLQVGANQKIVTGLSVSGNALALPRKFKRELKMELHFIKKYGYVSHASKKKIRNPYYIDSVIGKLNFWLQVEPANMEALSGLELMRGIQLGHVSSLQSHV

SEQ ID NO: 1989 - protein, 340 aa, Pseudomonas sp.
  source 1..340: note = Related to CP071730.1; note = Pseudomonas aeruginosa
MKKISYESWRKYFLSRGISPDYIQAYLSYIEKLSSTSSPVIFEFEHLSKLIGIEYDALRSMVNSPSSYYRVFNIKKRAGGLREIHAPYPSLLMCQDWIYRNILLSKPVHAAAHGFVPSRSIFSNASKHLGKKCLLKMDIKDFFPSIKINWVIKYFQTIGYADNVSFYLASLCCSDGALVQGSSASPYISNLLLYGLDARLSRLAKSYGVEYTRYADDLTFSGDYIPHFFIGFVTEIVGDYGLSVNEGKTRLKIGDGQKIVTGLSVAGEKLKIPREHKRRMKQELHFIRKYGYLSHMAKQKRRDPFALESLLGRFSFWLQAEPDSSDARGGVEYLKSIRWL

SEQ ID NO: 1990 - protein, 344 aa, Pseudomonas fluorescens
  source 1..344: note = Related to CABVIS010000011.1
MNNNTIVKNWLGYFRQRGVSGLLIEVYAEYIKTLVGNSVPVIFEFEHLSRLIGIDQARFRAMVNSPSSFYRTFHIKKRLGGLREISSPFPSLLICQDWIYKNILLNIPVHSCVHGYVPGRSIFTNATPHLNARCLLKMDIKNFFPSIKIDWVANLFNQMGYADNVSFYLASLCCKNGRLVQGASTSPYLTNILLRGLDHRLSSLAKSYNMEYTRYADDLTFSGEYIPHSVIGVVGAIISDFGLEPNVEKTRLQIARNQKIVTGLSVAGESLGVPRSFKRELKKDLHFIQKFGFESHLAKKKIRKPFYIDSLIGKVNFWLQAEPADQYAMQALSMLQGIHERRAV

SEQ ID NO: 1991 - protein, 343 aa, Pseudomonas sp.
  source 1..343: note = Related to NZ_JAIWYL010000001.1
MNEALIKQWLAHFRKRGVSGPLIDVYAVYIRTLIGNSVPVIFEFEHLSRLIGIDQARFRAMVNSSSSFYRTFHIKKRLGGLREISSPFPSLLICQDWIYKNILLNIPVHSCVHGYVPGRSIFTNAAPHLNSKCILKMDIKDFFPSIKIDWVANFFNQLGYADNVSFYLAALCCKDGCLVQGASTSPYLTNILMRGLDHRLYKLAQSYSMKYTRYADDLTFSGEYIPHTVIEVVDSIVSDFGLEVNTDKTRLQIDRNQKIVTGLSVAGKSISMPRSFKRELKKELHFIQKYGYQSHLSKKKIRKPFYIDSLIGKVNFWLQAEPADTYAIKSLFMLHEIQKGNSI

SEQ ID NO: 1992 - protein, 343 aa, Pseudomonas sp.
  source 1..343: note = Related to NZ_CP027656.1; note = Pseudomonas chlororaphis
MNDIKIRNWLSHFRQRGVSEALVEIYAEYIKTLVGNSVPVIFEFEHLSRLMGVDQTRFRAMVNSPSSFYRTFYIKKRLGGLREISSPFPSLLMCQDWIYKNILINIPIHPCAHGFAPEKSIFTNATPHLKARCLLKMDIKDFFPSIKINWVANFFNQIGYADNVSFYLASLCCKEGRLVQGSSTSPYLTNILLYGLDQRLFGLAKTYNMTYTRYADDLTFSGEYIPHTVIDIVKSIILDFGLKPNSEKTRLQIDKNQKIVTGLSVAGDSLSAPRSFKRELKKELHFIRKFGYESHLAKKKIRKPFYLDSLIGKVNFWLQAEPNDQHAKQALVTLRELYESRKI

SEQ ID NO: 1993 - protein, 349 aa, Aeromonas sp.
  source 1..349: note = Related to NZ_CP095841.1; note = Aeromonas veronii
MIKKTFDNNSSLDSKVNNWIEYFNNRGVSLELIDEYKTFILNLISKDLPVIFELEHLSLLLGIQYSEFLKIINNPDEYYRKFDIKKRKGGKREILAPLPSLLHCQRWIYKEILTKSKTHNNAHGFISNRSIITNASLHLNKKCILKMDIKDFFPSIPINWVINYFSSLGYPNNISYYLSAICCCNDSLPQGAATSPYLSNILLFSLDDRLTKLSKKYNLVYSRYADDMNFSGEYIPSHFSEIVSEIILSYGLEANKNKTQLLTKKGKRIITGLSVSGEKLTLPRNKKREIRKEVHYIEKFGYLSHAAKLKIKNPAYIDSLEGKLTFWLQVEPNNAFAKSGLLLIKSIRE

SEQ ID NO: 1994 - protein, 348 aa, Citrobacter sp.
  source 1..348: note = Related to CP045205.1; note = Citrobacter telavivensis
MTFQKLDKVQELKINSWYLYLKNRGLPSDLIDEYISYIISLIDKNLPIIFELEHLSKLLSINYIELLKIINSPENYYREFNIPKRKGGTRNILSPYPSLLHCQKWIYKNILSKIAIHDAAHGFIKKRSIMSNAEKHVEKKCILKMDMSDFFPSIPINWVINFFHSLGYSNNVSFYLSSICCLNNGLPQGGATSPYLSNILLVSLDRRLTNLSKSYKLDYTRYADDMTFSGDYIPLKFSEIVSQIIDNFGLHINNDKTQLITKPGKRIITGVSVAGSKMTLPRDKKREIRKEVHYIKKFGYLSHASKMKIRNPAYLSVLEGKLNFWLQVEPDNEYAKQAIVFIRTLKNI

SEQ ID NO: 1995 - protein, 343 aa, unidentified
  source 1..343: note = Related to NC_012691.1; note = Tolumonas auensis
MKKNNTIEYWISYLISHGVSLDIIEEYTPYITNLVDKNLPVIFELEHLSLLIGIKYLELLKMIHSPDSFYREFDIPKKKGGVRHIVSPYPSLLSCQKWIYNNILKKISIHPAAHGFNLNHSIVTNAQSHLNKKCLLQMDVKDFFPSLPINWVINLFSSLGYSHNVSFNLASLCCLNDKLPQGAATSPYLSNILLVGLDKRLSLLSTSYQLTYTRYADDLCFSGEYIPHELIQTIESIIIDYNLTPNKNKTRLQLNNNKRIVTGISVSGPKATIPRQLKRELKQELYYIQKHGYLSHVTKMKISNPKCLQSLEGKFSFWLQVEPDNDFAKKSLMFLIKLRKENT

SEQ ID NO: 1996 - protein, 344 aa, unidentified
  source 1..344: note = Related to JABSQN010000005.1; note = Piscirickettsiaceae bacterium
MNKKYNIPYWKKFYRSRGLSDEIISIYLPYIKKLQKNNAPVIFEFEHLSKLLGLKRAELSKIVNSPESFHRKFTIPKKKGGQREIVSPYPSLLHCQKWIYRNILLPQPIHDSAHGFVPNRSIFTYASMHLSKKALLKMDLKDFFPSISINWVICYFSSLGYANNVSFYLASLCCYKGHLSQGSSTSPYLTNILLKGLDKRLQKLSTTYQLIYSRYADDLTFSGKYIPHSYIEIVNACIVDYGLEVNEDKTRLHTKPGQRIVTGLSISGDELKLPRKTKRELKQEIHYIKTFGYISHISKNKISNPYYLESLIGKVNFWLQAEPDNLFAKDSLNHLLEIKRSALS

SEQ ID NO: 1997 - protein, 334 aa, unidentified
  source 1..334: note = Related to NZ_CP036266.1; note = Gimesia chilikensis
MKDWEKYFIDRGLPTDTISTYLSYISQLSENQVPVIFEFEHLTKLLGLKRNVLAKIVNSPEHFHRKFSIRKRSGGKRIIVSPYPSLLYCQKWIYVNLLLKQKVHTAAHGFVPGKSIFSNAKLHLSKRSMLKMDLKNFFPSIPMSWVINFFHDLGYAKNVSSYLASLCCYEHRLSQGAATSPYLSNLLLKNLDDRLSSISNSYRLQYSRYADDITFSGDYIPSKLIKIIEEIVDDYGLAINQKKTRLHTKPGQRIVTGLSVVGEELTIPRKMKRDLRQEVHFIRKYGYLSHISKMKINHPFYLESIAGRFQFWLQAEPENEFAKESLTYLQKIKG

SEQ ID NO: 1998 - protein, 334 aa, unidentified
  source 1..334: note = Related to NZ_CP081832.1; note = Idiomarina abyssalis
MFEQWIDFLNDRGVKTEVIESLSPIIQTLSSNKLPVIFEFEHLAKILGFNEASLASMINSPSNFYRTFYIPKRRGGKREICSPYPSLLECQRWIYKNILLKLDIHSAAHGFAPGRSIITNAKCHLSKNAVLKIDLKDFFNSIPINWVINLFYSLGYPRNISFYLASLCCLEGSLSQGAVTSPYLSNLLVKQLDSRLTNLSLKHHLVYSRYADDMSFSGAYVSKNFISSVGEVITDFGLMVNHSKTSLRTGNSKKAITGIIVSGNRLRASKQLKRKLSQEVHYIKKFGFLSHINKLKIRDPNYKLSLIGKLNFLKQVEPDNEFAIDALNYLRKLE

SEQ ID NO: 1999 - protein, 344 aa, Pseudomonas sp.
  source 1..344: note = Related to CP049161.1; note = Pseudomonas aeruginosa
MHKEKHIIRAWEEHFKDRGISSDLIVQYTTYIKKLSENDLPIIFEIEHLSLLIGINLPSLRKIINAPEKFYRTFSIPKRRGGEREISAPLPSLLACQDWIYKNLLAKISIHDSAHGFVPGRSILTNASPHLAQKALLKMDLKNFFPSIPINWVMKLFSDFGYANNVAFYLASICCLNESLAQGSATSPYLSNILVKGLDKRLKALSDSYHLEYTRYADDLTFSGNYIPHTFPSTVEEIVSDFGLEVNIEKTRLHTKPGQRIVTGISVAGATPSLPRASKRQIRQEAHFIQKYGLISHISKKKIRAPTYIDSIEGKLAFWLQVEPNNEFARESLSHIRKIRRDHQ

SEQ ID NO: 2000 - protein, 316 aa, unidentified
  source 1..316: note = Related to PBKZ01000017.1; note = Rheinheimera sp.
MVTTSLKNAVLLQDLPVIFELEHLSKIIGVEIRTLQKMIYCSRKFYRSFSIPKRNGSRRQIDAPYPTLLLCQKWIYENILKKTSVHHSAHGFIEKKSIITNALPHKNKKTLLKIDLKDFFPSIPLNWVVNHFLSLGYANNVSFYLASLCSLEGNLCQGAPTSPYLSNILLTGLDNRLTKLAASYCLEYTRYADDMTFSGNYIPHTLIVTIENVISSYGLSVNSEKTRLHLKKGQRIVTGISVSGDSLSVPREYKRALKQEIHFIERYGYISHVSKLKINDPLYLEKLIGKVNFWLQVEPENNFAKHALKLLRAARK

SEQ ID NO: 2001 - protein, 341 aa, unidentified
  source 1..341: note = Related to JAENMP010000010.1; note = Serratia fonticola
MKNNKIKSWIDFFADRGVSNEQANLYIQYISGLLDSNSPIIFEKQHLSHLIGIDEATLDRMISSSKDFYREFNIPKKKGGMRKIVSPYPSLLMCQKWIYKNILLNDKPHDACHGFTPAKSIITNASIHLNKPCLLKMDLKDFFPSIPINWVINYFKHLGYTNNVSFYLASLCCYDRKLAQGASTSPYLSNLLLKGLDNRLNNLSKKYRLSYSRYADDMCFSGSYIPNKIIGVITEIIKKFGLSINEEKTSLLIHSNKKIITGLSVSGQQLSLPREYKRKLKNELHFIMKYGYISHITQQKIKDPNYLFSILGRVGFWLQVEPNNELAISSRDYLLSILKSN

SEQ ID NO: 2002 - protein, 342 aa, unidentified
  source 1..342: note = Related to NZ_JPRU01000003.1; note = Buttiauxella noackiae
MKNNDINSWMEFFLDRGVSSDQINYYIPYIAKLLKTNSPIIFEKQHLAHLIGIDESILDKIISSPNHFYREFFIPKKRGGLRKITCPYPSLLMCQKWIYKNILLNDTPHVSCHGFTPSKSIITNASLHLKQKCLLKMDVKDFFPSIPINWVINYFKGLGYSDNLSFYMSSLCCHDKKLAQGASTSPYLSNLLLKGLDNRLNNLSRKYRLTYSRYADDMHFSGDYIPSDLVGVITSIINNYGLSVNEKKTALYIKSNKRIITGISVAGDELSLPRDYKRKLKNELHFIEKFGYISHITQKKIKDPNYLYSILGRVNFWLQIEPDNDAAIKGRDYLMRVLKNNL

SEQ ID NO: 2003 - protein, 341 aa, unidentified
  source 1..341: note = Related to NZ_ARWD01000001.1; note = Serratia plymuthica
MKNNNISAWVDFFADRGVSDEQTDLYIQYITVLLSSEVPIIFEKQHLSHLIGIDESILDKMVSSSKNFYREFNIRKKKGGERKIVSPYPSLLMCQKWIYKNILLKDKPHEACHGFTPSKSIITNASIHLDKACLLKMDLKDFFPSIPINWVINYFRQLGYSNNISFYLASLCCYEKKLAQGASTSPYLSNLLLKGLDNRLSNLSKKYQLSYSRYADDLCFSGKYIPNKIIGVITNIIANYGLQVNSDKTSLLIKANKKIITGISVTGQKPSLPREYKRKLKNELHFIKKYGYLSHISQQKIKDPNYLLSILGRVSFWLQVEPHNELAITSRDYLLSILKNN

SEQ ID NO: 2004 - protein, 341 aa, unidentified
  source 1..341: note = Related to NZ_JQHM01000002.1; note = Pectobacterium betavasculorum
MKNNELASWVDFFADRGVTDEQINIYIPYIKKILESKVPVIFEKQHLAHLIGIDENTLDKMVSSPDSFYREFNILKKRGGTRKIVSPYPSLLMCQKWIYKNILLKDSPDKACHGFNPSKSIITNASVHLGKASLLKIDIKNFFPTIPINWVINYFKKLGYADNVSFYLSALCCYEKKLAQGAATSPYLSNLLLKKLDDRLEKLSKAYHLSYSRYADDMCFSGDYIPYNIINIITEIIESYGLFVNKDKTSLLINANKKIITGISVSGETLSLPREYKRKLKSDLHFIEKYGYISHISRKKIKDPNYLLSILGKVNFWLQIEPSNETAINGRDMLLAILREH

SEQ ID NO: 2005 - protein, 344 aa, unidentified
  source 1..344: note = Related to CP026651.1; note = Morganella morganii
MKKNENELTLWIDFLIDRGISSEQIALYVPYISKLLESNLPIIFEKQHLAHLIGIDENTLNKMTSSPHSFYRNFNIPKKRGGFREIFSPYPSLHMCQKWIYKNILLNDKPHNACHGFTPSKSIITNAAIHIGQSSLLKIDLKNFFPSIPINWIINFFKRKGYTHNVSFYLASLCCNNKVMAQGAPTSPYLSNLLLKGLDKRLYNLTKKYNIKYSRYADDMFFSGNYIPYDFIRVITNIIEDYGLNINKDKTAFLINANKKIITGISVNNNTLSLPREYKRKLKNELHFIKKYGYLSHINKQKIKDPNYLFSILGKINFWLQVEPMSKKAIESKKLIISILKMGA

SEQ ID NO: 2006 - protein, 343 aa, unidentified
  source 1..343: note = Related to CWJI01000001.1; note = Yersinia intermedia
MNMKKNTLEHWSEFFHDRGISYELFEIYLVYIQKLISTDSPIIFEKEHLSQLLGINDSILNKMINSPNNFYRKFTIPKKRGGDRNIVAPYPSLLSCQHWIYKNILLTEQPHYSCHGFTPKKSIISNAKIHIGSKTLLKMDLEDFFPSIPINWVVRYFQQRGYANNVSFYLAALCCYDEHLAQGAATSPYLSNLLLKGLDERLTNLCLKYNLKYSRYADDLTISGEYVPHTLIEVITEIVSDYGLKVNIKKTALLINARKKIITGIAVTEDNIRVPRSFRRELKNTMNFILKYGFISHVTQLKIKDPYYLFSLIGKVNFLMQVEPENKNAREWKSTLINILKSQ

SEQ ID NO: 2007 - protein, 341 aa, unidentified
  source 1..341: note = Related to NZ_FXUX01000002.1; note = Pantoea agglomerans
MNKNDIHSWLVFFQDRGLSHDLINKYIPYIIKLQKNNIPVIFEKQHLSHLIGIQERVLDKIIISPSKFYREFSIPKKQGGVRDIKSPYPSLLMCQRWIYKNILLKDSLHPNCHGFTPSKSIFTNANLHTNKKCILKMDLENFFPSIPMSWVINYFMKIGYTHNVSFSLASICCYDRHLAQGAATSPYLSNLLLKKFDARIEALCVKYNVTYSRYADDLTFSGEYIPHRFSSIVEEIIENYGLTPNKEKTRLLINANQKIVTGISVSGENIALPRKYKRKLKNEIHFVITYGYVSHINNLKIKDPNYLLALLGKVNFWLQVEPKNPLALRGKEYLSKVLRDK

SEQ ID NO: 2008 - protein, 337 aa, unidentified
  source 1..337: note = Related to NC_009659.1; note = Janthinobacterium sp.
MKTNEWRAYFEDRGVSTARIDKYVSYIECLSKKNQPVIFELDHLSSLLGIQIEYLSKMIASSHSFYRKFSIPKRSGGKREILAPYESLLTCQQWILKNILKNIPLHSAAHGFRSGKSIKTNALAHINGKALLKMDLKDFFPSIPLSWIIKTFQDIGYAPNVAYYLASLCCYDEKLAQGAATSPALSNIVLTSLDKRLDRLAKKCSITYTRYADDLTFSGEHIHSSFSKLVTKIVDEYGLVVNTDKTRLKVKNGTRIVTGIGILNGRLSIPREYKRELKNEIFFIRKFGFVSHLSNKKISNPNYINSLLGKISFWLYIEPDNQLAIDSHKLVLQLIND

SEQ ID NO: 2009 - protein, 337 aa, unidentified
  source 1..337: note = Related to NZ_AJVC01000002.1; note = Herbaspirillum sp.
MTLLEWKNYFQDRGIEPDLAKKYLAYIKGLQKNNCPVIFELDHLSQLLEIDLNYLARMISASGNFYRSFHIPKRSGGVREICAPHHSLLSCQRWILQNILNNIDLHPAAHGFTAGKSIKTNAISHLNSSAILKMDLENFFPSIPQAWVIQVFKEFGYAPNVSYYLSALCCCDGALAQGAATSPALSNLILRSLDKRLSKLARTCSLIYTRYADDLTFSGKRIHFSLPIKVEEIVKEFGLKVNTKKTRLKLTHGARIVTGICITNGKLSVPREYKREIKNDLFFIRKFGYLSHIANRKIKNPNYLSSLLGRISFWLFVEPTNEFAIKGRNTVLELMRS

SEQ ID NO: 2010 - protein, 337 aa, unidentified
  source 1..337: note = Related to JAGPWD010000023.1; note = Massilia sp.
MESTQWRSYFRDRGIPNELTKSYVSYAGSLQKKNLPVIFEFEHLSLLLGLNIEPLARMIASPSSFYREFAIPKRSGGKRNICAPHESLLLAQRWILKNILEKSEVHVAAQGFLPGRSIKSNALIHLNSKNLLKMDLRDFFPSIPMSWVINVFKDCGYAPNVAYYLASLCCHSEALAQGAATSPALSNIILKSFDKRLTRLANKCGLKYSRYADDLTFSGETIHHSFSGAVEKITAEYGLAVNKEKTRLKIGHGARVVTGISIQGGRLAVPSKFKRELQNEVFFIRKFGLLSHLSNRKISNPNYLNSLLGRVSFWLHIEPENEKAQLARKLIMDTMKI

SEQ ID NO: 2011 - protein, 337 aa, Chromobacterium sp.
  source 1..337: note = Related to MUKQ01000009.1; note = Chromobacterium violaceum
MNISEWRSYFLDRGIKEDLLGIYLSYIRKLNKFKVPVIFELDHLSSLLGINVKFLTRMISSPEDFYRNFLIPKRSGGKREISAPHQSILYCQRWILVNILTHIPIHYSAHGFCAGKSIKSNAQIHLNSKSLLKMDLKDFFPSIPKSWIINIFSDLGYAPNVSYYLASLCCYNDHLAQGAATSPALSNIVLRGLDNRLQSLADKCGLRYSRYADDLTFSGDKISVNFPELVEGIIHNYGLTVNKDKTRLKAKFGSRIVTGVSISGGSLSVPREYKRNLKNEIFFIRKFGILSHVSKKKIKNPNYIYSLLGKLAFWSYIEPENEYPIEAKKFLVELIKD

SEQ ID NO: 2012 - protein, 336 aa, unidentified
  source 1..336: note = Related to PYUJ01000108.1; note = Serratia sp.
MECTWNNYFSDRGLSPDIIKQYVAYANNLERGNLPVVFEIEHLANLIGIKYPEINNIIFGAKSFYRTFKIPKRRGGCRVIQSPYPSLLSCQKWIYNNILKKVQTHPCAYAYKENISIIHNASIHLNADFVLKLDLSDFFHSIPKSWVVNFFSELGYANNVSVALASLCCVNDSLPQGGVTSPALSNILVSSLDERLNRLAHTFDLSYSRYADDMVFSGKRIPATIIKYVTGIIESFGFAINDEKTKLLIKERQKIITGIDTTGPKLTLPRNRRREIKKAMFFINKHGLVAHMNNEKIRNPNYLLSLEGKIRFWLQIDPENNEAKKFLGDIIRIKLN

SEQ ID NO: 2013 - protein, 336 aa, Proteus sp.
  source 1..336: note = Related to CP047112.1; note = Proteus mirabilis
MNKTWRHYFIDRGINDDLLDQYVIYADNLEKNGLPVIFEVEHLSNLVGIKYPEINNLIFGTKSFYREFKIPKRRGGYRTIQSPYPSLLSCQKWIYDNILQKIETHPCAYAYKKNCSIIKNASVHLNENVVLKLDLSDFFMSIPKSWVINFFSNIGYSGNVSIALASLCCLNDSLPQGAVTSPALSNILVSSLDERLYRLASVFQLNYTRYADDMVFSGKKISKSIIKYIAEIIESFGFTLNTKKTKLLIKKKQKIVTGIDITGSKLTLPRNTRREIRKTMFFIKKYGLISHMNNEKIKNVNYLSSLEGKIRFWLQVDPENIQAKEFLHDLIRIKFS

SEQ ID NO: 2014 - protein, 337 aa, unidentified
  source 1..337: note = Related to NZ_JAKMAJ010000005.1; note = Brenneria sp.
MNNNWHDYLADRGLNNALIEEYLAYINRLEENSIPVIFENEHLSRLLGIKYPEFNKLIFGTHKFYRKFKIPKRKGGYRIIASPYPSLFSCQKWIYNNILKKIPTHVCAQAYKKDHSIIKNANLHLNNDVMLKMDINNFFSEIPINWVIKLFSDLGYSKNVSFALASLCCLDGVLPQGGVTSPALSNILMLSLDNRLHKLAEKFDLIYTRYADDMFFSGKKISSKLINYIKNIVEEYNLSINESKTKLLTKEKRKIVTGIDTSSSKLTLPRATRRNIKKSMHFIIKYGLIGHMNNVKIKNPNYLLSLEGKIRFWLQVEPENQEALYFLNEILKIKKLS

SEQ ID NO: 2015 - protein, 338 aa, Enterobacter sp.
  source 1..338: note = Related to CP084692.1; note = Enterobacter mori
MKNNWKDFFESRGIKDDFIDNYLKYIEYINKNEIPVIFEVEHLSHLIGIKYPEINNIIYSPSDFYRKFEIPKRNGGSREISTPYPTLMKCQRWIYENILSKIPTHQCAYAYKKDHSIIKNASQHVNNKNIIKIDLKNFFPSIPINWVINLFVKLGYSNNIPFILAALCCNENCLPQGAVTSPSLSNILLYSLDDRLFKLSEKLGLTYTRYADDMIFSGKHVSPKIIEYIRHIIETYGFELNNSKTKILSADKRKIITGVDISNNELKLPRRTKREVRKVMFFIKKYGLMNHMSNLKIKNPNYLLSLEGKINFWLQIEPTNEEALSYRDIIRVLKKWIY

SEQ ID NO: 2016 - protein, 338 aa, unidentified
  source 1..338: note = Related to CP030173.1; note = Klebsiella variicola
MEQNWEEFFKSRGIKESYIELYLQYIKSIDKNDLPVIFEIEHLSHMIGIKYPEINSLIYGTKNFYRNFKIPKRNGGVRIIDSPYPSLMKCQRWIYTNILLKLSVHHCAYAYKKDTSIVKNASQHLGNECILKLDITDFFSSIKINWVINLFSRLGYSKKISFSLAALCCLHNKLPQGAVTSPCLSNILLYSLDERLFRLSVKLKLKYTRYADDIVFSGDNIHPNTIIYIRSIIDSFGFSINERKTKLLNNKKRKIITGIDISNNNLSLPRKTKRELRKSFHYINKFGLIGHMNSLKIKNPNYIQSLEGKVRFWLQIEPDNKEALDYLFLLKKLNLLTI

SEQ ID NO: 2017 - protein, 334 aa, Enterobacter sp.
  source 1..334: note = Related to JAEKKB010000005.1; note = Enterobacter asburiae
MRREWEDFYLEKGINTNFISTYLDYIKALESRNIPVIFEVEHLSKLIGIKYPEINDIVFGTKSFYREFKIPKKKGGYRKISSPYPSLRKCQTWIHEKILYSLRTHKNAFAYKKGKSIIDNAEQHLNNHFLLKVDIKDFFSSIPINWVIKLFDSLGYAKNVSYALASLCCLNGCLPQGGITSPSLSNILLYPLDERLSKLALKFNLKYSRYADDMVFSGEAIPSKFISYVTDIIESYGFILNKEKTKLLNNTKQKIVTGIDVSKDKLQLPRKTRREIKKIMYYVKKYGIFSHINNEKIKDPNYIKSLEGKIRFWLQVEPDNQEARSYIEHINQMK

SEQ ID NO: 2018 - protein, 342 aa, unidentified
  source 1..342: note = Related to JAHVIK010000003.1; note = Halomonas denitrificans
MKKRKELTTKLWEDYFLDRGLSSELRKTYLEYINFISEKDLPVIFETEHLSNLIGINYQSLNSMVNNPDSFYRSFKIKKKRGGSREISAPYPSLMMCQTWIYENILVDYPIHHCAQAYRSKHSIVTNAKIHLGSRTILKMDLKDFFSSIPINWVIQFFSNLGYPNNLSYALASLCCLEDCLPQGAPTSPALSNILLISLDRRLYRLGKKYNLSYTRYADDLVFSGSYIPHKFIKVVANIVTNFGLTINDEKSQLIIGDKQKIVTGISISGSSPCIPRKTKREIKKELHFIKKYGLVSHVGKMKIRNPNYLASLEGKIRFWLQVEPNNKFALESLLFIRSKRA

SEQ ID NO: 2019 - protein, 340 aa, Vibrio sp.
  source 1..340: note = Related to NZ_FRFG01000024.1; note = Vibrio quintilis
MNKTLKEWKSFFEDRGIELELIKEYLEYIDRLETNDCPVIFEVEHLSKLIGINYEDLNKMIFGEKSFYRTFYIKKRSGNKREISAPYPSLALCQLWIKENILSLDKSHFCSHSYTKKRSILSNAKIHINSNSILKLDIRDFFPSIKINWVINYFSSLGYSENVAFALASLCCLNDTLPQGGRTSPDLSNLLLKSLDKRLYRLAKKFSFKYTRYADDITFSGDDIPAIFINYVSDILVNYGFVLNNNKIRLIKGDKQKIITGLDVSGEKVRLPRKMRRDLKKQVYYIKNYGLLSHVSKQKIKDPNYIQSLLGKLAFWMYVEKSNKEVKGMYEFIKSLNRDN

SEQ ID NO: 2020 - protein, 340 aa, Vibrio sp.
  source 1..340: note = Related to DADXPV010000013.1; note = Vibrio cholerae
MNNTLKEWKRFFEDRGIEPRIISEYLKYIDKLESSGYPVIFEVEHLSKLIGIRYEDLNKMIFGSESFYRTFKIKKRSGGKREISAPYPSLALCQSWIKENILELDKSHFCNHSYARKRSIVTNAKIHVNSNSVLKLDIRDFFPSIKINWVINYFFSLGYSENVAFGLASLCCLSDSLPQGARTSPDLSNLLLKSLDKRLYRLSSKFSFKYTRYADDITFSGDDIPVVFIKYVKDILVDYGFELNENKIRLIKGEKQKIVTGLDISSNDIRLPRKTRRDLKRQVYYIRKYGLLSHVSKQKIKDPNYIQSLLGKLAFWSYVEKNNNEAKEMYEYIKSLNRNG

SEQ ID NO: 2021 - protein, 372 aa, Vibrio parahaemolyticus
  source 1..372: note = Related to ABBBBM010000001.1
MALKSPIFRERNLKDFNAMHSLEGSFYKSFPMKRSQEIKNWQVFFADRGVSESLIEQYMPYVEKLLVADLPIIFELEHLSKLIGIEISELHKMIGNSSKFYREFSIAKKRGGRRTVYAPYPSLLMCQTWIYENILKSRTVHFCCHAYRHKRSIITNATPHLNKRAILKMDMENFFPSIPINWVIRFFSDLGYSNNVAYYLAAICCVEGSLPQGASTSPALSNILLKHLDNRLYQLSIKYNLSYTRYADDLTFSGEYIPNRLINVISNIVSDCSLSVNERKTSLIIGDKQKIVTGISVQGENLSLPRASRRQIKKEIHYIKQYGLVSHISKLKIKNPYYLHSLEGKLRFWLQIEPENESVLENLNFILELKDI

SEQ ID NO: 2022 - protein, 343 aa, Vibrio sp.
  source 1..343: note = Related to VHSP01000001.1
MKKKQELEIKSWELFFIDRGISEHLIAQYMPYVRNLTQANLPVIFEIEHLSKLMGVELSELQKMIANPRRFYREFSIPKKRGGRRPVSAPYPSLLLCQTWIYENILKAISVHFCCHAYIEKKSIISNATPHLGKTAILKMDMEEFFPSIPINWVINLFSNLGYAHNVSYYLASLCCLNGVLPQGASTSPALSNILLKHLDSRLYKLSKKYKLAYTRYADDLTFSGDYIPHKLIDVISDVITDTGLSVNKQKTSLIIGNKKKIVTGISVQGNNLTLPRSSKRQIKQEIHYIKQYGLISHISKLKIKNPYYIQSLEGKLRFWLQLEPDNEFASESLAFISKLRKV

SEQ ID NO: 2023 - protein, 345 aa, unidentified
  source 1..345: note = Related to NZ_MAJU01000008.1; note = Aliivibrio logei
MNSKKTEQVVNEWKFYFLDRGISDHLIPQYLSYVEKLTNQQLPIIFEVEHLSVLIGIEYGELNKMVHDSSKFYREFEIPKRSGGKRCISAPYPSLLMCQDWIYNNILKSRNLHFCAHAYRTKKSIVTNAKKHLGKNALLKMDMQDFFPSIPINWIVNFFSGLGYSDNVAYSLASLCCLNDGLPQGASTSPALSNILLVSLDSRLYKLSKSYNISYTRYADDMAFSGDYVPHKIIEVITDIIYDFGFKVNEKKTKLIIGDKQKIVTGISVQGEFLTLPRKTRRLIKQEIHYINTFGLVSHIGKMKIRKPNYLLSLEGKLLFWRQIEPNNEYVLNNLEKISSIKWGL

SEQ ID NO: 2024 - protein, 343 aa, unidentified
  source 1..343: note = Related to NZ_CP010423.1; note = Pragia fontium
MPDYQIQKWKTFFHDRGISDYLIVQYLPYIETLVSNKVPVIFEIEHLSRLIGVDITQLRKMINSPQHFYREFSIPKRRGGHRKILAPYPSLLMCQTWIYENILKSIPIHSSAHGYVKERSILSNATIHLKQNALLKVDLKDFFPSISINWVINLFSSLGYSNNVSYYLAAICCCDECLPQGAATSPYLSNILLVNLDYRLHKLSSKYHLNYTRYADDLVFSGKYIPHNLINIISSIIADFGLNVNQAKTSLIIGNKQKIITGLSVQKNELQLPRSKKRQIKQEIYYIKKYGLISHISKLKINKLNYHQSIEGKLRFWLQVEPNNKFALESLNYIHSLQNILIN

SEQ ID NO: 2025 - protein, 332 aa, unidentified
  source 1..332: note = Related to NZ_PNCO02000001.1; note = Pseudoalteromonas galatheae
MKKISLRMQEWELFFKNKGVSTDLINIYLPYIEYLESQNLPVVFEAEHLSNLLGIKPVILYKMVSSPSSFYRSFDISKKKGGKRRISSPYPSLLICQKWIYENILMGLKTHYCAHGYIKSKSIVSNAKAHLNERVVLKMDLQDFFDTITINWVINLFSKLGYANNVSYILASLCCFNGALPQGAATSPALSNILLVHLDMRIYRLAKKYSLTYTRYADDLTFSGNYIPHTFIEIVNEIIVDFGLNVNKQKTKLIIGNKQKIVTGISVKNSRLQLPRKTRRTLKQELFYIKKYGLISHISKLKIKKPNYLDSLQGKFAFWTYVEPHNEFARHV

SEQ ID NO: 2026 - protein, 342 aa, Vibrio sp.
  source 1..342: note = Related to LJTE01000008.1; note = Vibrio alginolyticus
MNSIHKNQIASWNRFFDDRGISSHLTQQYIDYISNLICADLPIIFELEHLSKLTGINIDTLCKIIGDSSHFYRDFSIAKRRGGKRLISAPYPSLMTCQTWIYENILKKSPSHFCSHGYSPNKSIITNARPHLGNKAILKIDIRDFFPSISINWVIKYFSDLGYSNNVAYYLASICCLNKALPQGAPTSPALSNILLRGLDRRLYKLSKCYNLTYTRYADDLTFSGEHLPYKVISIISQIVSDYGLSVNEKKTSLIIGDKQKIVTGLSVRGDTLQLPRSSRREIKKEIYYIRKFGLLSHISKLKIRKTNYLDSLEGKLRFWLQIEPGNKFVQESLILILSIKN

SEQ ID NO: 2027 - protein, 342 aa, Vibrio parahaemolyticus
  source 1..342: note = Related to AAXXVD010000006.1
MKNTHKNKIAGWTKFFDDRGVSSHLSEQYIGYISNLICSDLPVIFELEHLSKLTGINIDTLCKIIGNSNHFYREFSINKRRGGTRLISSPYPSLMTCQTWIYENILKKSPIHHCSHGYSPDKSIITNAHPHLGKKAILKLDIKDFFPSIPINWVIKYFSDIGYSNNVAYYLASICCLDEALPQGAPTSPMLSNILLRSLDRRLYKLSKTYNLTYTRYADDLTFSGNHIPHKITSVIEQIVLDYGLLVNEKKTCLIIGDKQKIITGLSVRGDRLKLPRASRREIKKEIYYIRKYGLLSHISKLKIRKTNYLASLEGKLRFWLQVEPENNFAQESLTLILSIKS

SEQ ID NO: 2028 - protein, 346 aa, unidentified
  source 1..346: note = Related to NZ_LXEP01000041.1; note = Buttiauxella gaviniae
MTKSAEEIKKEINDWKKFFIDHGLETNLISDYLSYISSLIENNAPVIFEIKHLSQLIGINTSELLKMIYSPSDFYREFEIAKRSGGKRKISTPYPSLKKCQRWIYENILKKQSVSSHAHGYVQSKSIITNATIHAGKNNLLKMDIKDFFPSISINWVIVFFKKLGYAHDISFYLASLCCLKNHLPQGAVTSPCLSNILSLSLDNRLGKLSKKYKVTYTRYADDLFFSGDKIPLSLIKSVTNIVTSYGLNVNTEKTHLIRTSKRKIVTGVAVHNEVITLPRTYKKNITNTLYHIKKHGYLSHVSKLKVRNPYYLESLIGKLNFWQQIEPDNKFVEKSISYLKEIKKQ

SEQ ID NO: 2029 - protein, 346 aa, Salmonella sp.
  source 1..346: note = Related to AAMMPP010000001.1; note = Salmonella enterica
MAMTADAIKKEISNWESFFVDHGIEEKFTSDYMSYISPLIANNVPVIFEIKHLSQLIGINAPELLKMIYSPSNFYREFEIAKRTGGKRKISTPYPSLKKCQSWIYENILKNRTISPYAHGYVQTRSIITNAKMHVGKNNLLKMDIKNFFPSISINWVIVFFKKLGYAHDISFYLASLCCLNNRLPQGAVTSPCLSNILTLSLDNRLGKLSEKYQVTYTRYADDLFFFGEKIPLSLIKSVTNIVTSYGLNVNIEKTHLIRASKRKIVTGVAVHNDVITLPRAYKKNIANTFYHIKKHGYLSHISKLKVKNPYYLESLIGKLNFWQQIEPDNEFVKNSISYLKKLKKQ

SEQ ID NO: 2030 - protein, 349 aa, unidentified
  source 1..349: note = Related to WQRG01000008.1; note = Leclercia adecarboxylata
MKNEFLISPLRQNLDDWKDFFNDRGLEESLINDYISYIKPLLRNNVPVIFEIQHLSLLIGVPVIELKKMIFSPNHFYRTFEIPKKSGGSRQITTPYPSLKRCQKWIYNNILKKNRVHQNAHGYVLSKSILSNAATHVNQKNIIKIDIKDFFPSLKINWVVNYFKRLGYSHDISFYLSSLCCLNNSLPQGAVTSPYLSNILTLSLDRKLSKYAENHGLNYSRYADDIFLSGNFVPLDCFSEVKKIIKGYGFNINNGKSRFLNENKRKIVTGIAVHNEFMTLPRTKKKELMNVFYHIKKYGYISHVAKMKIKNPYYIDSLIGRFGFWKQIEPNNTLVIHCLAYLKNIKSNI

SEQ ID NO: 2031 - protein, 344 aa, Acinetobacter sp.
  source 1..344: note = Related to JAKUKP010000004.1; note = Acinetobacter pittii
MSHEIEQVKTPKQWRLYFDDIGLKEEYIELYIDIVERLYKNKNPIIFEIEHFSKLVGVEVQTLFSMIFSEENFYRQFAIKKKLGGERIITIPSPSLMLVQRWIYKYILKTKKVHYAAHGFNFNKSIITNAKMHVGHKVFLKIDLKDFFPSIPISWIVNYFNQQGYPPKISYYLASFCTFNECLPQGAPTSPILSNILFYQLDKKLYKYSKKNNLTYTRYADDLIFSGDYIPLKFRNFVIYLIKQYGFKVNPKKTSLKVNAGQNIVTGILIKDDIFVPKKYKRKIRQEMFYINKYDLLSHISNANIKDPNYIYSLQGRINFVISVEPENEEFIRYKNEIDRIIKG

SEQ ID NO: 2032 - protein, 345 aa, Acinetobacter sp.
  source 1..345: note = Related to JACXZP010000005.1; note = Acinetobacter towneri
MSYTIESVKTPKEWLIYFEDMGIKEEYISIYIEIIEKLYKNKNPIIFEIEHFSKLVGVEVDVLLSMIFSKKNFYRQFKIKKKLGGDRLITVPSPSLMMVQKWIYNNILIDKKIHYSAHGFNFNKSIITNAKMHVGHKVFLKIDLKDFFPSIPINWIINYFKQQGYPPKIAFYLASLCTLDNSLPQGAPTSPILSNILFYNLDKTLYKFSKKNNLTYTRYADDLVFSGDYISLKFRNFVIFLIKKYGFKVNSKKTSLKINAGQNIVTGILVKDSVFVPKKYKRKLRQEMFFINKFGILSHIATSNIRDPNYLYSLMGRINFVLSVEPNNEEFIEYQNKIKAIIKKG

SEQ ID NO: 2033 - protein, 346 aa, Acinetobacter sp.
  source 1..346: note = Related to NZ_CP031716.1; note = Acinetobacter wuhouensis
MLYSIEPVKSPQEWRTYFDNIGLKEEYIEIYLQIIEELYRKKNPIIFEIEHFSKLVGVEVTVLLSMIFSKEKFYRQFKIPKKKGGERTITVPSPSLMLVQKWIYNYILINKKIHYSAHGFNFNRSIITNAKMHVGNKAFLKIDLKDFFPSIPIGWIVNYFKQQGYPPKISFYLASLCTLKDSLPQGAPTSPILSNIIFYNLDKVLYKFSKKNALTYTRYADDLVFSGKYISLKFRNFVIFLIRKYGFQINSKKTSLKVNAGQNIITGILVKDTIFVPKKYKRKLRQEMFYIKKFGLLSHIATTNIRDPNYVYSLMGRLNFVLTVEPENEEFIEYQNYIKRILKKAD

SEQ ID NO: 2034 - protein, 339 aa, Acinetobacter sp.
  source 1..339: note = Related to CP077835.1; note = Acinetobacter baumannii
MDKKEIKKWTNYFLDVGLKDEYIIEYQDLITNLIKNDVPVIFEIDHLSKLVGINVSTLYAMIFSTEKFYRTFEIPKKNGGMRTITTPHKSLKLVQKWIHHNILKYKYVHKSAHGFVKNRSIITNALIHKESKVFLQLDIKNFFPSIPLNWIINYFYKLGYSKKISFYLAKLCCYENSLCQGAPTSPILSNLVFFALDKKLNHYADKNNIIYTRYADDIVFSGDNIPLSFKNFCIFLIKDFGFKINSKKTKLKIEVGQNIIAGIQIKDSDIWVPKKYKKKLTQELYYIQKYGLISHISKRRIKDPNYVYSLLGKVNFILSVEPGNTKFLEYKNLLNSIIK

SEQ ID NO: 2035 - protein, 339 aa, Acinetobacter sp.
  source 1..339: note = Related to NZ_VPDZ01000001.1
MTKHIAKNWTKYFEDIGLKDEYIEEYSEVIKKLVGNNVPVIFEIEHLSKLVGINVSTLYSMIFSTEKFYRSFDILQKNGENRRITTPFKSLKKVQKWIYQSILKQGYIHKSAHGFVEKKSIITNASVHKSSKVFLQLDIRKFFPSIPLSWVINYFHKLGYSKKLSFYLAKLCCYKESLAQGAPTSPALSNLIFFGLDKKLNNYAIKNNILYTRYADDMVFSGTEISLNFKNFCIFLIKKYGFKVNSEKTRLKINVNQNIITGVQIKNNNIFAPKKYKRELIQDLYYIKKFGLISHVSKKRIKDPNYVYSLLGKINFVLSIEPENLEFINYKNILKNIIE

SEQ ID NO: 2036 - protein, 338 aa, Acinetobacter sp.
  source 1..338: note = Related to CP035936.1; note = Acinetobacter cumulans
MSNKAKEWVAYFNDVGLQEAYINEYGLVVEKLLKNKVPVIFEIEHLSKLVGINVKTLYSMIFSPEKFYREFEIPKKKGGTRKINAPFKSLKKVQQWIYINILKVKNKNAYAHGFLDGKSIITNAREHINSSVFLHLDIKDFFSSIPIGWIVNFFYSLGYSKKISFYLSRLCCFKDCLVQGSSCSPALSNILLVNLDRKLNKYALKNNLKYSRYADDLVFSGNYISLSFRNFCSFLIKNYGFKINTKKTRLKVNASQNIITGIQIKGNILSVPKQYKRKLKQEIYYIEKYGFISHVNKKKIKNPDYLASLIGRVNFVLNVEPNNLEFTEYKKILSNLIQ

SEQ ID NO: 2037 - protein, 340 aa, Acinetobacter sp.
  source 1..340: note = Related to NZ_CP032134.1; note = Acinetobacter chinensis
MQLSQWETYFQDIGISEQYIDEYLEIISKLSKKKLPIIFEIEQFSKLVGIELNILYKMIFSPESFYHEFYIKKKKGGRRKIVVPFPSLLLIQRWIYKNILLKCTCHSNIHGFIQKKSIITNAKAHIGGRDFLKLDLQNFFPSISLNWVVRYFNELGYPKKISFYLARLCCYEEGLGQGAPTSPFLSNLLLFSLDKRLNNLAKKNESTYTRYADDIVFSGEKITKGFYSLVESIVGDFGLTLNESKTQLRKNKTQNIITGIVVVNDGIKIPKTYKKKIRQEIYYINKYGLMSHLSKIRNKNPTYLLSLLGKINYVLSVENDNQEFKDYQKKMENFIKNPLN

SEQ ID NO: 2038 - protein, 337 aa, unidentified
  source 1..337: note = Related to NZ_PIPJ01000004.1; note = Aliidiomarina iranensis
MKLKSPKEWEGYIKSRGLEPELEKTLSAYASNLSSKNLPVIFELEHLSNILDIEHDEMRVMVNGSDWFYREFEIPKRRGGVRVIKVPYSSLMHAQYWLKEAILDKEFIHSKAHGFANGKSIKSHVECHCHSLHILKLDIKDFFPTFKKSWVANYFNQLGYAPNVAFYLANLTTDTVSLVQGAPTSPVLSNILFRKADRALNKIAVKYELSYSRYADDMCFSGNYIPKKLLRLVERILRYFGFQLNSRKTYLGPVNGCHITGIKVVDGQLKVSRKLKRELRKQIHFIGKYGLLSHVNKKRIRDVFFVERLMGQLNFWKFIEPEHEFPIEALSLLRQKL

SEQ ID NO: 2039 - protein, 364 aa, unidentified
  source 1..364: note = Related to NZ_JAKZGR010000005.1; note = Belliella kenyensis
MRAANRKLFDHLLFLLTNMSKQKEINKWKTFFKNRGLSEEISDKYINYITKLLENRTPIIFEFNHLALLLGRQPFYLASVVNAPNNHYRSFKLKKRSGGFREITTPFPALLEMQYWIFNNILKNVSINPCAHGFAHKKSIITNATLHAGQNELLKLDLKDFFPSININRIIYVFKSLGYPNEIAFYLASICSYEESLPQGAPTSPVLSNIIAKQLDKRLINLAKKYNLKFTRYADDLTFSGKNIPAKFIEYIKVIIEEEGFDLNEAKTRLYKSNRKRIVTGISVLEKEIKIPREYKRNLRQELHFIFKYSFESHIKKKKIRKSNYLESLIGKVNFWLSVEPKNGFALDAKKRLFEIYKNYYPQQ

SEQ ID NO: 2040 - protein, 344 aa, unidentified
  source 1..344: note = Related to HF992628.1; note = Prevotella sp.
MTSDAIIEKWNNFFTRKGINQTLHDKYIEYIKILVKNNVPIIFDFNHLRLLMGRSDLYFTSVINSPENHYRSFKLKKRNGGFREILAPYPALLEMQYWIYNNILKKIPISPYSHGFAHKKSIITNAKIHLGQKELLKLDLKDFFPSIKINRIIYVFKSLGYTNQVAFYLASLCSYNETLPQGAPTSPYLSNIIAKKLDKRLIRLSKKYKLHYTRYADDLTFSGDSIPAKLIEYINNIVNSEGFTLNSEKTRLYKHGGKRIVTGISVNGKELKLPKDYKRNLRQELYFIMKYGYESHIKKKKIRKVNYLNILLGKVNFWLSVEPSNKFALDAHSFLLETYKKHNK

SEQ ID NO: 2041 - protein, 339 aa, unidentified
  source 1..339: note = Related to NZ_JAAKEL010000031.1; note = Dysgonomonas sp.
MAKDLIKEWYDFFTVKGIEPQLRDIYIDYISLLSENNVPIIFEFNHLALLLGRKQHYLASVVNSPENHYREFKLPKRKGGYREISAPYPALMEMQYWIYQNILKSIRIHSSAHGFINSKSIITNAKIHTGQTELLKLDLKDFFPSISLNRIISVFKNVGYPNQIAFYLAKICTYEECLPQGAPTSPCLSNIIAKNLDKRLMKLAKSLNLRYTRYADDLTFSGNKIPAKVIEYISTIIVDEGFVINQDKTRLYKNKGQRIVTGISVLEKELKLPREYKRVLRQELFFIEKYGLKSHLAKKKQRKANYIFSLIGKLNFWLSIEPENQFALKNIEKLKLILN

SEQ ID NO: 2042 - protein, 340 aa, unidentified
  source 1..340: note = Candidatus Cloacimonetes bacterium; note = Related to JAIPGO010000099.1
MKDDQYSQWKKYYESRGILPEIQDKLLNYAKIHIDNNTPVIFNFEHLTLLLGREKNYLSSVVNSPDSHYRKFKIKKRSGGEREITAPYLSLLEMQYWIYRNILINVKIHYAAHGFAQDKSIITNSRNHLGQKHLLKMDLKDFFPSIKLNRIIYIFKSLGYPNIIAFYLASICSYKGHLPQGSPTSPILSNIVSITLDNRLVKFARKMKLRYSRYADDLTFSGDKIPTNYIKYITDIINDEGFEVNDTKTKLYLKAGKRIVTGISVIGNDPKLPREYKRKLKQELHYIFTYGIGSHMAKKKIKKINYLYRIIGKVNFWLNIEPDNEYARNAKAKLLLLIDN

SEQ ID NO: 2043 - protein, 339 aa, unidentified
  source 1..339: note = Related to NC_015496.1; note = Dokdonia sp.
MSNKETFNKWQSYLESRRVQEDVKEQYLSYIRILLDKNVPIIFTFDHLSLLLGRSKNYLASVVNSPDNHYREFKIKKRSGGFRKITTPFPALLEMQYWIYNNILKKIPIHSSAHGFTHKKSIITNSKIHAGENHLLKIDLKDFFPNIDINRIIFIFKELGYPNIIAFYLAQICCFDGTLPQGAPTSPILSNIVTRRFDKRLIHLAKKFNLKYTRYADDLTFSGSTISAIFISYVNDIVIDEGFVINDSKTRLYQKKSKRIVTGISVIEKEIKIPRNYKRDLKQELHYIFKFGLKSHMSKNKIRKANYLFVILGKVNFWLSVEPKNEYALEAKTKLKELI

SEQ ID NO: 2044 - protein, 350 aa, unidentified
  source 1..350: note = Related to NZ_JPRI01000002.1; note = Chryseobacterium vrystaatense
MTKKEILREWRLYFENRQVRKDIYEKYIVYIGVLLENNVPIIFNFDHLCLLLGRSNEYLSSVINCSSNHFRDFEIKKRSGGHRAITAPYPALMEMQYWIYNNILKAIPINSSAHGFTHKKSIITNSNIHKGQKELLKLDLKNFFPSISINRIIYIFKQLGYPNNIAFYLSSICCYDNFLPQGAPTSPILSNIVSRKLDKRLITLAKKFALKYTRYADDLTFSGDIIPAKFIDYVTAIVCDEGFEVNINKTRLYKSKGKRIVTGISVSGDVIKVPRDYKRKLKLELHFIKKYGLESHIAKKKIRKYNYLFSLVGKVNFWLSVEPKNQEALDYQILLNEYVKKIQQPLDITL

SEQ ID NO: 2045 - protein, 364 aa, unidentified
  source 1..364: note = Saprospiraceae bacterium; note = Related to JAGPCT010000083.1
MLKHKKEVAHHLFLDMTKNQIYESWKCFFIERGLDEKYSRPYLVYIKKMLSNGLPIIFETEHLSLLLGRSASYLNSVAFSPSSHYRQFKLKKRSGGFRTIDVPYPALLECQYWIYRNILSVVPLNYCAHGFVPKKSIITNAKVHLGQNVLLKLDIEDFFPSISKDRVIGVFNFLGYPPKVSYFLASLCCLNECVPQGAPTSPTLSNIISYNLDKRILAFSKNFELKYTRYADDLAISGKNLPTKYIDYLRVIVEDEGFKINVSKTQLFTRQSKRILTGVSIGSGKLKAPKEYKRVLFQELFYIKKFGLNSHISKMKIRNPNYIQSLVGKLNYILSIEKDNFKAINYLNYLKENYNSQIIKIDIY

SEQ ID NO: 2046 - protein, 350 aa, unidentified
  source 1..350: note = Related to NZ_JACVMN010000002.1; note = Flagellimonas sp.
MTNHKIIYNKWEDYFSNRGLEKNLLDSYLVYIDGLLTNNLPIIFESEHLSLLLGRNEVYLNSVVFSTELHYRDFKLRKRKGGFRIISVPYPALLECQKWIHKNILSKVKISPYAHGFAKKKSIVTNARKHTNQEHLLKIDLKDFFPSIKKGRVIAMFCKLGYSTEVSFYLASICCKMDCLPQGAPTSPSISNIIAKSLDNRLFALSQKFEIRYTRYADDLAFSGGNIPARFIDYVTEIVTTESFEINNSKTQLHKSKGKRIITGVAVNGEIVKAPKSYKRKLFQTLYYIEIFGLNSHRTKLKIRNPNYLESLIGKLNYVLTIEPDNSKAKNYLTMLIEIDKSRTHNSVYK

SEQ ID NO: 2047 - protein, 346 aa, unidentified
  source 1..346: note = Related to NZ_CP047897.1; note = Nibribacter sp.
MSKKRILSNWSNFFEQRGIPEDIREIYLRYIKKLLVKDVPIIFDFNHLSKLVGRQQWYLASVVNNTSSHYRTFNLKKRSGGFREISVPYPALLGVQYWVYKNILQKIPINNSSHGFAKNKSIITNSKIHLGQSNLLKMDLKDFFPSIHLARVIKVFKALGYTTKVSYYLASVCCINDCLPQGAPTSPILSNIISFDLDRRLYLFAKKFNLKYSRYADDLTFSGENINVKMIHYISEIIVSEGFIVNDKKTRLHKESAKRIVTGISVAGSELKLPKKYKRDLKQELYYINKYGIHSHVSSVNIKHTNYIDVLIGKLNFWLSVEPGDEFVVEQLKMLYSIKYPESIPK

SEQ ID NO: 2048 - protein, 341 aa, unidentified
  source 1..341: note = Related to PCOU01000016.1; note = Chryseobacterium sp.
MSKKDLFFWNSSFTKAKINDEIKQNYLRYIEVLLNNKVPIIFDFFHLTLLLGRNSKYLSSVVNSNISHYREFEIPKKKGGTRKITAPYPALLDCQRWIYNNILKNIKIHPCAQGFTKKKSIITNAKIHVNQDEFLKIDIKDFFPSITINQVINIFKSFGYTQKVSFYLASICCYDQNLPQGAPTSPILSNLVAITLDKRLFAFAKKFDLKYTRYADDLAFSGKKITSKHLEYIKEIISECGFEANDEKTFLQQKKSKRIITGISISDNTIKVPKQYKRKLKQEVHFIRKFGALNVIRRNKIKNPNYLYSIIGKLNFWMSVEPNNQFAKKAYNDLKQFINYN

SEQ ID NO: 2049 - protein, 339 aa, unidentified
  source 1..339: note = Related to JACHTC010000027.1; note = Myroides sp.
MSNKIIQGWKSFFIKAKISVEAREIYLKYISTLLSNKVPIIFDFYHLTLLLGRNSEYLASVINSNTSHYREFQIPKKLGGFRTILAPYPALMDMQNWIYKNILNDVKIHPCAQGFTNKKSIVTNAKIHINQKEFLKIDLENFFPTITINQVINVFKNLGYTHKVSFYLASICCYNKNLPQGAPTSPILSNIIALTLDKRLFALAQKFNLKYTRYADDLAFSGDEINLKHIDYIKNIINECGFTLNEAKTVLQKNKNKRILTGISIAGETVKVPKNYKRKLKQEVHFIRKFGILNYIRRNKIKNPNYLYSILGKLNFWLSVEPKNEFAKKAYNDLKQQIQ

SEQ ID NO: 2050 - protein, 342 aa, unidentified
  source 1..342: note = Related to NZ_NFHW01000007.1; note = Butyricimonas sp.
MSKLKLYNYWYSNFEKSGIKSEFVEKYMAYVSKLLNNNVPIIFDFNHLCLLLGRNGHYLASVVNSNVSHYRIFQIPKRSGGHRNISAPYPALLECQSWIYENILAKIKIHPAAQGFTTKKSIITNAKIHINQNHFLKIDLKDFFPSITINQVINVFKSIGYTNKVAYYLASICCCENVLPQGAPTSPALSNIVGKTLDKRLYSFARTYDLKYSRYADDLAFSGEQIPSKFIEYISDIIRSCGFSVNDRKTILQQQKNRRRIITGISISDDAIKIPREYKRKLKQEIHCIRKFGISSHIRRQKIKKTDYLLCVIGKVKFWLSVEPENQFATHALNDLLNIAQQ

SEQ ID NO: 2051 - protein, 354 aa, unidentified
  source 1..354: note = Clostridia bacterium; note = Related to JAFWZH010000322.1
MNTREQNIILKNWEQFYNSRGVEPELIKVYMSYVEKLVNQSLPPIFDFRHLSLLLNINEYDLASIVNSPSNYYRTFDIPKRNGGFRTITAPYPSLKNIQKWIYHNILSNIKIHGCAHGFATSRSILTNANVHINQKCLLKIDLKDFFPSIPMSYVLQLFKSLGYAPKVAFYLSSLCCYDECLAQGSPVSPAISNIVAKHLDRRLYRIAKKYNLNYSRYADDIAFSGESINVKFIEYIKEIITDCGFFVNENKIRLYKEYGNKILTGISLATGVPRLPRDYRRSLEKELFFIYKYGIKGHISHNKIRKSNYLESIIGKVRYWLMIEPNNTFAQQMYEKLYAEYKLQLNTSDIEVL

SEQ ID NO: 2052 - protein, 348 aa, unidentified
  source 1..348: note = Related to CP042465.1; note = Prevotella copri
MTDLQLQKMMELWKAYYRSRGIAPEFANQCLAYARSLLKQDMPVIFDLPHLCLLLGLDVSYLHSIVYGADKHYRNFFIRKKSGGVRELSAPHYTLKYVQTWIYENILSKVKVNYCAHGFCPKKSIVTNARVHVSNKYLLKLDLKDFFPSITQNQVINVFRSLGYSNHVAFYLGSICCVDGHLPQGAPTSPALSNIIAHHLDNRLLGVAKKMGYKYTRYADDLAFSGDLIKPVFVQYVVRIISECHFIVNASKVKLYKGNGAKILTGVSLANGQIRVPREYRRKLEQELYYISNYGLGEHIRRRRIKNPHYLESVIGKTEFWLMLEPENEFAKQSLEYLRALYNQKYNQ

SEQ ID NO: 2053 - protein, 347 aa, unidentified
  source 1..347: note = Related to WTAE01000072.1; note = Sulfurovum sp.
MIKKYPHEWKKYFDSRCIPQNVQDEYLSYIKNLHDQDIPIIFEIEHLALLLGMEISVLNRMIFGTKSFYRTFEIPKKSKDSVRIIDAPYPSLLSVQQWILKNILKNIHIDDSAHAYMKKKSILTNVTPHLNNKVLLKIDLKNFFPNIEKNRIIAVFLKLGYTQNISFALASLCTLNNHLPQGAPTSPTLSNIIAYRLDRRLSSLCKKSDMVYTRYADDMVITSKYISLKTKDLIITIIEDCGFIVNKDKTYLSTNQNKRIITGISIQDGTTKIPRKLKREIKQEMYYLNKYGFYSHINKRKITNPFYLERIRGQILFWNFIESDSTLAKEMLSDINRIIEIVENLSQ

SEQ ID NO: 2054 - protein, 343 aa, unidentified
  source 1..343: note = Related to NZ_CABVRY010000015.1; note = Aliarcobacter butzleri
MNNTKIISIKEWKSFFKSRGIEQSLINEYISNIEKLKDKNLPIIFEIEHLSYLVNINIEILNKMIFSNKSFYQEFKIPKRNKGEFREIHAPYPSLKCVQDWIYNNILQYAKIHYNAHGYVKNKSIKTNAKKHLNKKELFKIDLKDFFPTIKIPRIIEQFKRLGYSKNMSLCLATLCCQNDYLTQGSPTSPALSNLVAYKLDKRLTALAKRNNLVYTRYVDDIAISGDDIHHFLQKLICEIIEEEGFIVNYEKTYLNKENSNKRLLTGIIIKDDKLTIPRETKRKLKQEIYYISKFGIKSHLISINNKNPYYYESLLGKLQYWKFIEPTSKDVDKLIKILNDSI

SEQ ID NO: 2055 - protein, 351 aa, unidentified
  source 1..351: note = Lentisphaerae bacterium; note = Related to JABMQT010000738.1
MDEQIDSTADRWVEHLGGTIKSRPFREACTAYASRLVENGFPVVFNLQHLAKVTGLKTRVVGSQVFRTERYYRKFSIPKRTGGLRTIHTPYPSLLLCQRWINYRVLTGIRVHKHAHGFVSGRSVLSNALPHLQKRWMLKMDIKDFFPSISIRRIVPIFRRCGYSRDVSYFLSRQCCLEDVLPQGAATSPTLSNIVLKRTDSRLTALAESFAATYTRYADDLTFSGDYLPARIIDIVSRIVTDEGFRVNTAKTRLVGPKGRKIVTGVSVSGASPRLPRQTKRVLRQELFHLHTKGYAKHTAVRQILDPLYAERLLGKLSFWLQIEPDSPFARQALDWMAEVRGTLQVLGRHT

SEQ ID NO: 2056 - protein, 342 aa, unidentified
  source 1..342: note = Related to NVRR01000003.1; note = Sneathiella sp.
MEKDEIQLWNKNISEAVSSKRWVKAYSKYIDVLSENSVPVIFEIDHLAEILGLRSDLLVRAVNSVERFYRPFEIPKSSGGTRKINAPYPVLLDIQRWIGAHILSQVRISEQAHGFVKNRSIIRNAREHLGKECMLKMDISDFFPAISLKRVITIFLFLGYSPSVSYYLSVLCCLENQLPQGGAASPQICNIIATPLDRRLMSLALAYSLNYTRYADDLTFSGRYIPIKFIKIVESIASDEGFEINNKKTKLMRAKGRRIVTGISIGTGELKLPKSTKRSLRQEVYWLERNGIFAESGRDGIFDPLYVDRLLGKLNFWRSIEPENTYVIEKIDRLKELIISES

SEQ ID NO: 2057 - protein, 350 aa, unidentified
  source 1..350: note = Related to JAGQOP010000117.1; note = Phycisphaerales bacterium
MSAKNRLGSSAWRKHFDSIGCPSDLKSTYLAYIDRMTGRGFPPILDFGHLASLLGRTPAYLASAINGTKCHYRQFVIPKRRGGARTISAPYPALLECQQWINREILEHIDVHSAAHGFRRKRSIATNASQHLNKACLLKMDIKDFFPSIKLRRVIAVFRDLGYPKNISVYLGRLCSLDGQLPQGAATSPAMSNIIAKQLDCRLLGVAKKWRLRYTRYADDLCFSGPHISIQFPKLVSRICEEEGLQINASKTQLCRSKGRRIVTGLSVSGERLRVPRAFKREVRQEMHYIKVHGYWSHVSKRKIRNPFYLQSLYGKLMFWRWIEPDNSFVNSAFDVLRNLVHENGEFEKD

SEQ ID NO: 2058 - protein, 347 aa, unidentified
  source 1..347: note = Related to NZ_CADEUM010000003.1; note = Burkholderia cenocepacia
MIEKNINIEPWANLIARRVRRPSIRTAALKYIERLIAVGVPPIFDFEHLSELVGVHRAILAGFVESAGSFYRTFKIPKQSGGFREISSPVPSLLMVQRWIKENILDEIPVHDAAHGFVKGKSVVTFAQPHVNKAALLHIDVSDFFPSIDLKRVYVLFRNIGYAPNVSLFLARLCCVNGRLPQGAPTSPSISNIIFSSIDARLIGLGCVAKLDYTRYADNIVFSGNYINIKFLDIVSEILSENSFKVNRKKTFLSTKKGKRIIAGISVSGERISLPRDTRRNLRQQVHGLLKFGFFEHTAHIGDLDPIYAERVLGRLLFWKYVEPNNSYVASSIQALRGMQMDLDSQV

SEQ ID NO: 2059 - protein, 377 aa, unidentified
  source 1..377: note = Related to NZ_FQXY01000011.1; note = Bacteroides sp.
MDGILITILIITGFLIYKMISSSRKQEGYKRWKATASGGKEESASKSESGHGAWLRRALGVTAPQSPYVPKFDDESVVWCASLLGVEANKLKEILENIPTHYHEFWVRKRRGGYRMISAPLKELQSIQTTINSRILSSVTTIHPAAVGFRCGRSVVDNASPHLGKRYVLKMDIHDFFFSIRSPRVKATFEKMGYPANVAKVFRTLCCLHNSLPQGAPTSPALSNIVGYEMDKKLAALAAEYGLTYTRYADDLTFSGDVFPKEQIIPRIKQIIRDEKFEPNHKKTRFLHEYDRKIITGVSVSSGVKLTIPKTRKREIRKNVYFILTKGLVEHQRRIGSNDPAYLKRLIGELCYWRSIEPDNTYVSDSIIALKRLEKHY

SEQ ID NO: 2060 - protein, 376 aa, unidentified
  source 1..376: note = Related to VWAM01000011.1; note = Bacteroides finegoldii
MDGILITIIVITAFLVYKMISSSRKQEGYKRWKATSSGKEEKTTKVKWEHGAWLRHALGETVPRVQYVQRFDESAVVWCANLLGVETAQLKEILRDVSEHYREFWMRKRKGGYRMISAPDKELQSIQTTINSRILSSVTMIHPAAVGFRSGHSVVDNASPHLGKRCVLKMDIHDFFFSIRSRRVKKTFEKIGYPENVSKVLGVLCCLYRHLPQGAPTSPALSNIVGYEMDKKLAALAVEYGLTYTRYADDLTFSGDVFPKEQIIPRIKQIIRDEKFEPNHKKTSFINEYGRKIITGVSVSSGAKLTIPKARKREIRKNVYFILTKGLAEHQRRIGSSDPVYLKRLIGELCYWRSIEPDNAYVSDSINRLKCLEKGY

SEQ ID NO: 2061 - protein, 376 aa, unidentified
  source 1..376: note = Related to VVYG01000002.1; note = Bacteroides caccae
MNKILITILIITGFLIYKMISSSRRQEGYKRWKATGGGKEEKVDKTKWERGSWLSHAMGVTTPVAPYTPRFEKEAVIWCAALLGVEVNRLEEILNNVSGHYQEFWMRKRSGGYRMISAPDKDLQAIQSTIYSRILSSVTIVHPVAVGFRCGRSVVDNAAPHLGKRYALKMDIHDFFGSIRSPRVRQTFKKIGYPENVSKVLGALCCLHRHLPQGAPTSPALSNIVGYEMDRKLAALAAEYGLTYTRYADDLTFSGDVFPKEQIIPQVKRIIRDEKFEPNHKKTHFMNQSSRKIITGVSVASGVKLTIPKSKKREIRKNVYFILTKGLAEHQRRIGSHDPAYLKRLIGMLCYWRAIEPDNTYASDSIAALKRLEKGY

SEQ ID NO: 2062 - protein, 377 aa, unidentified
  source 1..377: note = Related to CP081916.1; note = Bacteroides faecis
MDGLLITILIVTGFLVYKMISSSRKQEGYKRWKATGSGDTANEETAGNKWKHGAWLRHALGVTTPKARTYPVFDEEAVVWCAGLLGVEAVRLKEILQDVSSHYREFWIRKRKGGYRMISAPDKELKSIQDTIYHRILLPVNVHPVATGFRRQHSIVDNVRPHLGKRCVLKTDIHDFFLSIRSPRVKQTFENIGYPKNISKVLGELCCRRRHLPQGASTSPALSNIIAYEMDRKLAAMAEEFGLAYTRYADDLTFSGDVFPKEQVLVRVKEIIREEKFEPNHEKTRFLNEYDRKIITGISVSSGVKLTIPKARKREIRKNVYFILTKGLAEHQRRIGSHDPAYLKRLIGTLCYWRSIEPDNTYVSDSIAALKRLQKGD

SEQ ID NO: 2063 - protein, 394 aa, unidentified
  source 1..394: note = Related to FQZN01000002.1; note = Bacteroides stercorirosoris
MNTTIYISKYSSSSFFIPIDTMNGILIAVFIVTCLLVYKIISSSRKQEGYKRWKAGNRDNTEHTANAGTTRKGWFSQLFETSAPRISPWFKEEAISQCANLLGVEEVKLKEILKDVSAHYREFWIGKRRGGYRMISAPDDELKPIQGAINHRILSFVNVHPAATGFRCKMSIADNVRPHLGKQCVLKTDIHDFFSSIRSPRVRNTFEAMGYPPDIAKVLGTLCCLHRCLPQGASTSPALSNIISYEMDKKLSALAAKYGLTYTRYADDLTFSGNVFPGEQILSQVKQIVREEKFELNHKKTRFLKEHSRKIITGVSISSGVKLTIPKARKREIRKNVHYILTKGLAEHQRRIGSHDPAYLKRLIGTLCYWRSIEPDNAYVSDSITALKSLEKKY

SEQ ID NO: 2064 - protein, 373 aa, unidentified
  source 1..373: note = Related to CP072251.1; note = Bacteroides cellulosilyticus
MNGILIAVLIVTGLLIYKIISSSRKQEGYKRWKAGNRSNTEDTTDTETTRKGWFSRYFGTSALITIPWFDEEAVVKCANLLGVEEAVLKEILKDIPGHYREFWIGKRKGGYRMISAPDKDLKAIQDTINHRVLSFVNLHPAATGFRCKMSISDNVRPHLGKPYVLKTDIHDFFGSIRGLRVRKMFENMGYPPKIARVLAALCCVRRCLPQGASTSPALSNIISYEMDKKLAALATEYNLVYTRYADDLTFSGDVFPAQQILPLIKQIIREEKFEINHKKTRFLSGHKRKIITGVSISSGVKLTIPKAKKREIRKNVHFILTKGLAEHQRRIGSHDPAYLKRLIGILCYWRSIEPDNAYVSDSIAALKGLEKEY

SEQ ID NO: 2065 - protein, 371 aa, unidentified
  source 1..371: note = Related to SZUU01000003.1; note = Bacteroides fragilis
MELLFCIVTVITALLVFIIIRSSKSQEGYKRWKAGNYVSDTPYAKEKKTSALFPRSLFGKDANFFGAKRFKAEAVSWCANLLAVEEDALREVLDYVPRQYKLFYIRKRSGGFRAITAPEDKLRVMQQTIYQRILLLAHVHPAVTGFCPGKSVADNAQAHLGRKNVLKVDIHDFFPSIRSPKVRAAFREMGYSGPIAKVLGELCCCYKCLPQGAPTSPALSNIIAYPMDKKMMALADEYGLVYTRYADDLTFSGDYLPKDEVLARIHGIVREEGFTINAKKTRFLSEYKRKIITGVSVSSGEKMTIPKVKKREIRKNVHYVLTKGLVGHQEHIGSTDPVYLKRLLGNLCYWRSIEPDNRYVSDSITALKRLM

SEQ ID NO: 2066 - protein, 371 aa, unidentified
  source 1..371: note = Related to CP037440.1; note = Bacteroides fragilis
MELLLAIVIVVTGWLVFSIIRSSKGQEGYKRWKAGNYAGENPYAKEKKESVSSLKNIFGRKAVAFGSKRFDAGAVSWCASLLGVKEDTLREVLDYVPRQYTQFYIKKRSGGVRIITAPQGQLRVMQQTIYQRVLLLANVHPAVTGFCPGKSVSDNARVHLGRKNVLKVDLHDFFPSIRSPKVRATFREMGYSRPIAKVLAELCCCNRCLPQGAPTSPALSNIIAYPMDKKMMALADEYGLVYTRYADDLTFSGDFLPKDKVLSRIDQVIREEGFTMNVKKTRFLPEHKRKIITGVSVSSGTKMTIPKTKKREIRKNVHYVLTKGLASHQEHIGSTDPVYLKRLLGNLCYWRSIEPDNRYVSDSIAALKSLM

SEQ ID NO: 2067 - protein, 370 aa, unidentified
  source 1..370: note = Related to CP036550.1; note = Bacteroides fragilis
MELLLGIVIVVTCWMVVRIIRSSKNQEGYKRWRAGNYASENPYAKEKASGPLSQGFFSKRIRTSGARRFDDGAIRWCANLLATEESRLREVLDYIPRQYTCFHVRKRSGGFRYISAPAGDFRSMQQTIYHRILLLANIHPAVTGFCPGKSVSDNARVHLGRKNVLKVDLHDFFPSIRSPRVRAAFREMGYSRPIAKVLAELCCLRCCLPQGAPTSPALSNIIAYPMDKKMMALAGEYGLVYTRYADDLTFSGDYLPKDEVLVRIHRIIREEGFTMNVKKTRFLSEHKRKIITGVSVSSGKKMTLPKVKKREIRKNVHYVLTKGLVGHQEHIGSTDPVYLKRLLGSLCYWRSIEPDNRYVSDSITALKRLM

SEQ ID NO: 2068 - protein, 359 aa, unidentified
  source 1..359: note = Related to RQYS01000018.1; note = Tannerella forsythia
MTVILVTILIFICGMILLIIREKKKEKDLLNRHLPNDNSFRNGSVFYHTGICRQAVYDPEALKWCATFLNIGEKELSSFLHHPSEWYSLFWLAKRGGGYRMIAAPKKELKAVHRTIYEKILINSEIHPSATGFRRNKSIVENVRPHLGNAQVLKVDIHDFFGSIRKHTVRRTFKQLGYESGVAKILAALCCKSGRLPQGAPTSPALSNIIVAGMDEQLAAISRSVGLTYTRYADDLTFSGNLSSHHAFLAQVEKVVAEHKFALNRKKTRFLDMSHRKIITGISVSSGTKLTIPKVFRREIRKQVYHVLTKGLAEHQKYIGSSDPAYLKRLIGRLSYWHAVEPDNTYVIRSLKALKELNH

SEQ ID NO: 2069 - protein, 388 aa, unidentified
  source 1..388: note = Related to JAEPKU010000005.1; note = Dysgonomonas sp.
MNINIVILIIVLGLWLLYKLFSSGRKDDYNRNTSSYNRNADNYDKGEEKKKNHRKFIFSFLQREKNKTEVKAKRQGFLTRIFSTPLPFDDAAITWCANFLIVEKKTLIEILKDTSDHYTHFKLGKRSGGYRTISAPNKTLLNIQRVIYKRILLSVNLNPASMGFRQNISVAHNAKAHLGNKQILKVDIVDFFGSIKKQRIIETFGKIGYPSNISEVLAELCTLEGKLPQGAATSPTLSNIVAHEMDVKLVSIAQKNNLTYTRYADDLTFSGENIFFELIFSEINNIVREGKFIIQRKKTRFLTEKRRKIVTGISVSSGKKLMIPKAKKREIRKNVHYILTKGLAEHQRFIGSTDPSYMKRLMGYLNFWLMVEPDNEYVKKSITALKKI

SEQ ID NO: 2070 - protein, 388 aa, unidentified
  source 1..388: note = Related to NZ_GL891979.1; note = Dysgonomonas gadei
MNTILVILIIALGLWLLYKLFNSGGKDDYNRNTSGYNRNADNYDRGETKKENNKKSIFSFLHKKKSNTEKKAKRQSIFARIFSEPLPFDDGAITWCANFLIIDKNTLIGILKDTSDHYSHFKLGKRSGGYRTISAPDATLLNVQKIIYKRILLSVNVHPASMGFRQNISVTHNAKTHLGNKQILKADITDFFGSIKKHRIIKAFRRIGYPANISQVLAELCTLENKLPQGAVTSPTLSNIIAYDMDMKLASVAEKSNLTYTRYADDLTFSGENISFELTLSEIDRIIREEKFVLQRKKTRFLTEKKRKIVTGISVSSGEKLMIPKAKKREVRKNVHYILTKGLAEHQRFISSTDPSYMKRLMGYLNFWLMVEPDNEYVKKSIAALKKV

SEQ ID NO: 2071 - protein, 360 aa, unidentified
  source 1..360: note = Related to SELI01000017.1; note = Apibacter muscae
MNIILVVFFIVLMLWLLFRLLNFDGNNVDVEKKENGSVLKAKKQSFLARIFSKPLPYDDEAITWCANFLIIDKNTLISILRNTSAYYSHFKLAKRSGGYRTISAPNEAMLNIQRIIYKRTLLTVNIHPASMGFRKNFSVTHNAKAHLGNNHILKVDLFDFFGSIKKDRVIKTFEKIGYPVNISQVLAELCTLGGKLPQGAPTSPTLSNIIAFNMDIELASIAQKNSLRYTRYADDLTFSGTDIAFEPLLTDIDVIIRKENFIIQRKKTRFLTEKKRKIVTGVSISSGQKMTIPRAKRREIRKNMHYILTKGLVEHQRFRGSTDPVYLQRLMGYLNFWLMVEPENEYVKRSIAALKKLKIT

SEQ ID NO: 2072 - protein, 381 aa, unidentified
  source 1..381: note = Related to NZ_OEPV01000016.1; note = Dysgonomonas sp.
MNTTLIILLICLGLWLLYKVLNYRGGDVDNYNRNIDSYDKGEKNKSKSRIFSSRKSDSDFSSNPAKKQGFFARLFSVQLPFDDEAITWCANFLIIEKDVLIGILRNTSQHYSHFRISKRSGGVRIISAPSPALMSLQKTIYKRILVSVNIHPAATGFRSNTSIVQNAKAHLGKSQILKVDITNFFGSIKKRKVIKVFENIGYPPNISQVLAELCTLDNKLPQGAPTSPVLSNIIASDVDVKLAALSQKKELSYTRYADDLTFSGSNIDFETTLAEIDEILFKERFIIQRKKTRHITEKRRKIVTGISISSGEKMTIPKSTKRELRKNVYFIQTKGLAEHQRFIGSTDPTYLKRIIGQLSFWHMVEPDNDFVKKSLSALKKL

SEQ ID NO: 2073 - protein, 390 aa, unidentified
  source 1..390: note = Related to NZ_JACIEP010000005.1; note = Dysgonomonas hofstadii
MNIALVILIIFLVLWIFYKLLNYSGGDEYSRDTRNYNRNPDNYDKGEEVKTTPKKSIFSVFSREKKVKQAKRQSFFERIFSAPLPFDDAAITWCANFLAVEKNELIDILKNTSIQYSHFKLGKRSGGCRTISAPNNVLLNIQKTIYKRILLSVSIHSAATGFRQNVSVIHNAKVHLGKTQIIKVDLADFFGSIKKPRIITAFEKIGYPSNISKVLAELCSLDGKLPQGAATSPTLSNIIAYDMDVKLIALARKHNLTYSRYADDLTFSGEDIAFELFLSEIDGIVREEKFVIQRKKTRFLTENKKKIITGVSVSSGEKLTIPKSKKREIRKNVHYILTKGLAGHQKFIGSTDPSYLKRIVGYLNFWLMVEPDSEYVKKSLIALSKLQGKS

SEQ ID NO: 2074 - protein, 387 aa, unidentified
  source 1..387: note = Related to JACMIC010000003.1; note = Dysgonomonas sp.
MNILLGILAIALLYLLYKLFYKKRGDEYSRDTSGYDRGTNSNEKEERPKDQPKKSVFSFFGRKNIEKPQIAKRQGLIARLFLAPLPFDDKAITWCANFLVIEKNILIDILRDTSKYYSRFRLGKRSGGFREISAPVTALLNIQKTIYKRTLLSANVHTSCTGFRQNVSVVDNAKPHLGKPHVLKVDIVDFFGSIKKSRIIKVFESFGYPSNISQVLAELCSFEGKLPQGAATSPALSNIVAYDMDVKLMSIAQKHNFTYTRYADDLTFSGENILFEEVLSEVNNIVKDEKFVIQRKKTRFLTEKKRKIVTGISISSGKKLMIPKSKKREVRKNVHYILTKGLTDHQRFIGSTDPSYLKRLLGYLNFWLMVEPDNDYVKKSIASLKKL

SEQ ID NO: 2075 - protein, 360 aa, unidentified
  source 1..360: note = Related to QVMQ01000008.1; note = Dysgonomonas sp.
MDILIYFAIAIIIIWAIFKLLNYDNSAEKDKTRINNKPQSPGLWQRITAPHVPYDNQSLSWCSKLLAVDVVELKKILAYRDIHYKSFRIGKRSGGYRTISAPNEQLLNIQKTIYNRILLPVGLHPAATGFRKDTSIKDNAKPHLGKRLVLKMDIVDFFGSIHEYRVRKIFQAIGYPVNVSDVLAALCCLRQRLPQGAPTSPALSNIAALEMDKKLAALATKYNLTYSRYADDMTFSGDEFEKDKLIKIVTKAVQSENFAVKRSKTRYMGEKQRKIVTGISISSGEKMTIPKSKKRQVRQQVHYILTRGLDAHQRHIGNNDPAYLKRLVGYLNFWLSVEPENRYVRNSIKALAKIKTVGIV

SEQ ID NO: 2076 - protein, 387 aa, unidentified
  source 1..387: note = Related to QVMN01000003.1; note = Dysgonomonas sp.
MTGLVIISVAVIIIWLIYKYSRKEDDYSRTTDHYNRNPKGYNKEINTSPSYANNRKHSTPPPKVEKKGIFSQLFERKPSLPFDDKAITWCANFLSVDENALRLILAYQSNYYKKFLLGKRSGGYRTISAPQEPLISIQRTIYRRILAPVNIHPAATGFRHKKSVADNARPHLGKDYMLKVDIIDFFGSIKRDTIRKTFQKIGYPLNIAEVLTFLCCLRGQLPQGAPTSPALSNIVAYEMDQQLYALATENNLTYTRYADDITLSGNSLAKDEILPAIQRIVGEARFRIKHKKTRYMTPNRRKIITGISVSSGEKLTIPKTTKREIRKNVHFITTRGLNRHQQHIKSQDPSYLKRLIGQLCFWHSIEPQNEYVQKSLDVLKKIEKRIR

SEQ ID NO: 2077 - protein, 363 aa, unidentified
  source 1..363: note = Related to MIQD01000015.1; note = Tannerella sp.
MTTTLLTTLAILFGILMLVLTLREKQRERRKLSGSTPDAPYRQQPPPANPPSTDRDPLNDIYGADAIARCAAQLCTTEGELRDVLRDIRWAGYTTFWMAKRRGGYRNIEAPNPHLKAIQRAILDRLLTPLPVHTAATGFRPGLSIADNARPHLGRRRALKTDLHDFFGSIRRPAIRRVFRDMGFDAHITKVLVDLCSHRNRLPQGAPTSPALSNLVAAKMDERLTALSLRRGLTYTRYADDLTFSGDSFNRNELIADIKHIAACDGFTLNAKKTRLMASSRRIVTGLSIGSGEKLTLPRERKREIRKNVHFVLKYGVTEHRERIHSSDPAYVKRLIGELCFWRSIEPEHPFVNRALRQLRALR

SEQ ID NO: 2078 - protein, 343 aa, unidentified
  source 1..343: note = Related to JAFPFX010000010.1; note = Prevotella sp.
MKEHYQIWLKAIEESNTMSENDKNAFSKVVIALSKSGAPVIFNVKHLALLIGVDFRALKRMLYVRDRFYRSFSIKKRNGGERLIEAPYPSLKMVQRWILDNILVPSAFVHPCSVGFISKKTITDNARPHLGHSVLLKMDIKDFFPSVTEELVRSYFSNLGYRSDLASTLAYLCCKDGRLPQGSPTSPMLSNVLFYEMDNQLSKIAFWDGLSYTRYADDLAFSGDRIRISIIDNVAAIVLKYGLRINNEKTRRSGSTSRKIITGVSVSSGEKLTIPREVKRVIRQKVFYVLKYGLTDHLKHIQSRDLLAGYRLLGLLAYWHSVEPENKYVLDSSKALGEMLRGE

SEQ ID NO: 2079 - protein, 355 aa, unidentified
  source 1..355: note = Related to NZ_CP034930.1; note = Apibacter raozihei
MVWKLLKSLFSTSFHKEDVPDVHADTQVQNNKINSKSLRPSVEYLLTKDLGHLCELLEIDNKTQLAPILLHPEEYYRTFRIPKRNGKSRLISAPFTPLYRIQKKIYEKILIHARVHSAAKGFCINTSIVHNAKEHLHAKDLLKVDIRNFFPSIHQSRVVAIFRNLGYEYTLAYQLAYLCCLNGKLPQGSPTSPALSNLALLRLDSKLSEIAGNRQLIYTRYADDLSFSGNILSKNELLAEISKTVQEEKFILNKKKTRFITGAKRKIITGISISSGKLTIPKSKKREIRKVIYYIKTRGIAKHLLHINSKDAEDWYLEKILGYLSFWRAVEPENAYVLQSVKYIQSLRKQLLYKK

SEQ ID NO: 2080 - protein, 341 aa, unidentified
  source 1..341: note = Related to NZ_OEPV01000002.1; note = Dysgonomonas sp.
MNEQQNNIEIWYHEIDKANDLTSRQNSYAKKYVATLLKNNAVVIFDLYHLACLIGIKYHILLKMSHSSKHFYYDFTIKKRNGDDRVISAPFPSLKYTQKWIYQNILAKAPISPHAKGFVPNLSLLNNAEPHLHQNAILQMDIANFFPSISWKRVYNVFKNIGYNNRISAALTNLCCKHNSLPQGAPTSPILSNIILSKLDKRLSKLAEKHSLTYTRYADDITFSGYIIPNELINIISYIIEDEGFIVNNNKTRIARGNKKKIVTGISVNSEYLTIPRKKKREIRQAIYYIKTKGLSSHMENINNSDPIYIYRLLGYLNFWKFIEPENSYVIDSIRIIKSQL

SEQ ID NO: 2081 - protein, 358 aa, unidentified
  source 1..358: note = Related to PKRS01000005.1; note = Emticicia sp.
MSYDSEENIEQKLKIIRKYSKQKNHYESLLKDISIMEQKGSILIINNKHLADLVGISFDGILKIINSSQSFYYSFSIPKKNGGYRVISMPFPSLMKVQRWIYENVLLKHQIHKVAKGFVKELSIKDNASEHLGSKELLKMDIQDFFPSISKKRIISIFKRLGYNNKVSYSLASICCLNQCLPQGAPTSPTLSNIIAYKLDNRIQGLANKFNIIYTRYADDLTFSGDTFPPFFYSTIQRILLEEGFNVNKDKTRLIKEGRQKIVTGISISSDKMTIPKIKKREIRHAVYFILKRGLFAHQQAIGNYDPIYIDRIIGYLHFWQFVEPENEFVRKSIIEIKTNLASLEEEFKVYIDSNLKY

SEQ ID NO: 2082 - protein, 356 aa, unidentified
  source 1..356: note = Related to QNTX01000003.1; note = Elizabethkingia miricola
MYEALNNWDLYLDSKIKDAKVRSVLKKYVKNLLSNNTVIIFEFNHLSKLLGIEKSYLSRLVFGTHYFYQSFTIPKSNGEERLINAPKDILLDIQRWIYYNILKGISLNDNCVGYREGYSIRNNVEKHLNKEYLLKLDLKDFFPSINIERVIAVFKNLGYTPSISYILASICTLDGYLPQGSPTSPCLSNIIAKRLDARINGLCKKFDLDYSRYADDITISGNKLPKKMISYIENIIVDEGFEINLNKKRLLYKNNQRIITGVSISSGYLTIPKKKKRELRQIMFYIECYGLSNHLFKKGLNDPIYLERIIGYLYFWKFLEPNNKDIIRYFSIIKKEMIKQNEYFTDFRIPNFEFIG

SEQ ID NO: 2083 - protein, 304 aa, unidentified
  source 1..304: note = Related to MAUH01000030.1; note = Chryseobacterium sp.
MNQDLDYWFFFIDKSFRKIKVRKALKIYVEKILSTNSPIIFEFNHLSLLLGIEKDYLAKIANKSALFYHEFHIPKRNGELRIINSPNTILLGIQRWIYQNILSHIQLHESCTGFRKDYNIKHNASKHLNSNVILKMDLKDFFPSINKRRVISVFKNIGYTRNISYTLASLCCKDDSLPQGAPTSPFLSNIIAKRLDRRLNALCQKFNLNYTRYADDLTISGDTISKKLISYISDIINDEGFIVNQDKTRLLYKNNRKIITGISISSDKLTIPKKRKREIRHSIYFIKKYGIFEHVNRQQKVDII

SEQ ID NO: 2084 - protein, 357 aa, unidentified
  source 1..357: note = Related to JADEYP010000027.1; note = Sphingobacterium sp.
METAKYNLNIQRLIEDTFRGEKTLNALNIYSKGLINKNLPIILSKDHLASLLGHPLNLINNVIYSPESFYRSFYIPKKNNNGKRVIHAPKGILLDLQQKIYEYILSAIPVHEKATGYVANKTIKDNAIPHLNTNEILKVDLKDFFPSINFNRVINVFLKAGYTRDISFSLARICTLHNSLPQGAPTSPILSNLIIKRLDIRLEKLSKKLKLNYTRYADDLTFSGDSITISFLHYVKSIINSEGFKVNKKKLRILRKSHKKVITGISITNNELKVPREKKRIVRQAVYFIKKHGFLNHLEHIDRFDPIMLEKLLGYAYYWKFIEDSESSKSIISVLKLEIAKLNSSTSNLHTHLEFVK

SEQ ID NO: 2085 - protein, 360 aa, unidentified
  source 1..360: note = Related to QUMF01000012.1; note = Odoribacter sp.
MKVVSPSSFFTIMTQEQEFEINKWNGFISENIKGDKTKKALSLYVEKLIQKDTVVIIDFNHLAMLLGIQANTFASIIANTESFYYNFEIPKRSGGTRTISAPYPVLLNAQKWIYDNILNKIKVHDNAKGFIKKTSIADNARVHLDRDYILKMDIENFFPSIKMNRVMSIFRNLGYTKKISYYLSSICCLHGFLPQGAVTSPCLSNIIAKRMDARITGLAARFALNYTRYADDFTLSGDILPPKIIDYIEEIVNQEGFLINKKKTSLIGKGKQKIITGISISSGELKIPREKKREVRQSVHYVLRNGLFEHQKHIDSFDPIYVERLLGYLFFWLSVEPDNNFVKSSISKLKDYTKVLDGIN

SEQ ID NO: 2086 - protein, 346 aa, unidentified
  source 1..346: note = Related to NZ_ANLA01000010.1; note = Xanthomarina gelatinilytica
MNDNKNILVKEWDAFISENIRGAKTQIAVKTYVNKLISNNTVVILDFNHLALLLGIEVDVLARITSHSESFYYDFEIPKRDGKSRNISAPYPVLLQSQRWIYKNILSKQPIHDCSKGFKKNTSIVDNAKVHLNQKILLKMDIEDFFPSIKLNRVISVFRVLGYTKKISYYLASICCYKGALPQGGVTSPSLSNIITKRLDYRLNGLASKFDLKYTRYADDFTFSGEYLPIKIIDYIKSIVSNEGFKIKDSKTKMIGSKRQKIVTGISISSGKMTIPRKTKRELRKNVHYLLKNGLSKHLEHNRINDPIYTERMIGYLHFWHSVEPNNKYVKESLKKLKDYSIQLDS

SEQ ID NO: 2087 - protein, 316 aa, Pseudomonas fluorescens
  source 1..316: note = Related to LCYB01000004.1
MQIDSHVHMLLGISTEEELSVLSRIIASPSNFYREFKVPKKSGGTRTISSPYPSLAIIQSNILNNLFFPFEANSSAYAYVKGKSAIDHARIHVNGSELLKLDIKDFFPSISRQMVFEALQRSGAKADVCFYTSLICILDNGLPQGACTSPALSNLVFSPIDVRLTGLANFFGLKYSRYADDLAFSGEFIPRDLASLVGEILLEYDFHLNHKKTQLKLAGRKKIVTGVSISSGQVRAPKSFKRKLRAQIYELEKNIGSLARLPDFDPLIYERLIGRINYLLQIEPENNYAKVKKAYLSKCHQDFLGLVDEQIISAFV

SEQ ID NO: 2088 - protein, 317 aa, Pseudomonas sp.
  source 1..317: note = Related to CP027736.1; note = Pseudomonas chlororaphis
MQMDSHILKLLGISSKENLAILSRIIASPPSFYREFKIPKRSGGVRTISAPYPSLSYIQSNIFNSFLSSVECNLSAYAYVKGKSAIDHARVHINGKELLKLDIKDFFPSISKQMVFEALQREGGENSACFYISNLCTLNDELPQGACTSPVLSNLVFSPIDIRLSALAKFLGIDYSRYADDLAFSGDFIPRDLASLVGKIILEYGFFLNEKKTQFKLDGRKKIVTGVSISSGELKAPRVFKRKLRAQIYELERNVSNLARLPSFDPLVYERLLGRLNYLLQIEPENQYAKAKKKTISESHQRFLGLVDEQQVVSLLL

SEQ ID NO: 2089 - protein, 315 aa, Pseudomonas sp.
  source 1..315: note = Related to NZ_QDGR01000012.1; note = Pseudomonas aeruginosa
MEFEVYPILGIGSVEERAILSRIIADPPSFYRRFNIPKRRGGVRVIHSPFPSLANVQKSILTNVLADIPVSEYAFAYVSGRNAILHAKVHRESPELLKLDINRFFPSITRQMVFEALQSHGLSSKVSYFLSWLCTHKNELPQGACTSPVLSNIVFSTMDFRLSRLASEVGLSYSRYADDMAFSGGYVPRNLSRSISKILLEGGFYLNESKTQLKLAGSKKILVGVSISTGCLKAPKEFKRKLRAQIYELEKHSGNLSEVNDFDPLIYERVLGRINYLLQIEPDNRYALEKKRELSEMHQRFLSLGAGFSEALNWM

SEQ ID NO: 2090 - protein, 322 aa, Pseudomonas sp.
  source 1..322: note = Related to NZ_CP067098.1
MDNIESQIEVSGLMALYRDLNLSVEDLAIVSRMIARTDLFYRSFRIPKRRGGTRLISSPYPTLDKIQKSILQNVLEDYLPHDSAYAYVKNKCAVGHARYHLGSREILQLDIKEYFPSISRQMIFGALSRNGCDPKKASYISILCTLKNALPQGACTSPMLSNLVFFPIDVRFSKLASSLRLRYSRYADDIVFSGGKVPRDLPGLVRKILLDHHFCLNEDKTQFKIFGAKKIITGVSISSGVLKAPKAFKRNLRAQIHELERNKFHLSSQKEFDPLVFERILGRVNYLLQIEPDNIFALQKKKVLSFHHQEFLGLIDDFCLDI

SEQ ID NO: 2091 - protein, 322 aa, Pseudomonas sp.
  source 1..322: note = Related to NZ_CP077094.1; note = Pseudomonas promysalinigenes
MDNIEDIYSYQGDVQALCMALELDHTQSLILPRAIARPDLFYRFFSIPKRTGGLRKIRAPYPALASIQKRILDCLLAEKHVHHLSFAYVKNKSAIDNAKVHLTSKEILKLDIQDYFPSIDSQMVIEALMRNGFSSATAFYISRLCTVDGALPQGACTSPILSNLVFNPIDNRLAKLAERLNLRYSRYADDIVISGERVPRNLINLIRKILIERRFSLNEKKCQLKLSGSKKIITGVSISSGVMKAPKAFKRELRSQIFALEKYSGDLSKLREFDPLFFERVVGRLNYLLQIEPYNEYARKKKATICSYHQKLLGLHPMAQPQ

SEQ ID NO: 2092 - protein, 322 aa, Achromobacter sp.
  source 1..322: note = Related to CYTI01000008.1; note = Achromobacter xylosoxidans
MTSLSAFATDLNLWEIKDFSIQILYGILADSSKYYRSFEIPKRRGGNRTIHSPYPVLAQIQKELLLILQDRCGTSEYAYAYCRGKNAIMHASAHLGCDELLTVDVENFFGSTTRQQVHQALLGASFENDFAHLASLVATLHGVLPQGASTSPLLSNVVFRPLDGRLARLASHLQIKYTRYADDLAFSGDKIPRNLPKLIGKIISEKGYKLNPGKTALKIRGAKKIITGVSISSGTSKAPRQFVRATRAAVHNLEKNIGKLSATNILDPLAYERTLGKINYWLQIEPHNYYAAKKKKILSEAHQRFLELGAGFNLDNYIENRA

SEQ ID NO: 2093 - protein, 322 aa, unidentified
  source 1..322: note = Related to JAIZSD010000010.1; note = Burkholderia seminalis
MTILSLFSATMNLWEIEDFSTQILGGILADSEKYYRSFQLPKRKGGMREINSPYPVLAQIQQALTKYLRDQCFVSEHAYAYCRGRNAVMHATSHLGCDELLTVDIHDFFGSITRQQIHQSLLKNSIDASYSHIISVLATRKGILPQGAPTSPLLSNIVFSPLDLRFSRLAIKLGINYSRYADDLAFSGPRIPRNLPKLVEKILSEKNYKLNPQKTTLKIKGAKKIITGVSISGGTPKPPRKFVRSVRAEVYQVEKNINKLSSLSTIDPLSYERVLGKLNYWLQIEPHNKYALDKKNLISEAHQNFLNLSSSFDRNEYLQQLI

SEQ ID NO: 2094 - protein, 322 aa, unidentified
  source 1..322: note = Related to NZ_WKJJ01000010.1; note = Massilia rivuli
MDILESFSKELNLFSLDGFSVQLLAGAIADSSKFYRSFKIPKRRGGNREISAPFPFLANIQKAIANKLRDRIPSSDNAFAYREGRNAIMHASTHLGNRELLTVDIRDFFGSITRQQIHQSLLECNFDGNFSHISSLLSTLHGTLPQGGCASPILSNLVFYSLDIRLARLASALDITYSRYADDLAFSGDYIPRNLPRMVEKIIKEKGFALNNEKTKLKIFGARKIITGVSISSGKPKAPRQFVRALRAEVHALENNKNRLHSLTVFDPLRYERVLGKLNYWLQIEPNNSYAIEKRIGISIAHQKFLGLSANFKLEDYIQLVA

SEQ ID NO: 2095 - protein, 324 aa, unidentified
  source 1..324: note = Related to NZ_CAIGKG010000003.1; note = Cupriavidus necator
MPESEDLLALLNICEIESSNTPVLFSVLGSPDKFYRSFKIPKRNGGFRVIDSPYPSLEIIQRSILRNVLSNFPAHPNAYAFIKGRNAITHASHHLACRELITLDIKDFFPSITRQMVIDALIENGLANGVANYISLLCCLNGTLPQGACTSPALSNLVFERIDERLSRLAKTLKLKYSRYADDLAFSGDAIPRDMPQLIERILESRDLKLNKEKIRLKIAGAKKIITGVSISSGTLKAPREFKRLLRTQIYELEKNIDDISQMRSFDPLVYERVLGRLNYLLQIEPKNAFALQKKASLSQHHQRFLALSSGQWPALFPDADLAA

SEQ ID NO: 2096 - protein, 314 aa, unidentified
  source 1..314: note = Related to NZ_RBXP01000016.1; note = Azonexus fungiphilus
MTINDETLAELVRHLEIDEHLLLTLVAAISSPNKFYRSFAIPKRRGGIREIESPYPSLGSIQKAILRKILDGFSVHPCAHAFTRKKKALDHAAYHLGCKELITLDIKNFFPSITRQMVFQALNNSGLSSHFSFYISLLCCLNDVLPQGACTSPALSNVVFSQLDERLHRLAIHLGLKYSRYADDLAFSGEKIPRNMIKTVQKVLATKGFELNTEKTRLKVFGAKKIITGVSITSGIPKAPRSFKRSLRVKIHELEKHIDNLASMKKFDPLVFERTLGKLNYLLQIEPGNEFALKKKKLLSEQHQKFLSLGRQVQ

SEQ ID NO: 2097 - protein, 310 aa, Vibrio sp.
  source 1..310: note = Related to MCXB01000344.1; note = Vibrio splendidus
SLKNILSKFEIPISRENVSIFNKMISEPSAFYREFKIPKRKGGIRTITAPYPTLSYIQKLISERYLTKVNPSEHAFAYVKGRSVVDHARVHLNSTELLTVDIKSFFDSIRQQTIFEIYQSLGLSYSEAAYLTRISTLNGGLPQGACTSPILSNIAFYPLDVRLNNLAEKLGLKYSRYADDLAFSGTVVPKNLHRTIDSIIKSYNFELNQSKTKYKLEKSKKIITGVSISSGVLKAPKSFKRALRAEVYKLEKYKDNLSDMDGFEPLIYEKTIGKLNFVLQVEPNNLYAQEKRKTLISDYKVFSSKATNLI

SEQ ID NO: 2098 - protein, 310 aa, unidentified
  source 1..310: note = Related to CP014943.1; note = Colwellia sp.
MHYNNDFSIFIQNLGLEASHETRAIVSSIIHASENHYRSFNIPKRKGGYRKIDSPYPTLKHLHGVILDVFQDKLKCHKNSFAFMKGNSAIGHAKHHLDCEELLTVDIENFFPSISRQMIFEVLHSVGMKTNDSNYISYICTLRNSLPQGASTSPILSNAVFYPIDIILEQIALKFDLKYSRYADDLAFSGINIPRNLPSLIEKILMNRGFNLNKSKTKLKIKGARKIITGISISSGKLKVPRSFKRDLRANVFELEKFKHNLFEMNNFDPLIYERTIGKLNYLLQVEPESKYAKIKIKLLLESYKDFQLS

SEQ ID NO: 2099 - protein, 312 aa, unidentified
  source 1..312: note = Related to NZ_FYAJ01000004.1; note = Photobacterium andalusiense
MTDNNIVNLLEVISIKNTSHNIKIITNILNSNKNYYRFFSITKRKGGVREISSPYPTLKFIQQNIKKNILEKIVVNDNAYAYIKNKSYIDHAKIHCDSNELLTLDIKDFFPNIYRQDVFNIFSQYGFCDLQSNYLSYLCTLNNTLPQGACTSPIISNIIFNKIDNRLYKLALSFGLKYSRYADDLAFSGKKIPSKIIKLVALILEEYDFIVNESKTKLKKKGSKKIITGVSISNGEIKAPKSFKRNLRAVIYELEKNKDNIFKMPNFEPLIYEKTIGKLNYLLQIEPENKYAKEKKEKLISNYKEFISSPML

SEQ ID NO: 2100 - protein, 303 aa, Aeromonas hydrophila
  source 1..303: note = Related to NZ_CP028568.2
MNKDNLFELLEIDESFINAVNAISYSPEHFYRKFHIPKKKGGFREIHAPYPSLLALQKIISEKIQPYLKIHRSCFSYRKNISFIDNAAHHLGSKEILSLDIEDFFGNISRQKVFDVLSQSGFNNHLSNEITYLVTYKDYLPQGAPTSPIISNSIFYKIDARLYKLSEKLNLKYSRYADDITISGEKIPSNFPRYIEDILLQHGFSLNKGKTRLKKGHQKKIITGVSITSGRVMAPRIFKRNLRTEIYHLERNNYAISSPIDPMLYERLIGKLNFLLQVEPENTYAIEKKKALIEKYKKIILMI

SEQ ID NO: 2101 - protein, 301 aa, Aeromonas sp.
  source 1..301: note = Related to NZ_JRBG01000001.1; note = Aeromonas media
MNQDIFEFLAISEQQSPNLFAISHSPSSFYRTFRIKKRSGGYRELKSPYPLLLELQRIILEKSSQLLKIHDVCFSYRKEKSFIDNAKYHLNGECILTMDIEDFFGSITRQMVLDTFLFNGLTLELSQQLSYLTTCNNSLPQGAPTSPILSNAIFYRIDVRLSALSKSLGLKYSRYADDLVFSGKNIPKNFPSYISNILRQHGFSLNNEKTKLKLKSSRKIITGISISSGTLKVPKPFKRSLRSLIHNFERSSFSVSSSRNPMIFEEIIGKLNYLLQVEPHNNYAQEKRKLFLSEYRKFISY

SEQ ID NO: 2102 - protein, 342 aa, unidentified
  source 1..342: note = Related to JAIUIU010000040.1; note = Mesorhizobium sp.
MTDETLAGALRERGVPVRWIDAYESYAQRLTENGVPVIFELKHLAILTEIDLSFVLSCVYATNIHYRIFIIPKKTGGTREICAPLPALLSIQRWINHQILEKFAVSEFAHAYVNGRSIVSHAQNHRSGRVLLKMDLQNFFGSITLSMVLGIFRAAGYSRNLSFDLAKICTLGDFAPQGAATSPSISNIIFYHIDQAIGSICAKNELIYSRYSDDICISGRHISKEIIATLRELIESNGFAINDKKTKLATSAGRRIVTGISIGSGRMLPTRAFRKDVKRRLARIRKIGVNSAMVEDGDPFVLDRLVGKLHFWSHIDPDNKRIRVALNEMISLAKGESQTTGT

SEQ ID NO: 2103 - protein, 341 aa, unidentified
  source 1..341: note = Related to nan
MINSDPLESALVELRVPSHWIKSYLQYRDRLESSGFPCIFELDHLAYHLSFEPSALRVLVHNPQGSYNFIEIPKKRGGIRKISAPLPALLYAQRWIKNNIVDKLNIDESAHAYVRTRSIVTHARLHIEGRVIYRTDIRDFFGSISFDSVVSLIYSLGYSQDVLFDIASICCLHGSLPQGASTSPALSNVIFYKTDRALSTLASSFGLRYSRYADDLCFSGEHIPRKFIDKSTSILNADGYILNSEKTRLETSRSRRVICGLSIGDGRVKPVKSFRRAVRAETNNFLKQTKERSVVYWEVTPFFIDRLLGRLNFWKSVEPDNKWIVEHEQIVRRRIRTILEM

SEQ ID NO: 2104 - protein, 310 aa, unidentified
  source 1..310: note = Related to SJST01000002.1; note = Oricola cellulosilytica
MYRAGQILSLIHEICEKSGLPKDKITALAYRNRPRYRIFHIHTGKKQRLIKAPIPSLRAAQKALAAIISEKLKPEECAHGYVTDRSVITHAASHLGKKAFFKTDIVDCFGSINFPEIANTLREAKYNSVDSFIAASIATDEGSLPQGAPSSPLLCNLVLRSVDRPLSKLADKLCATYTRYGDDIVMSADDFDINIISIVRNVLSRHGFKMNEDKTYIAIEPQQNIITGISIATGYPKVRKSFKRQVRLETHLLLKKGIVSYLESDGYIDPFAADRVLGKLTWWSHVEPDAEFPKKHSIMIRSMMKEVARG

SEQ ID NO: 2105 - protein, 334 aa, unidentified
  source 1..334: note = Related to JAEPPB010000039.1; note = Pseudomonadales bacterium
MNTVNEWAEFFRDQQVPEDLILRYLPYIERLLTKNVPIIFEGKHLRKLLGIESSMLRSLVFNGSAFYRSFSIPKRSGGERTITAPYPELANAQAWIKQEILDNLKATPSATAYVQGKSILENANEHVGKKMLLKLDVEDFFGSIDVKKITAIFESCGYTNKVSYLLASICTLDGSLPQGAPTSPQLSNLASIPLDNRIHALAKKLELTYTRYADDIALSGEFIHSNVISYVEDILKSEGLKLNSNKTQLKQPGKRKILTGISVSSEKPMIPRAYKRQLRAEVFNALHKAQHELPFDPLNIERLIGKLNFVLHVEPENQFARRSLEALKQKKIAP

SEQ ID NO: 2106 - protein, 342 aa, unidentified
  source 1..342: note = Related to NZ_CAKLOR010000001.1; note = Klebsiella variicola
MTEIIKSSWDHLVGTKSPDGRQKEIFKKYIQDLEKNGLPVIFEFEHFAYLLGMTTSTLAQTIINPEKSYRSFHIKKKRGGSRLINAPYPLISYIQKWINTNILSKIKNHESSFAYKKNSNAYLHALQHIDTNETLKVDIVDFFGSIKKIDIVRLFRELGYADNVSLYLASACTYANSLPQGAVTSPNLSNIIFYSLDNRFYHLAIKLNLTYSRYADDLFFSGEKIPSNLYKSIKSILQSSGFSINKEKTRHITNGKQKIITGLAVKENSVRIPKSYRRKFCQEAYIFIKNEKSNSSMENINFDPILIDRLIGKANYILKVEKNNERIMKLLKQLNEIKLNTF

SEQ ID NO: 2107 - protein, 344 aa, unidentified
  source 1..344: note = Related to NZ_JABBPG010000001.1; note = Pseudoalteromonas caenipelagi
MNQLSYETWLDFLKKEGYGHKQSEKLAAYAHKLASNNVPIIFEIEHLAKLLGVELSLLSRIYGVSSYFYRSFSIKKRSGGARNIKLPYPKLKYIQQWIKQEILDNLTVDENAFAYVKGKSNIENAKLHIGSNELLKLDIKDFFGNVKVESIESIFRSCGYTDDVSYLLARLCTCFGFLPQGAPTSPTLSNLVLQALDKNLAHFANINSLTFSRYADDIFLSGKLITKEIKQDAVEIVEKSGLPINHNKTKIIRGNTCKIITGLIVTDSTVRVPKKIRREFRKNSFFMLKNKSSQMDGSRAKLNPLLIDEIIGVGNYIIRVEPSNKYVESVLGELQELKKDLFGK

SEQ ID NO: 2108 - protein, 343 aa, unidentified
  source 1..343: note = Related to NZ_JACJFK010000033.1; note = Pseudoalteromonas sp.
MKPIYDKWFNFLKASNLSLQQSEALAKYASRLENSNFPVIFEQKHFSKLLGLELNLLSRMTGASSNFYRSFEFKKKKGGIRAIRSPYPKLAYVQKWIKKEILEEIPISKSAFAYVKGRSHIDNAKKHIGSKDLFKIDIIDFFDQIKFEKIYNAFIACGYSHKVSFDLTQLCTFWGKLPQGAPTSPSLSNIVLKKLDDELFNVCKASSLTYTRYADDISVSGIEISPKIRNEIIEVVENNGYPVNHKKTYFAQGKAKKVVTGLIVTDSEVRVSKSMRRDFRKKSFFLLKNGVNELNGKNKPINPLYIDEIIGLASYILKVEPNNKYVATELKNLKKLKQDLFLN

SEQ ID NO: 2109 - protein, 343 aa, unidentified
  source 1..343: note = Related to SLYT01000019.1; note = Rahnella sp.
MADNNLDRKIFFKKNGLSESQSIKLDIYAKNLESKNLPIIYELKHLSKLLGMEYALLSRMSGINRFFYRSFSIKKRNGGRRIINSPYPKISYVQNWIKDKILSQVPISNNAYAYVNGLSHIEHARQHIGSDVFLKIDLLDFFGQISDQRVKKIFSELGYTDKLSLQLARLCTCNSSIAQGAPSSPILSNIVLKELDETLFTIANSNSILYTRYADDIYFSGKHVSKGFFSKIKGVINNFGMVINEEKSKIYKSHHKKIVTGIIVNQKEIRAPKHMRRRFRTESYILLKDKFKVFNGERGLFNPNYIDEILGLGMYILSVEPQNAYVIKIVKSLKALKKEFAQY

SEQ ID NO: 2110 - protein, 343 aa, Vibrio parahaemolyticus
  source 1..343: note = Related to NNHO01000001.1
MMEQSRWFKFFIENDLNKSQAQLLTKYAQILELKSLPVIFELEHLSKLLGVELSLLSRICTLNERFYRLFSLEKKHEGFRHIESPYPKLKYIQRWINDNILSVLAVHDNVYSYLQGKSHIDNAKMHIGCKQMLKLDLVNFFGHITISQIEKVFIECGYTKDLSNKLAKICTYYDHLPQGAPTSPALSNIIFYELDCILYDISQSNGLIYTRYADDLCFSGDNISQYVVDDILSHLKSHGFSINDEKSRLLTGNQRKVVTGLLVQSDTIRVPKKVRRKFRKDSYYLIKNGYDNLGNERLFNLLEVDELIGIGSYIKKVEPQNSYVSNALIELNNIKNSLMTSTS

SEQ ID NO: 2111 - protein, 343 aa, unidentified
  source 1..343: note = Related to NC_010334.1; note = Shewanella halifaxensis
MVFQESRWFQFFIEHKLSSRQAALLTEYAINLECNSVPVIFEIEHLSKLLGIELSLVSRMTGVSNLFYRQFPLKKRSGGIRTIESPYPKLAYVQRWIKNHILEIKPISSNALAYVQGSSHIENAKRHIGAKELLKIDLVDFFEYIKLSTVKSIFTECGYTEKVSHQLAKLCTLRDRLPQGAPSSPVISNLVLVELDKRLQSISKKHELVYTRYADDLCFSGHAISDEFFSLVKDEIESEGFVVNQNKSGVVRGHKRKLITGLVVSEYGVRVPKKMRREYRKQAHYMLKNGIEQLNGNMGMLNPLHIDEVIGKGQYILSVEPGNAYVKDSLCMLLKLKNKLLIK

SEQ ID NO: 2112 - protein, 342 aa, Vibrio sp.
  source 1..342: note = Related to NZ_MCYY01000073.1; note = Vibrio breoganii
MAYQESRWFKFFNEQQLSANQATLLAKYAQTLESNSVPVIFEIEHLSKLLGMELSLLSRMTGASSLFYRQFSLKKRSGGVRFIDSPYPKLAYVQRWIKNNILETRPVSSSAFAYVQGGSHIENARKHIGAKELLKIDLVDFFGHISFSSIVSIFEECGYSRSVSTQLAKLCTLWGKLPQGAPTSPVISNLVLLALDKRLQNLSDKNGLVFTRYADDLCFSGNEITEEFYSSVYDTLENEGFVVNEKKSGFVLGNKRKLITGLVVSESGVRVPKKMRREYRKQAHYMIKNGIEQLNGELGIFDPLYIDEVIGKGQYILSVEPDNAYVKESLCKLSKLKSDLLV

SEQ ID NO: 2113 - protein, 344 aa, Aeromonas sp.
  source 1..344: note = Related to JH823256.1; note = Aeromonas veronii
MTEEKSPWYEFFLKNNIGSRQATALSEYASRLDCNGVPVIFEMKHFSKILGLEFSLLSRMCGVNSYYYRAFYIKKRRGGVRVIQSPYPKLSYVQGWIKDNILDKNRISKHAFAYSKGKSHIDNAKCHIGSSELLKIDLENFFDQISISAVQEIFLRFGYTENISFKLAKLCTLRDTLPQGAPSSPAISNIFLYELDNFLASYSEINKLTYTRYADDIVFSGERISNESIVDIKKYITSYGLKINEKKSRLVKGAQRKIVTGILVGDTDVRVPKKLKRQYRAQAFNIIENGFSVFDGSIGKPNPLYIDEVFGKGQYILSVEPWNKKVVELQSSLRELMKEMSENI

SEQ ID NO: 2114 - protein, 344 aa, Vibrio sp.
  source 1..344: note = Related to NZ_CP060047.1; note = Vibrio vulnificus
MSSEYIRWLDYLRSNGVQNKQARILAEYAHNLVKSNLPVIFEIEHFSKLLGIELSLLSRMSGASSLFYRGFSIPKKRKGVRKIDSPYPKLAYVQLWIKSNILERLPISDNAYAYTKGRSHIQNARAHIGAKELLKLDMRDFFNRISRLQVEQVFLKCGYSDNVASVLSNLCSYNGVLPQGASTSPILSNIVLKELDDVIQHVAEKYSLIYTRYADDITLSGNSISKNVCNEVMQYIEEFGLPVNEEKVHLLKQNDKKIVTGLIVTDSSLRVSKQMRRAYRQESYYLIKNGETQFDGSTKPLKPLYLDEVIGKGSYILQVEPENDYVRNTLRDLSKLKSRLFSNV

SEQ ID NO: 2115 - protein, 344 aa, Vibrio sp.
  source 1..344: note = Related to JAKGTN010000030.1
MSPEYIRWLDYLCSNGVHTKQANVLAEYANNLAISNLPVIFEVEHLSKLLGIELGLLSRMSGAPSLFYRSFRIPKKRGGVRGIRSPYPKLAYVQSWLKENILECLTISDNAYAYTKGRSHIENARAHIGARELLKLDIKDFFNRISKSQVRQVYINCGYAENVASVLSNLCTYNGTLPQGACTSPILSNIILKELDETLQDISGQYSLTYTRYADDITFSGNSISDDVCSELIHHIEEFGLPVNEDKVRLLKPKDKKIVTGLIVTDRSLRVSKKMRRAYRQESYYLIRNRERQFDGSIKPLKPLYLDEVIGRGSYILHIEPNNDYVRDSLKELLELKSQLFSNS

SEQ ID NO: 2116 - protein, 344 aa, Vibrio sp.
  source 1..344: note = Related to NZ_LNRB01000009.1
MSPEYKKWFEFLCTNDVSEKQATLLAAYADRLLKSNLPVIFEIEHLSKLLGIELSLLSRMSGMPPFFYRNFQIPKKREGFREICSPYPKLAYVQSWLKENILDGLTISDNAYAYTEGRSNIRNARAHIGARELLKLDIRNFFYNIKTLQVKRVYLNCGYSNNVASVLSNLCTYNGRLPQGACTSPILSNIILKELDDALQNISEKYSLTYTRYADDLTFSGNSISDDVQNEIKANIEGFGLPINEDKVRLLKPNQRKVVTGLLVGDSSLRVPKKMRRAYRQESYYLIKSGKSQFDGSIKPLKPLYLDEVIGRGSYILQVEPDNDYVRDSLKELSKLKSHLFSID

SEQ ID NO: 2117 - protein, 345 aa, Vibrio sp.
  source 1..345: note = Related to NZ_SYUW01000019.1; note = Vibrio kanaloae
MKSNEREWIDFFIERKVDLNQAKILTSYAINLQEKSLPVIFEIEHFSKLLGIELSLASRIVTKPERFYRVFNVKKRRGGSRVISSPYPKLYYVQSWIKDNILQKIRVHESAFAYKKNTSHIDNARVHCFSDEMLKVDISKFFDNILKSNIVDIFVKCGYSKKLSEQLASFCSQGDHLPQGAPTSPVISNIFMFELDNRLSKVAEENNLKYSRYADDICFSGKRISQNLLELVNRAITDYGFQLNNRKTRLYKSQDVKSVTGIVVSNGKLRTPKRIRREFRADCHHLLSNGYLQFNGELGVFNPLMLDEVIGKGRYILSVEPENQFVSDQMSKLATLRSKYLSLSL

SEQ ID NO: 2118 - protein, 345 aa, Vibrio parahaemolyticus
  source 1..345: note = Related to DADYGM010000030.1
MKINEKRWIDFFIKNNVDLEQAKILTLYAVNIQKKSLPVIFEIEHFSKLLGIELSLASRIATKPERFYRLFNISKKRGGSRAISSPYPKLNYIQLWIKENILEKCPIHDSAFAYRKNRSHIDNARMHCDAIEMLKVDISGFFDNISASYIVKIFEKCGYSKKLSEQLANFCSHSDLLPQGAPTSPIISNIHMYELDKKLSDVSSEHNLIYTRYADDICFSGREISVNLLNIVNKLVNEHGLKLNKNKTRLYKSQHIKSVTGIIISDGKLRTPKKIRREFRLDCHYLLKYGYLQFNGEFGPFNPLLLDEVIGKGRYILSVEPENHFVKCQLSKLITLRNSYLSFNE

SEQ ID NO: 2119 - protein, 342 aa, unidentified
  source 1..342: note = Related to SNWT01000008.1; note = Idiomarina sp.
MLNFSQWKSFLQSEGISEQQSEHLANYAERLANRGFPVIFELEHLSRLLGVEKNYLYRVMFKGSEFYRTFEINGRRKKRLISSPYPILSYIQSWIKEQILEKFVVSEHAYGYVKSRSILDNAKFHLGCTELLKLDIKDYFAHISRAMVNRVFNEAGFTPKLSYQLSKLCCVYGSLPQGAPSSPTLSNLVMRELDQSLFYLSDFYNIKFSRYADDLAFSGKAIPSDFIVKAVKQIENYGFMLNHEKFTHRKINQGKMISGLSISGDFVRVPKKTRREFRQKHHYMMLNKEKSFNGVHGDFDLLSLDKLIGLGQFIKFIEPNNTFVIRAVDDLNLLKKEIFRTG

SEQ ID NO: 2120 - protein, 342 aa, unidentified
  source 1..342: note = Related to JACJFK010000046.1; note = Pseudoalteromonas sp.
MLNSSQWKSFLVNEGISVEQSDLLANYTEQLTSSGFPVIFELEHFAVLLGVEKNYLYRMMYKSREFYRTFKISGKKKKRLINFPYPILSYVQSWIKEHILENIEVSEQAYGYVKSRSILDNAKLHLGCTQLLKLDFKDFFGHISIHDVKRVFRDVGFTPKLSYQMAKICSVNGCLPQGAPSSPILSNLIMRKLDNELAHLSKFHNIKFSRYADDLAFSGEIIPSSFIVMIVKIIESNGFTLNHKKFAHKKSGQKKMVTGLCITGDRVRVLKKTRREFRQKHHYLMLNKEKSFNGDYGDLDVLYLDKIIGLGRFIKFIEPNNTFVSKAVEDLASLKKELFSIV

SEQ ID NO: 2121 - protein, 346 aa, unidentified
  source 1..346: note = Related to JAAFZY010000006.1; note = Mangrovimonas sp.
MSANYQIKDWEELINNSSLSKKEKKEKLFFIRSAYHNGVPVILDLDHLAHLLGLKVGVLSAMIKKPLRFYRQFKIPKKRGGFRDIVTPYESLLEVQQWIVEHVLSKFQVHDAAHAYVKKRNIAQNASIHVGCDEMLKIDLKDFFPSIKIPRVRELFNRVGYSKEVSYYLTNLCCLNGSIPQGAASSPMISNIILFNLDKRLSVFSKNHGVKYSRYADDLVFSGNFQSFGFKNLVIMNIEDEGFKANTDKTREYCEGHRKMITGIVVEKDRIRLPKAKRREIRTEVYFLMKYGIFDQVKRYNDIYYADRVLGRLNYWKQIEPNNEYVIDSIKSIKKLYEETLKQIST

SEQ ID NO: 2122 - protein, 343 aa, unidentified
  source 1..343: note = Related to FNSF01000001.1; note = Tenacibaculum sp.
MKVEYKISDWEDLINESSLTKKEKVEKMLFIKKAYDNNVPVILDLDHLSHLFGLKKGIVASMINSSQSFYREFKIPKKRGGYRDIVTPYQSLLEAQQWIIEHILSKFKVHDAAHAYVKKRNVAMNAMRHIGCDEMLKIDLKDFFPSIKIPRVRELFNRVGYSKAVAGYLTKLCCLNGSIPQGAATSPMISNIILNSLDRRLYVLSKNIGVKYSRYADDLVFSGEHIPHEFALNVVKNIEDYGFNINIVKSRHYKSQQRKMITGIVVGDDNIRLPKVKRREIKKEVHYLKKFGVLDQVKRYNDIYYIDRVLGRLSFWKQIEPDNIYVLNSIKEIKKMYEEFLKS

SEQ ID NO: 2123 - protein, 349 aa, unidentified
  source 1..349: note = Related to JAIQZE010000004.1; note = Psychroflexus sp.
MSYTINDWKKTIETSNLSKIEKIERMQYVESAFKNKVPVIIDTKHLSQLLGLKIGVLTSMVQSPSSFYREFKIPKRKGGYRDIVTPYKSLLEVQQWIAKHILSCFEIHPSAYAYVKGKNIAQNAKLHIGSSEMLKIDLKDFFPSIKIPRVRELFKRLGYNKEVTYYLSKLCCLKEQLPQGAASSPLISNIILSNLDKRLFKFASNNQLIYSRYADDLVFSGDAIPSDFRILVAMNIQDEGFSLNPDKTIEYSENQRKLITGVVVKKDSIRLPKDLRREIKQQAHYILKFGILDQVKRYNDIFYVDRILGRLSYWKQIEPKNEYVINTLKEIILMYKETMNNIQNNDDGE

SEQ ID NO: 2124 - protein, 346 aa, unidentified
  source 1..346: note = Related to BBML01000001.1; note = Nonlabens tegetincola
MDNNYKYEDWKEIIESSNLPNEVKVDRMDLVRNLYKNNVPVIVDLKHLSNLLGIKYTVLASMIFSTSSFYREFKIPKKSGGLRTIVTPYKSLLTVQKWIVKNILSQFKIHDDAYAYVKNRNIALNAKQHIGNPEMLKIDLKDFFHTIKIPRVRELFNRLGYSKEVAGYLSNLCCLNEALPQGAGSSPIISNIILRTLDNRLSNIASKSEIVYSRYADDLVFSGSKIPLDFEVVLTQKINDFGFKLNLKKTKFYKKGDRKLVTGVVVNSDGIRLPKSKRKQIKKEVYYLKKYGIQDQVFRHNDVFYIDRILGKLSFWKQIEPKNEFVLTSIIEIRNMYDKTMKNNKD

SEQ ID NO: 2125 - protein, 385 aa, unidentified
  source 1..385: note = Related to BBMM01000006.1; note = Nonlabens ulvanivorans
MIKAPKSFYRTFKIPKKRGGTRTIVTPHNSLKEIQRWILDNILSQFMIHEAAFAYEVKKNVAMNASIHLGQDEMLKIDLKDFFPSIKSPRIRELFTRVGYSKEVSYFLNALCSLDGCLPQGAVTSPKISNIILYYLDKNLSTLCHNNEVKYSRYADDLVFSANELPINLKSIVSSSIIENGFEINYAKLTEYSSEQRKLVTGIVIKEKGLTLPRSKKLSIRNDVFFLLKYGIEDQIQKYNDIFYLDRVQGRLSYWKQIEPNNKFVLDSIDKLKSLHKDYLNQALDKLNFLKIQKTNPLNNYKEYIHQVAFVASGLKIQIQIEDLRQSMNYLGYRTKKGAKYLKGRGFHRLIGLTFKWLEKQNKNEEADKVALTFINADGSYSYKK

SEQ ID NO: 2126 - protein, 348 aa, unidentified
  source 1..348: note = Crocinitomicaceae bacterium; note = Related to JABSPD010000014.1
MKNNYSIEDWEKHILENTEANGLERVYYLETVKIAYQNNVPVILDVNHLAKLLGLKVGIVTSMIYGPHSFYRTFDIPKKKGGVRTIVAPYTSLLYCQRWISDEILSRFFVHDAAYAYRPNRNIVMNAEKHVGQKYMLKLDLVDFFGNITESRVRSLFQENGYDKGMSFFLAGLCCLDGVLPQGAATSPSISNIVLNELDHKFDYLCDKYGVVYTRYADDLVFSSDSPLDHIVDHIGDIIKGEGFTVNIEKSKIYTAGANKLVTGLAVQEDRVRLPKRKRRKIRQEVYFVKKNGIMKEVERSSDLFALERVLGKLYFWKQVEPNNEYVLGEILELKKMRKELLRSLTSS

SEQ ID NO: 2127 - protein, 349 aa, unidentified
  source 1..349: note = Related to JAHXPQ010000003.1; note = Mucilaginibacter sp.
MIKWSEKLASNTSKPTELTEALIKYSKKLEKQGFPVIFDLAHLALILGIEKLTLASIVNSSSKFYRSFKIPKRRHNTFREINSPYPVLKKIQDWIKVEILEKIEMSHHCYSYRKNVSIIDNASVHLGNEVLYKLDLVDFFDNIKEDRILSIFLNCGYSYKVSYFLTSLCLLTTKLPQGASTSPIISNIIAKRLDKRLSALCSKYKINYSRYSDDITISGKFVPPFLRLIIKNIIADEDFIVNQNKEILINGLNKKKIVTGISITNNVLKIPRESKRIIKQEVFKFLKYDFMINPNEQEFDPYFTERLIGKLNYWINVEKGNENPIFLLRSVIEKNKLFMSRIIQEDFNS

SEQ ID NO: 2128 - protein, 314 aa, unidentified
  source 1..314: note = Bacteroidetes bacterium; note = Related to JAIBAE010000002.1
MNEIYPNIKSIRDLSIATEIPIKKIAGMIFSSENHYRIFSLPKRNSDGVRVIHSPYPNLYKVQRFILEQILRNVDGNNYCYSYKSGVSIKDNAMRHIGTKVFYKIDLENFFENIGFKKVIRVFRNCGYSDGVSYMLTKLCLCNNGIPQGAPTSPLLSNIVTSKLDKRLSGLSTKENLTYSRYADDLFFSGEYISTKCRELIKTIVEQEGLIVNNKKELLVIGYHKKKIVTGLSVTEKNISLTRNYKRELRLNVYKYLKYNHKVNPYNVDFDPLYKEKLLGQLYFWKFIEEDNEIPNILIEKVRNKEIIYPDLEL

SEQ ID NO: 2129 - protein, 350 aa, unidentified
  source 1..350: note = Related to JAAGPI010000025.1; note = Burkholderia sp.
MKLSSGSDWRKYFEEIGLESARSAELCRYAATLADSSLPVIFSFEHLAALLGRTRHHLASIIFASEHHYRSFDLIKRRGGTRLIEAPYPSLLECQRWILKNILLKIPTSNNVHSYLHGKNIKTNALVHVGENSILKMDLRNFFHSIEMTRVLKLFESLGYAPEIAYFLAKLCVLRDRLPQGAATSPMLSNIIASTLDSRLNSLAKSQNLKYSRYADDLVFSGNDISPAFVGEIRSICEGEGFYVNEEKTKLKTGSSRKIITGLIVGEKKVSLPRTYKREVRQQVYYIIKMGPLEYLKRNRLSPTALSSLAGRLAFWNSIEPDNPFVRESLPILMRLMSGEQNETRRIKNT

SEQ ID NO: 2130 - protein, 346 aa, unidentified
  source 1..346: note = Saprospiraceae bacterium; note = Related to JAGQWR010000133.1
MKPSESISKWHDLLKAAPLNEDLKDALSLYIRSIIKSGFPVILNVEHLSHLVRIEYIFLKRMMNSSESFYYEFEIPKRRGGKRVIEKPYPTLILVQKWILRHILQKKAVHRSAFGFVKGKSMIDNAKCHINGKSLLTIDLKDFFPNIKLPRVISLFQRIGYPYHISYILASLCVKNGRLPQGAPTSPYISNLVTHKLDSRLDKLCDKFDICYTRYADDMAFSGGTINLTFVNLVRSIIADEGFIVNEGKVKLIHGFDKRKIITGVSISSKKTTIPKSTKRKWKLELFYLIKNGLDAQMKVLRINDPLYLDRCIGKLNFWLQVEPDNKFARASLDTVTEMKKLRSIE

SEQ ID NO: 2131 - protein, 343 aa, unidentified
  source 1..343: note = Leptospiraceae bacterium; note = Related to JAGNNE010000423.1
MNRDYWIEYINLNIQDEEKRLIYYELLNRLIENSLPILLKFENFEFLFKIKKEILALIYKDSRKFYRTFTIPKRNGSLRFIQSPLPLLQYIQRYILDEILSKIITHNNAFGFVKHKSIVDNVKPHLNSHTLLKLDIDNFFPSIKIKRVISIFQRLGYSNRISFLLAKFCCYDDSLPQGAPTSPYLSNIIAKRLDSRLYNLAKEHHLKYSRYADDMTFSGNHISKNFIDFAYKILIDEGFTPNYTKSKLIVGRGRKIITGLSISNKKITIPRNKKRELRSKAYSVLSSDAKYKINYAAIDDPIFVERLIGQFSFWNFVEPDNLYAVNTLKLLKEYSSQLDNLIE

SEQ ID NO: 2132 - protein, 347 aa, unidentified
  source 1..347: note = Related to CP027860.1; note = Ahniella affigens
MRILNTIESWEAYFEDVCLREDIAAAHLKIISAQLKSGVPVIFDVEHLSLLLGVSSTYLASAVSVPRYHYRDFAIPKKRGGVRTISAPRAALKGVQRWILDNILNCFLPHKCAFGFRAKKSILNHARTHCTAGRILKLDVAEFFPSIKLDRVIGLFKSFGYTPGVAFTLASLCCLDRQLPQGAPTSPAISNLVCRRLDNRLHAFASKNRFRYSRYADDIALSGRDLNSSVIQIIRGILAEEGFALRDDKTRIYGVHSKRILTGLSASLDGVKLPREDRRQLRSVCHQIRKFGFLSYLANNKIRDPMFLARLIGRFSFWCYIEPENAFASEALAHLRGVERQFLAARS

SEQ ID NO: 2133 - protein, 338 aa, unidentified
  source 1..338: note = Related to JAFIXE010000059.1; note = Stenotrophomonas maltophilia
MRALTSLDSWIDYFKDVGLSDDVVEKHARYVGELLARSLPVIFDVQHLCLLLGVSERFAAVVLNASQSSYREFKIPKRSGGSRTIIAPRRALKDCQRWILDNILARVGVHAAAKGFVQRRSTKSHCRPHLGRESLLKLDFQDFFPSIKKRRVIALFRSMGYSDSVSLYLAAFCCFGEVLPQGGVTSPAISNLICRRLDARLSALASSKRWRYSRYADDLVLSGRNLNYAVVGIVAKIAKEEGFRLNDGKTRLYRGEARPIVTGLVLGESALAVPRTFKREVVKQAHYVLTYGVLSHSAKTKSRNPYLVPTLLGKLNYWIHIEPENQRAVRLRDRLSAL

SEQ ID NO: 2134 - protein, 352 aa, unidentified
  source 1..352: note = Related to NZ_JAKZKY010000019.1; note = Geothrix sp.
MNAYEGMPASIPGLRVWRKYFEDRGLSSEVVELYMGYIAPLYRRRLPVIFEWEHLGKLLGRTPHYLATAIASPAAFYRTFRIPKKCGGFREIQAPHRSLLDCQRWIVENILKRVPAHECAIGYVQGKSIIDYVTPHLQSADIFVTDISDFFPSIKIQRVIGLFQGFGYSNSVSYALASICCLGGALPQGAPTSPYLSNLICKHMDKRLSGYARKQNMIYTRYADDICFSSQAIRSVNKNTIRRIIFESGFSVNNLKTRTYIGNSTSKIVAGINLSGGKRTLPKDFTRPLLTEVYYIEKFGYISHRKKKKIKDPLHLMRLLGRAAYWRWVDPGSEKAQYCYGLLAGILREIAI

SEQ ID NO: 2135 - protein, 350 aa, unidentified
  source 1..350: note = Acidobacteria bacterium; note = Related to JACPYP010000009.1
MYDFVPAPLPSLHKWRKFFISRGVPEPRIQELLIYIKPLVKNRVPVIFNLEHLGRLLGRKTGYLAKIINSNEHFYRSFQIPKKNGAHRIINAPYPSLLECQRWINDNILSIVKIHDCAKGYLKNTSIIDHVEPHLGNNVVLLLDLKDFFPNITINRIIPVFRNLGYSQQVSLALSKICTLNDILPQGAASSPSLSNIICNRLDKRIACYSEKNDINYTRYADDLCFSSKHIEPHKIKMILKIINSEGFLINSSKYRLLGPQSSQKIITGINISNGAMKISNTYKRELSLAMYCIKKFGIRSHLQKLKIRDTYYLDSLYGKINYWLNIESTNKKAKFYKMFVRSLMQTYEP

SEQ ID NO: 2136 - protein, 352 aa, unidentified
  source 1..352: note = Related to NZ_WQGP01000012.1; note = Ruegeria lacuscaerulensis
MKRSLTQVWESYFEEIGLDTELSAKYIPYIARCADAKIPPIFEQDHLAQLLGLELPMMLSMVFGTKSFYRSFSIPKRSGGRREIVAPYPSLLEAQRWIAENILDSVKVSVCATGFRRGKSILDNARLHCERDQILKIDIKDFFPSISFQRIMRVFTSIGYPNEVAYLLSKICTLGDSLPQGAATSPTLSNIVCRRMDVRFYKVCKRHRLRYTRYADDIAVSGKSIPSGIARLFFEIIEDEGFEVNQQKVRFLGKADRKIITGLDITSGVPRVPRKFRRELKKDVYFVWSAGLSTHVSRRKIFNPQYIDHLMGRIEFWRQVEPECVQLATVQRRVNEIVSQQKSYSGTSKFQL

SEQ ID NO: 2137 - protein, 345 aa, unidentified
  source 1..345: note = Related to NZ_FNNB01000012.1; note = Sulfitobacter pontiacus
MNDNLLYKWHQYFEDIGLRSDLVRSYTPYIRRCISNGVPPIFESSHLAVLVGRNPADLSAMGFGAKSYYRSFKIRKRSGGLREIQAPYPSLLEVQRWIVGEVLSSVRLPVCSTGYREGVSILDNALVHCGRKEVLKIDLKDFFPSIGFSRVVKVFIDFGYPSNVAFLLANLCTLDRKLPQGAASSPLLSNIICRDLDQRIMKICKSRRLRYTRYADDIVISGKAIPKGIRRLFFEVIASEGFQVNEKKVRFLCEGDKKIVTGLDITSGKPRPTRQFRRDLKRDVYFVWSSGLSSHVARRRIFFPNYIEQLEGRARFWEHIEPDNVQMKKTMERVVELRKLYGRQR

SEQ ID NO: 2138 - protein, 343 aa, unidentified
  source 1..343: note = Related to NZ_CP044970.1; note = Brucella anthropi
MNQNSIQQWSSYLEDIGIYPDLREQYIEYVKKCVRFGVPPIFERTHLSMLTGRHLGDLMSMIFATEKFYREFKLRKRSGGYRRILAPYPSLLEVQQWIKDNILSKYELQNCVTGFRDGYSIVDNARMHCGRDILIKIDIRDFFPSINFNQIMGVFHKAGYANNVCFYLSRLTTLDNQLPQGAATSPSLSNIVCRNMDKRFLLLSKNHRLRYTRYADDISISGKHISDGMIRLFFEIVESEGFRINTDKFRILNANDKKIVTGLDISSGRPRVTREFRRDLQRDIYFVWSQGLAAHIARRRIFFPNYVDHLTGRVNFWRSVEPESAQLKKVINRLKIIRSQYMI

SEQ ID NO: 2139 - protein, 348 aa, unidentified
  source 1..348: note = Related to JACIDV010000004.1; note = Rhizobium skierniewicense
MATIPYQREHLSRWKAYLSDIGVRDDLKAIYLFHVKKSLEKGVPPIFEHEQLALLLGIDVAHLMRMLFGQKSFYREFSLKKRSGGYRTIRAPLPTLLECQRWINSNILSAVQLAQPAMGFRERHSIVDNARIHCGREELYKIDLKDFFPSIGFRRVMGAFVSLNYPKHVAFFLSTICTVDDELPQGAATSPTLSNIICNRLDMRLRAICRKRKLRYTRYADDITISGNKITDELKWIVHKIVEDEGFVINREKIRHVFAGEKKIVTGLDITSGVVRIPRQYRREVMKDVYFVWSSGLSNHMAKNRAFEPNYIAQLAGRLQFWKHVEPENPQMLKCLKRFKSVMLSYQK

SEQ ID NO: 2140 - protein, 344 aa, unidentified
  source 1..344: note = Related to NZ_BACT01000550.1; note = Methylobacterium sp.
MSKSSVEKWEAYFSDLGINQDYIREYIDYAGPMLRAGVPPIFEDVHLSLLIGRDLGTLYAMVFGTGKFYRSFTIRKRRGGKRLIQSPYPSMLECQKWISEHILQKSQVSRCATGFRRNQSILRNASLHCKRDVLLKLDIKDFFPSISVNRVIDIFNSFGFPPNISFLLGRLCTLNGRLPQGAATSPIVSNIICKQMDDRLYSLCLSKNLRYTRYADDIAISGVQIEVGTNYLIREIINAEGFLINEEKTRICGPRDKKIVTGLDITAGKPRLTRSYRRELQRDVYFVWSAGLASHLSKRKIFNPNYMEHLQGKIAFWESIEPESAQMKKCKDRVSKIRRLMNKM

SEQ ID NO: 2141 - protein, 318 aa, unidentified
  source 1..318: note = Related to NZ_SKCI01000005.1; note = Marimonas lutisalis
MAYVEPLVRNRVPVIFGFKSLSDLLGIEESTLSSIINSSSSFYRSFKIPKRSGGRRQIDAPYPSLLHCQRWIAQTILPSCKVSSVAHAYLPERSILTNARVHCGAQFLLKMDFKDFFPSISERRLVGLFSSLGYSTLVSVYLAKICTLKGATPQGSPASPMLSNVVARRFDLRLVGYARSRGLKYTRYADDIAISGEMDADEVQSFVTTCAVSEGFRINHKKTRYVESGQKMVVTGLDISTGTPRPTRKFRREVEKDVFYIWRYGVAGHVNAEKIYDPSYILRLKGKLDFWAQIEPDHPRLVRCRERFLSAAPDYLPL

SEQ ID NO: 2142 - protein, 383 aa, unidentified
  source 1..383: note = Related to NZ_GL883080.1; note = Asticcacaulis biprosthecum
MNDVDEKVSPPPMSIDLEQWAAFFLDKAKGNQQLISGYLHFLKHCKQKDIPPIFEDNHLSQLLGINIRDLAFYLSGAQGRYRSFHIPKRKGGVRLINTPTPLLLHIQQWILSKILYKLPVSEFAHGGVPGRSIFSNAKAHLGARCVLRIDLKGFFDTVPLALGISIFRAAGYSPNVSRSLALLCFENGCLPQGAATSSTLANLAANSLDKRLSALAKKYGLSYTRYVDDLTFSGRSIGPRFAIAVKSIVEQCRFVVNPRKTQLMRGSSPKFVTGLAVGGQTLRVPRAFRRNVKNQAFQLVKRGVAGHLLATGDNDPLILERVAGKLAFWLQAEPESKTARQLCAALAEYRKTVDTDVSLPQPRRIVPINYPDELFSDIDLFTT

SEQ ID NO: 2143 - protein, 379 aa, unidentified
  source 1..379: note = Related to JAAXEP010000005.1; note = Rhizobium leguminosarum
MNYVNLKVSPPIMPISVEDWRAFFSLSVKRDSKLVEGYIRFIELCENKGLPPIFEERHLAHLIGIPYSNMAYFFSVASGRYRTFTIPKRRGGRREINVPTPLLLAIQQWILHNILYKLPMSEFAHGGVPGRSILSNARAHLGAKAVLRVDLKQFFDSVEFPIGIPIFEAAGYSPKMSKSLALLCFENGRLPQGAATSSTLANLAAISLDIRLSKLANKFELTYTRYVDDLTFSGRSIGPGFISAVEGVVEQCRFVVNAEKTQLARGKSPKFVTGLAVGGDRLRIPRAFRREVRNQAFQITRRGVQNHLEAIESSDPLIIEKVLGQLAFWLQVEPESAMARKLFANLSLYRRTVSTDTLLPPPRRIIQIGTMPIDERRKE

SEQ ID NO: 2144 - protein, 367 aa, unidentified
  source 1..367: note = Related to NZ_CAKLBS010000005.1; note = Sphingomonas sp.
MSDTAEQWRAFFQEHVKQDTALVRGYLAFIDQCIVRNLPIIFEERHLSRLIGVDYRDMAFYFTSSGGRYRQFRIPKRLGGTREINVPSPLLLAIQQWILRNVLYKLPITDAAHGGVPGRSIITNAGGHLGARSVLKMDLRGFFDTILLPRGVAIFESAGYSPHLSRSLALLCFEGGRLPQGAATSPALANLAAVALDGRLEALAQKFGLIYSRYVDDLTFSGHSIGVRFSAIVQDIVEDTGFVVNSDKTRLMRGQSPKFVTGLAVGGGRLRVPRAFKRDVRNRAFQLAKRGVERHLEATESSDPLVLEQVTGQLAFWLQVEPESKTARQLFDALTEYRRGMTTSVKLPDPRRVASIDDSHWRVIRDH

SEQ ID NO: 2145 - protein, 372 aa, unidentified
  source 1..372: note = Related to NZ_CP022528.1; note = Qipengyuania flava
MDMVVEDWSSFFSKEIGKGSNLRGRSRILVDGYMAFIKHCADLGVPPIFENTHLRLLLGLDAAHFGALLTEHPGRYRKFTIPKRSGGERVISSPNPALLHVQKWILRQILDNAEVSDFAHGGIEGRSIVTNAREHLGAEALLKLDIADFYGSVGFGFGISTFQRFGYPRNVALSLTQFCFDGGSLPQGAATSASLANLSCRLLDRRCHGLAKKYNLTYSRYFDDISFSGSFINERLVEIVSEIAMESGFELNKRKTRLLLGKSTKYVTGISVGGDRLRLPKKTRRAIRNSAYLLTKTGDVQGFAESAKDPLIIETVLGQVAFWRHVEPEDDVAEELFQALVELRRETDVPVELPAPWRPSPIPELDLEKVSD

SEQ ID NO: 2146 - protein, 367 aa, unidentified
  source 1..367: note = Related to JAJTGN010000370.1; note = Roseomonas sp.
MSESSSEIALKWLTLWDEKIRHRKWLFDSYSRYVGNLVRNGFPPVFEMRHFAALVGLEETTIAWMLEKNAGFYRTLQIPKRLGGVREISAPSPTLLHVQRWILRNILDKVKPHDCCYGYIPQKSAIENAKQHLGSKTVLKMDLANFFPSIELRRGIAIFRAIGYTGRVSYCLALLCFKDGKLPQGGAASPSISNIVGKRMDLRLSTLASRNNLRYTRYADDMTFSGDEISWKFVAAVELIAREEGFCVNREKTRLIREGRAKVITGVSISSGEARLPRRTVRDIKNEAYNILRNGLEQHAERTHNFDPIAIERLLGRINFWLQVEPTNQTALNYRYRLLEYQKFLDAHGLGLPEDRSDRSLILGGPS

SEQ ID NO: 2147 - protein, 361 aa, unidentified
  source 1..361: note = Related to NZ_JROG01000004.1; note = Sphingomonas sp.
MTDSIRTIASNFQVDVRQWQSFFEENGSRRKRLIAGYLHFIEEMASRGLPPIFEGSHLGKLLGTTPVEFGRLTSAPEHHYRSFTIPKRSGDERTILAPTPLLLHCQRWVDAFILRKFPTHSAAHGYVVGRSNITNARVHIGNAQILCLDIANFFESVGVKKITEIFYEAGYPPNVAFLLARLCSYMGHLPQGGASSPQLSNIVMRDFDATMQTFAEKRGLRFSRYVDDIALSGDRVSDQDIQAVEEALEETGLTLNPHKIRFQRGRKKIVTGISIGSGRMLLPRELRRRFRNQAFLALKNLADAVDADPIALERHLGRFAYWKSVEPDNKRVQMVFDRLNELKNILVKRDTSLSDKDGFLS

SEQ ID NO: 2148 - protein, 345 aa, unidentified
  source 1..345: note = Related to NZ_BEWP01000006.1; note = Gluconobacter kondonii
MIDSIRTIASNFRIDVNDWRSFFEIHGGRQKRLIAGYLAFVEEMATHGLPPIFEGRHLRKLLGATQAEFGSMTSNPESHYRSFTIPKRNGGERTILTPTPLLLYCQRWIDLFILRKIPVHDAAHGYIAGRSNISNAKIHLGSAQLLSVDISNFFENVNAGKVAYVFQSAGYPPAVVFLLTRLCTYKGHLPQGAASSPQLSNLVMRGFDETLQSYANVRGLRYSRYVDDIVLSGRHIGPNDVNAVEEALKQVGLALNPKKIHFQRGRKKIVTGISIGSGRLLLPRELRRRYRNETFLTLKNITAATERDPIALERHLGQLAYWTNIEPGNERALHLLKQVRSVSTC

SEQ ID NO: 2149 - protein, 361 aa, unidentified
  source 1..361: note = Related to JAHVKP010000001.1; note = Qipengyuania aquimaris
MTDSIRSAASSYELDIELWSSFYSKRVERNKQLVAGYLKFIAEMADRGIPPIFEGHHLAKLLGLSLAELSRFTANPEKQYRTFEIPKRSGGAREISTPSPELLECQRWIDWYILRRLPVHDCAHGYVTGRSNRSNAVTHIGSRQVLHLDIRDFFGSIKFRRVISIFLKSGYPRNVAFLLARLCTQGGCVPQGGASSPQLSNVVMYDLDLEIAEFCKSNGLIYSRYVDDIAISGDLIRTTHIAEISRILLESGFLLNEKKTSLQRGRKKIVTGVSIGSGNPKVPRQMRRHFKNQAFIALKNLEHGEQIDEMSDPIHFERCLGQLSYWSMIEPENEKVAKLIDEIKNRLSDLEARLRPSRATR

SEQ ID NO: 2150 - protein, 348 aa, unidentified
  source 1..348: note = Related to NZ_PHSN01000004.1; note = Acidimangrovimonas sediminis
MSKSSEEWRHFFEERGVKDKKALLGYLQYIEEIEAKGLPPIFEMQHLSELIGVNKSYIAAVTKDSSAFYRDFEVKKRSGGVRVISAPHPTLLLCQRWINGEILQHVPIHDSAFGFAQGRSVVDNAKMHISGNHLLGMDIKDFFPSIHIDTVRDTFLGLGYPPNVSAIMARLCCKDGRLPQGAPTSPAISNLVCRNMDKEISDLVKPRSLIYTRYADDISVSGEDLGSDVLGKIEFILKSFGFLVNEGKTRISKGGHKKIVTGISIGTGRPKLPRKEVRSIKADAHALLSYGLLSYIERSEKPDPLVVERLMGRVAFWLQVEPENSTAVKLKSNLQDLSNQMDRGRFRL

SEQ ID NO: 2151 - protein, 351 aa, unidentified
  source 1..351: note = Related to SJNG01000007.1; note = Rhizobium leguminosarum
MTDFNYDEWQSFYHERVKGEHGLQLVRGYLAHAAALSARNLPPIFEFSHLAALLGVDKVTLATICHSPHNYYRTFAIPKRTGGRREISVPRPILMKLQRWILANIVELVNVHDAAHGFLKNRSIVTNARQHLGCNELLKIDILNFFPSISSGKVRSLFAELGYSGSVASALTRICTKNDGLPQGAPTSPAISNLAAKAFDVRIADHCAEEGLTYTRYADDIAISGERIAPHVRGKIIQILADTELKIHPVKSRLFGPKDRKIIAGISISSGKLMPPKDFVRSVRKDVYHVTTKGLLAHMAAIENFDPIYLERLLGRIAFWKHVTKNSDQSLRAEFALKQYMVVSGLAGEFQ

SEQ ID NO: 2152 - protein, 379 aa, unidentified
  source 1..379: note = Related to LMCG01000027.1; note = Pseudovibrio sp.
MNNVKDWEEFLRTHLSHEQQQLEGAIGYVKHLISQSLPPIFGEKHFSILTGVSEIFLRKLADNSAHYYRTFSIPKRKGGFRNISVPSPTLLHVQRWIVANILRKIPVHEAVHGYVASRSVITNAKVHREQESILRIDIKDFFPTIESQQVQALFAAIGYRPELSVLMSDLCCRNNVLPQGAATSPAISNWAFAPLDRKLKELSQKYSYQYTRYADDIFISGKHIHDRIESEVAQILLEQKFRINRAKTRFMGPNRPKILAGVSIASGRLCLPREKKREIKQNAYYIIKYGLFEHCNWKASRDPLILEKLLGKINFWLMVEPKNPTALELQQKLRAISLEFDNSLWEKFEPKRARDIQDIFKPTPAANFEFPSSMRNSKS

SEQ ID NO: 2153 - protein, 353 aa, unidentified
  source 1..353: note = Related to VFTI01000007.1; note = Mesorhizobium sp.
MKQSKYKSVLCGDLVPVQPYSQFLQEKTFRWPLKYAAKRGLIAYAERLESQGLPVILDIQHLAWHSGLEAKFIASVALDNRRYYSTRTIPKRRGGERSLFVPRPFLAGLQRWILDEILSKFGLHQSAFGFVKGRRTLDNARLHAASKCILKVDIRDFFGSIKYASVSDIFLGAGYSPKVSYYLSRICTLDDVIPQGAPTSPSISNIAMRQVDIQIAEFCAQNRLLFSRYADDICLSGDSIPESAFPFLSDCLSKFGLEIAEEKTVLAFEGQKKIITGISISSGELRLPKVYRRELRKTIHYICRFGLKSHKNKAGISDPIYRYRLLGQVEYWLSIEPNNSIALLGREILKESR

SEQ ID NO: 2154 - protein, 353 aa, unidentified
  source 1..353: note = Related to NZ_AYXE01000006.1; note = Mesorhizobium sp.
MIGTIILCGNPVPVQLYSEFLRERTFRWPLKSAAKRGLVVYAERLENKNLPVILDMQHLSWHTGIKSQFIANVVLDGARYYRSKVIPKRRGGERILFVPRPFLAGLQRWILDEALSKLKPHCSAFGFIKGRGIVENAKVHVNSKCIVKVDIKDFFGSVSYVTVYDIFLQAGYSPKISYFLSNICTLNDALPQGAPTSPALSNMAMFQADTQIAEFCSQNALLFTRYADDICLSGDLIPESAFPFLSDCLAKFGYEVAEDKTVLAFAGQKKIVTGISISSGKLKLPKEQRRKLRQAIHYISKHGINSHLANLAILDPIYRYRLAGQIDFWLSIEPDNEVAKLGRRIIRSTISAG

SEQ ID NO: 2155 - protein, 314 aa, unidentified
  source 1..314: note = Related to nan
MELKFSFPPPAIQTLADLADVLNVERWCLGKAINSSRSFYRVFQLPKRSGGYRSISAPVPSLLSVQKIIYKSILSSVVCSDRAHGFLSGRSVRSHAEVHLNGRDFLLTDIENFSDSIKIEDVVSIFSKIGYVHEIASALALLCTLDGSLPQGSPTSPVLSNIYSIRLDNRLSNICSDLNISYSRYADDMVFSGDKMSLGFLRLAQSIINSEGLNLNSKKTMFAKSPSRLIITGISISNRTLKLPKETKRALRFKAHFIARNGILSELERQETADPFYIDRIIGQLCFWSFIEPENRFPKIYKNVIKNIINNNPS

SEQ ID NO: 2156 - protein, 321 aa, unidentified
  source 1..321: note = Proteobacteria bacterium; note = Related to SEDZ01001888.1
MVGRIELPFRTIRGLARQAEVRHSVLRAVLSKIESNYRLVRIPKATPGEYRSLSIPKPTLKQIQRTIYDSALKGIAISSSAHAYAPGRSIVSHARIHAGSTDFIQIDIKEFFPSVSPARVRVLFDELGFGSDVAQALTALCTFQGGLPQGAPTSPSISNAILKHLDEDLDAYAVSRSCRYSRYADDLVISGSSLDVADFEATIALVAKHGFRINDRKSRLMMNPSKVIITGISISSGVLKVPKSFKRQLRQMSHRLLVSPQLTISEDGHVDPFLFDRVIGRLTFWRMVEPEAVFPRRQIELLVSRYPSGVVSSRPERLPFV

SEQ ID NO: 2157 - protein, 311 aa, unidentified
  source 1..311: note = Related to WIEF01000046.1; note = Rhizobium leguminosarum
MFEENLAIGSLTQLSLASGIPSSVISSLVFEREGRYRKHFIAKRDGGARTISVPLPALLQVQKTINKEILSTVDIHDAAVGFRKHHSIIDHVKPHLGNKKFAKFDIKDCFGSIAFNAVFSIYLRITNDPALANSLSELSTDEGKLPQGAATSPSLCNISLKFLDERIFGLCQRLGLTYTRYADDLLISGTKLDLYIYRTLKSYIEDCGFLTNEKSRLMEDPQRLIICGISISESDLKLPKQKKRDIRQAAHFLVNRPIVSESISDELFDPFHVDRVLGRLQFWRFVEPEAEFPIKYIPIIKERIASQIDTQ

SEQ ID NO: 2158 - protein, 347 aa, unidentified
  source 1..347: note = Related to LR701476.1; note = Roseovarius sp.
MTGEDLREWRELYNSRISGNRGRALADGYIKYIESLQALGIPPIFEFSHLADLVGIEYETLAKVASRPQDFYRTFAIPKRSGGIRKIDTPRPILMQIQRWLLDQIVSKSRVSEQAHGFVVGRSIITNARTHLGCRELLKMDLKDFFPSVTASTVHYIFKDMGYPPNVCRALSRLVTLGACLPQGAPTSPALSNIACVELDSNLNNLALKYDLTYTRYADDLTFSGSSIPSDMTSLVANLTSKAGFSTNDKKTILSPAGHRKIVTGISISSGELKLPRTYIRNLRQRIHLLINHGILHPNNDSTAWDPLVLDRLLGMVSFWVSVCPESEAAKRAYSELKNFMMKFQTV

SEQ ID NO: 2159 - protein, 323 aa, unidentified
  source 1..323: note = Candidatus Blautia pullistercoris; note = Related to DXFG01000149.1
MKSDIWKYCNKSHTREFLLSLGLTGKLNLPEEKQLSLLYGLSNHAEEHYQKVQIPKRNGTWRTLYVPDSLLKYIQKQILHKILMQFPVSSCASAYKKGCALKENAAPHSGKPIVLKMDIWDFFGNITFISVYQHAFPGELFPPSVRTLLTHLCCYKDFLPQGAPTSPYISNLVLAPFDHYMENWCKGRNITYTRYCDDLTFSGNFEPEMLIPKVSSFLLRMGFEVNPKKTKVCRQGQQQIITGLIVNEKAQVPKAYRRSLRQEIYYIEKFGLSEHLAHIHSDLTPERYLEKLKGRIRYILQINPQDKVFQEAFTHLNKIHISH

SEQ ID NO: 2160 - protein, 323 aa, unidentified
  source 1..323: note = Related to DWUX01000243.1; note = Candidatus Blautia stercoripullorum
MSSDIWKYCDKNHSREFLLSLNLTGNLNLTKEKQLSLLYGLSNHTEEHYQKIQIPKRNGAWRTLYVPDSLLKYVQKQILHKVLTQLPVSYCASAYKKGCSLKENAAPHTGKSIVLKLDILDFFGNITYISVYQHAFPGELFPPPVRTLLAHLCCYRDFLPQGAPTSPYISNLVLFPFDRYMERWCKNQNITYTRYCDDLTFSGSFEPEAVIRKVSSFLLRMGFEINPKKMKICPQGQRQIITGIVVNEKTQVPKTYRRNLRQEIYYIEKFGLSEHLAHIHLDLTPEKYLEHLKGKLRYVLQINPQDREFQEALARLNRICISH

SEQ ID NO: 2161 - protein, 327 aa, unidentified
  source 1..327: note = Related to DXBG01000050.1; note = Candidatus Blautia pullicola
MNSDLWKYCTGSQCRDFLLSLNLTGNMKLSDEKKLALLYGLANHTQDHYKRVEIPKKTGGFRTLYVPDSVLKYVQRQILSNVLSQFAVSPCATAYQKGHSLICSAKPHLQKPMLLKLDISDFFGSITYISVYQHAFPGEIFPPSVRTLLTHLCCFQDMLPQGAPTSPYISNLVLAPFDKYMEKWCRDRAITYTRYCDDMTFSGSFSPGQVTAKVRGFLGRLGFQLNPEKTRVIHQGQRQIVTGIVVNEKAQTAKAYRRRLRQEIYYIEKFGIYEHLKNIHSSQTPENYLKSLEGKIRYCLQINPQDVQLLNPWEKFKKIKTEGISES

SEQ ID NO: 2162 - protein, 324 aa, unidentified
  source 1..324: note = Lachnospiraceae bacterium; note = Related to JAGZGI010000008.1
MAPSLWKYYTKEQTQDFLLSLHLTENLTHTPTAEMALLYALANHADEHYEKISIPKRNGTKRILHAPDSVLKYVQTQILRQVLREFPVSGYACAYQKGISLRSNAFPHQAQKLVLKLDIQDFFDSISYISVYQHGFPCERIPDSVRTLLAHLCCYKDRLPQGAPTSPYLSNLVMKPFDEYMGNWCRVREIAYTRYCDDMTFSGDFHPKEVLKKAEGFLNRLGFELNHKKTRICSQKNRQEITGIVANEKLQVPKNYRRRLRQECYYIRKFGLENHLSHIEYTGDKQKYLQRLLGKIQYVLQINPEDGEFCEWKRWITNSFFIHD

SEQ ID NO: 2163 - protein, 324 aa, unidentified
  source 1..324: note = Related to NZ_CP030280.1; note = Blautia argi
MNSSLCNYCTENQIQDFLLSLHLTGTLTHSPKAELALLYGLANHAEEHYERVLLPKKDGSKRILHVPDSVLKHVQKQILRQVLMEIPVSSYSCAYQKGSSLSQNAAPHKGQKLLLKLDIHDFFGSISYISVYQHGFPCERIPDPVRTLLAHLCCYKDMLPQGAPASPYLSNLVMKPFDEYMGNWCREREIAYTRYCDDLTFSGDFNPKEVYRKAKGFLNRLGFEVNSRKTHIISQKNRQEVTGITVNEKLQVPKNYRRQLRQECYYIQKFGLENHLKQTGCQDSSAKYLQRLLGKIEYVLQVNPEDMEFQELKKRMKVYRKNDE

SEQ ID NO: 2164 - protein, 322 aa, unidentified
  source 1..322: note = Related to CP022413.2; note = Blautia hansenii
MENSLWKYNTHNDSLDFLRSLHLTDGLNLASDNQLAFLYALSNHAQNHYSQVFIPKKNGKKRKLLIPDYLLKQVQTNILKHILVQFPVSPYATAYKSGCSTVFNAFPHLNQKLLLKLDIHDFFGSITYIDVYQKVFKSELFPPSVRTLLTHLCCYHDALPQGAPSSPYISNLILKPFDNYIGNWCKKQQITYTRYCDDMTFSGDFNPVLVKKKVQSFLMRLGFSLNPEKTHVCSQKNRQEVTGLVVNQKLQTSKEYRRRIRQECYYIKKFGLKDHLAHIGYKKGETHYLQSLNSKINYILYVNPSDSEFLLLKKELSSFFQV

SEQ ID NO: 2165 - protein, 323 aa, unidentified
  source 1..323: note = Related to DVGS01000147.1; note = Candidatus Egerieimonas faecigallinarum
MQNGLWKYCSSAQETEYLLSLDLAGALTASREKQAALLYALSNHAEEHYRRVRIPKKHGGFRTLDVPDRLLKSVQQRILTQVLEHLPVPECARAYRKGVSLLENAEPHAGQRCVLKLDIRDFFGSITYLSVYSLAFPGEFFPPAVRTLLTHLCCLHDSLPQGAPTSPYISNLVMAPFDRYISGWCEARGITYTRYCDDLTFSGDFNPNEVKSAAEGFLLRLGFELNPDKTRFFSSSRRQEVTGIVVNDRPHLSKSYRRKLRQEWYFLKKYGTENHLQHMGSPLTPEKYLQSLKGRILYVLSIDPSDREFADMLRELSAERSSI

SEQ ID NO: 2166 - protein, 330 aa, unidentified
  source 1..330: note = Related to DXGZ01000117.1; note = Candidatus Mediterraneibacter vanvlietii
MHYDIWKYCTKDQWIQYLLSMNLTGNLRLSDEKKLALLYELSNHAEEHYTTIRIPKHSGGLRVIRQPDSLLKYIQRQILFRILVQIPVSDCAFAYRKGFSAADNARPHAGKDTVLKLDIHDFYENITFMAVYQHAFPETLFPPPIRTLLTHLCCYDSILPQGAPTSPCISNLVMRPFDETMKQWCGEQGITYTRYCDDMTFSGHFPGNTAQEVIDKTRGFLLRLGFELNQKKTRLIRRGCRQEVTGYTVNDRVRTSKDYRRKLRQEWYYIRKFGLEEHLKTLLGTSHVTDAQKNSYLQSFTGRIAHVLRTDPQNTVFLAIQKEVKLMRNS

SEQ ID NO: 2167 - protein, 336 aa, unidentified
  source 1..336: note = Related to DXEY01000047.1; note = Candidatus Mediterraneibacter colneyensis
MSQELWKYCTKEQCRDFLLSLRLTGSLCHTDEKRVALLYGLSNHVDEHYHIRKLPKRGGGCRTICEPDPLLKYVQKQILCRVLSQFSPAPCACAYRKGMSLRDNALPHTGKEKVLKLDIRDFFGNITYSSIYQHVFPGTIFPPSVRTLLTSLCCYDSVLPQGAPTSPCISNLVMKPFDQYMENWCAKRSISYTRYCDDLTFSGSFDHVQVIRKVRSFLKRMGFELNTGKTRIITRGSRQEVTGLTVNDSPGVPRPYKRALRQEWHYIKKYGISSHLERTSGISSITLEAKKHYLIQLAGKAGYILQIDPQNLFFQEMRQEILQLIQETGWQDASQN

SEQ ID NO: 2168 - protein, 354 aa, unidentified
  source 1..354: note = Related to NFKT01000023.1; note = Proposed Lachnoclostridium sp.
MGAVLINHDTQIEEKQSEETTDSPAGHGLWKYCTPAQCRDFILSLNLTGSMRLSSEKQLALLYGLSNHTEDHYAKKKIPKRNGGFRTLYAPDPLLKYVQRQILRKVLVQFPVSGCACAYRSGASTRDNALPHVGKEKILKLDIHDFFGSISYISVCQHAFPGTIFPPQVQTLLASLCCYDSMLPQGAPTSPYISNLVMKPFDRYMEEWCRQRDISYTRYCDDMTFSGSFDARKVTAKVRAFLLRLGFELNEKKTRIITQSGRQEVTGLVVNDHIQVSKAYRRRLRQEWYYIRKYGLKGHLARINYSNTEEAYLASFSGKVNHILQCCPEDAYFQEIKLALQSRTDTRTDAATYH

SEQ ID NO: 2169 - protein, 328 aa, unidentified
  source 1..328: note = Related to JAJEQX010000005.1; note = Ruminococcus sp.
MSGDLWKYSTKEHWVRFLLSLGLTEPLQLSESGALPLLYELSNHPEAHYTLHRIPKRSGGVRLLHEPDTLLKTVQRQILKNVLKPQSVSDCARAYRDGVSLKDNASAHTGKALILKLDIHDFFGSISYLNVFQHAFPGTLFPPAVRTMLTALCCCDDALPQGAPTSPYISNLVMKPFDNYTDIWCRQRGISYTRYCDDLTFSGDFDPREVQCKTEMFLLRLGFELNRKKTKVIRSSSRQEVTGLTVNEKVSVPKEYRRKLRQEWHYIEKFGLEEHLKRTAGPDTASPELTKKYLLSLSGRIGHVLQADPESAYFREMASNVKTLLQNG

SEQ ID NO: 2170 - protein, 333 aa, unidentified
  source 1..333: note = Clostridiaceae bacterium Marseille-Q3526; note = Related to JAGTTS010000004.1
MQAVCRGEQDIWKYCTKEQWKEMICSFGLLGDPEIPQEIQMAVLYRFSRHSSCYYREKKIPKRFGGVRCLMIPDSGLKAVQRRILKHILSERPVSSCACAYRKGVGIRDNAAAHVGQESVLKLDIEDFFGSITSSAVYGLAFPGTLFPPPMRGLLTALCCCKGRLPQGSPASPAISNLVMKPFDDSMDLWCRQRGIRYSRYCDDMTFSGSFEPGEVIRKVQSYLSELGMRLNRRKTGVYAKNCRQEVTGITVNQKAQLSKDYRRKLRQECYYCRKYGIESHMERLGAGGQEAEEQVLARLLGKIEYLLSVDPANREFQAQREYFRKLMKTLHT

SEQ ID NO: 2171 - protein, 337 aa, unidentified
  source 1..337: note = Related to NZ_CP085988.1; note = Clostridium sp.
MGETGLWNHCSSRQCVEMILSMKLLGYASLTEEQELSVLYELSNHASRHYREAVIPKRTGGVRHLMVPDSTLKAVQRRILRNVLSGLELSEQAYAYRKGVGIRENAAVHTGQEKILKLDIHDFFGSITSSSVYGLAFPGTVFPPQVRGLLTSLCCLRGRLPQGSPASPAISNLVMRPFDEHMGLWCRERNIRYSRYCDDMTFSGSFDAGKVIRKVSGFLSERGMRLNWKKTGVYGKNCRQEVTGLTVNEKVQLPKELRRQLRMECYYCRRFGTESHMERLGLAESESEEHFLMRLLGRLEYALSVSPGAKEFEQEREYFREQLKALRERRAQKNQKG

SEQ ID NO: 2172 - protein, 350 aa, unidentified
  source 1..350: note = Clostridiales bacterium; note = Related to JAGZWN010000002.1
MSGNLWKYCTTDQWQDYLLSLHLGGSNLPLKKEMAVLYHFSNCQEEHYRKGRIPKKSGGYRTLWIPDGQLAGIQRRLLGRVLETMEVSEYAAAYRKGMGLADGARPHVGKPVVVKMDVKDFFGSIGYLTVYRKAFPPWLFPDPVRGLFASLCCFRETLPQGAPTSPYISNLVMRDFDCSLGSWCRERGIAYTRYCDDLTFSGDFDPGQVIRKATAFLEAMDFSVNREKTRVFTRGARQEVTGLVVNEKLQVPGKTRRRLRQEWHYCRMYGVEEHLKQTGLEESPEHYLERLAGRIQYVLSVDPGNSVFGRMKEEVARELAVRRATGASESFRPGSESDGKIRTKNRQKMD

SEQ ID NO: 2173 - protein, 328 aa, unidentified
  source 1..328: note = Related to HF995414.1; note = Firmicutes bacterium CAG:646
MDERTNIWKYCSREQSMEFLLSLRLTEDFRGAQDHRLAQLYEISNHPQRHYRKAVIPKKTGGNRVLWIPDTELAIIQRRILRNVLEERPVSSYAAAYRRGQGLKDHAECHRNQKLLVKVDIHDFFGSISWMQVYQKAFPWYLFPPSVRNLLTNLCCFREALPQGAPTSPAISNLVMASFDESMGGWCEERQISYTRYCDDMTFSGEFDPGMVIRKVSAYLEQMGMVLNRKKTRVYTRGSRQEVTGLTVNERVQVPRFYRKKLRQEWYYCKKYGVKEHIKALSLEAEPAAYLAGLMGKVQYVLQIDPENREFLQYRKEIQEEITKNYEN

SEQ ID NO: 2174 - protein, 339 aa, unidentified
  source 1..339: note = Related to DXHY01000007.1; note = Candidatus Eisenbergiella stercoravium
MSGELWKYCGKEQEKAFILSLNLLPASMRERMSGEAQLALLYVMSNHVEQHYRETRIPKKGGGSRRLLVPDGMLKGVQRNILHHCLDGRSVSRHACAYRRGLSPVDNAAPHAGGERDKILLKLDIRNFFDSILFPGVYGAAFPESLFPPAAAGLLTHLCCCHDRLPQGAPTSPAISNLVMKPFDDYIGKWCEERKVIYTRYCDDLAFSGRFDAKEVYRKVRGFLAAMGFELNEGKTVIAGRGRKQTVTGLVVNERPRTSAQYRRKIRQEMYYCRKFGVEEHLRMAGLLNGREDAGETSEKADAFLQSLSGRIGYVLQMEPENREFLEYQEICRKMMDSH

SEQ ID NO: 2175 - protein, 342 aa, unidentified
  source 1..342: note = Candidatus Eisenbergiella stercorigallinarum; note = Related to DWUW01000200.1
MSSKLWKYCGTQQEKEFLLSLNLLPSGIRERMSGEAQLALLYSLSNHTQRHYRETRIPKKGGGSRRLLVPDGLLKGVQRNILHHCLDGRSISAHACAYRRGRSPIDNAAPHAGGEKGRLLLKLDIRNFFDSILFPRVYGAAFPESLFPPAAAGLLTHLCCCYDRLPQGAPTSPAISNLVMRPFDDYIGKWCEARQITYTRYCDDLAFSGVFDAGEVYRKVRGMLEAMGFALNSRKTVVANQGMRQTVTGLVVNERVRTSAQYRRKIRQEIYYCCRYGVREHLKAVGSLSGKETEGEAATKEQAFLQSLFGRIAYVLQTEPENQEFLEYRDGCRSMLLEKERG

SEQ ID NO: 2176 - protein, 349 aa, unidentified
  source 1..349: note = Candidatus Eisenbergiella pullistercoris; note = Related to DXDD01000050.1
MSSQLWKYCGTQQEKEFILSLNLLPAGMRERMSGEAQLSLLYALSNHTERHYRRARIPKKSGGSRRLLVPDGLLKSVQRNILRHCLDGRSVSAHTCAYRRGLSPIDNAAPHAGGEKDKILLKLDIRDFFDSILFPRVYGAAFPESLFPPAAAGLLTHLCCCYDRLPQGAPTSPAISNLVMKPFDEYIGKWCEARQISYTRYCDDLAFSGVFDVGEVYRKVRGMLEAMGFELNRKKTVVARQGMRQSVTGLVVNDRVRTDAAYRRRIRQEMYYCTKFGVREHLKVAGKPDGMETEAEREAETAAEEYAFLQSLRGRIGYVLQMEPENREFLEYLEEWKRLWEELENRERK

SEQ ID NO: 2177 - protein, 345 aa, unidentified
  source 1..345: note = Candidatus Eisenbergiella merdavium; note = Related to DWWS01000044.1
MSSNIWHACTDRQVREFILSLNLLPDGSREELSGEKQLALLYALSNHPERHYRKVRIPKRSGGSRRLLVPDGLLKGVQRNILHHCLDGRSVSEHACAYRRGVSPMAGAAPHAGGGKDKVLLRLDIRDFFDSILFPRVYGAAFPESLYPPAAAGLLTHLCCFYDRLPQGAPTSPAISNLVMKPFDDYMGKWCREREITYTRYCDDLAFSGAFDVGEVYRKVRGLLEAMGFELNSGKTAVLKQGMRQTVTGLVVNERVRTSAQYRRRLRQEIYYCRRYGVREHLKAVGRLTGAETEADVSALETAYLCSLLGRIGYVLQTEPENAQFLEYREICRSLIEGADAAEWG

SEQ ID NO: 2178 - protein, 361 aa, unidentified
  source 1..361: note = Candidatus Eisenbergiella intestinipullorum; note = Related to DWWH01000066.1
MSGRLWKYLTPQQEREFILSLNLLPASCRKRMSGEAQLALLYAISNHVERHYRKVRIPKKDGKSRRLLVPDGLLKGVQRNILRHCLDGRSVSEYACAYRRGLSAADNAAPHAGGGKDKLLLKLDIRDFFDSILFWQVYGAAFPGSLFPPAAAGLLTHLCCCGDRLPQGAPTSPAISNLVMKPFDEFMGAWCRQRQIVYTRYCDDLTFSGAFDPKAVYHKARHLLEAMGFALNAEKTALRNRGMRQSVTGLVVNERVRTGVPYRRRIRQEMYYCRKYGVGEHLQAVGRLTGTETQEEAAEAERAFLCALLGKIGYVLLLEPENREFLEYREICRGMQAEQEKASCPPACGEREQKRRGGKEK

SEQ ID NO: 2179 - protein, 328 aa, unidentified
  source 1..328: note = Related to AP025576.1; note = Lachnospiraceae bacterium
MGNTQLWKYCTTRQCQDFILSLRLIPGGEKMSREKQLACLYTLSNQGIKNYRRVTIAKKGGGSRQLLVPCGLLKAVQRNILHHVLDERPVSPCALAYRKGTDIRANASAHLGKNKVLKLDISHFFDSILFPRVYGAAFPDTLFPPAAAMLLTSLCCCKERLPQGSPASPAISNLVMRPFDEYMEGWCREREITYTRYCDDMTFSGSFDAPALITKVRSYLEAMGFSLNEKKTKLLTEGVRQSVTGIVVNEKLQVSRDYRKKLRQEVYYCRKYGIEAHLARIEAAEGIRWDKERYIGSVLGRLRFVLQINPQDEEFARYCRDWKEQYLG

SEQ ID NO: 2180 - protein, 327 aa, unidentified
  source 1..327: note = Related to NZ_MCGI01000005.1; note = Eisenbergiella tayi
MGNSPLWKYCTREQCQDFILSLRLIPGGEKMSREKQLSCLYTLSNRGSRNYRRVTIDKKDGGSRTLLVPCGLLKGVQRNILHHVLDERPVSPCARAYRKGTDIRGNASCHLGKRLVLKLDISHFFDSILFPRVYSAAFPETLFPPAAAMLLTSLCCCNERLPQGSPASPAISNLVMRPFDIYMDGWCRERGIAYTRYCDDMTFSGDFDAAALCSKVRSYLEAMGFTLNEKKTKLLTGDVRQSVTGIVVNDKLQVSREYRKKLRQEVYYCKKYGIDAHLERVEADTGIRWEKELYICSVQGRLHFVLQVNPQDDEFAGYCREWKELFM

SEQ ID NO: 2181 - protein, 328 aa, unidentified
  source 1..328: note = Related to NZ_QVLV01000005.1; note = Eisenbergiella sp.
MSNSQLWKYCTKEQCQDFILSLDLVPHSAGMSREKQLACLYMLSNRGAENYHKEILTKKDGGTRTLMVPCSLLKAVQRNILHHVLEQRPVSDCARAYRKGTDILANAGPHTGRKQVLKLDISHFFDSILFPRVISAAFPDTLFPPAAAALLANLCCCRERLPQGSPASPAISNLVMRPFDESMRRWCEARQIVYTRYCDDMTFSGDFDPAAVYHKVKSYLEAMGFSLNEKKTKLLKDGVRQSVTGIVVNEKPQVSRDYRKKLRQEIYYCMKYGVTGHLERLREKTGNAVEEQRYICSVLGRIQFVLQVNPEDREFAEYCRIWKERFVK

SEQ ID NO: 2182 - protein, 362 aa, unidentified
  source 1..362: note = Related to RAYB01000053.1; note = bacterium 1XD21-70
MDIGESGGQGSAWTVSRKDLWRYCTDAHCQEMILSFRLLGENGWPREKVMACLYALSNHSERHYERISIPKKDGSRRILLAPDPLLKHVQKNLLRHVLEGLSIAGCATAYHRQAGIICNASGHVGKPLVMKLDIRDFFGSITFPMVLCHAFPVKYFPPPVGVLLTSLCCCGEYLPQGAPTSPAVSNLVMKPFDEYMAGWCRERKISYSRYCDDMAFSGDFDAWEVRQKAENFLRAMGFELNRKKTKVLPQNMRQTVTGLVVNERVQTSAQYRRKLRQELYYCRKFGVEGHLRQSGEAKHFLLPDGSLDKQRYLQALAGKVRHVLLTRPEDAWFLEAKGWLLTERKRQEGRQSRREMGTENGI

SEQ ID NO: 2183 - protein, 353 aa, unidentified
  source 1..353: note = Clostridiaceae bacterium; note = Related to QXWS01000023.1
MKETAISSSKDLWHYCTEDHVRTMLLSFRLLGDNDWPEEKILACLYSLSNHTQDHYKRIQIQKKSGGTRTLLAPDPLLKYVQRNLLHHVLDGLSLADCATAYRKNRDDLYKRGGQEDRDGSAYKECFGIVPNARIHVGKPLVMKLDIVDFFGNITFPMVLHQVFPARMFPPAVGNLLTSLCCCGEYLPQGAPTSPAVSNRVMKPFDEFMEAWCRERGISYSRYSDDLTFSGDFSPKEVRGKVKGFLGAYGFELNRKKTRILSLGTRQKVTGLVVNEKAQTSKEYRRKLRQEIYYCRRFGVKEHLQFQNKGEPACEADQERYLYRLLGKVNYVRMTRPEDKWFLEARQWLKGML

SEQ ID NO: 2184 - protein, 322 aa, unidentified
  source 1..322: note = bacterium D16-56; note = Related to RAYY01000002.1
MLLSFHLLGENDWSEDKILACLYALGNHGEKHYKKIRIPKKSGGFRILLAPDPLLKYVQKNILHHVLEGFSVSDQATAYRKKGNPANAVCGCVENASLHRGKPLIMKLDVENFFGNITFPMVLHSAFPIQYFPPEVGKLLAELCCYLEYLPQGAPTSPAISNLVMKPFDEYMAEWCRNRGIVYSRYCDDLTFSGDFDPEEVLKKSEGFLKAMGFELNRKKTRVLSKASRQTVTGLVVNEKVQPSREYRRKLRQEIHYCRKYGVEEHLRRRGTQGMLFAGKEDDRGKYLYSLLGKINYVRLTRPDDTWFLEAEKWVREQLSER

SEQ ID NO: 2185 - protein, 335 aa, unidentified
  source 1..335: note = Related to CP069520.1; note = Enterocloster bolteae
MARTDLWKYCSAEQCREMMISFRLIGAGDWPPEKIMGCLYALSNHAEKHYQRVNIPKRSGGFRTLLVPDPLLKNVQRNLLHHVLDGFTVSDSAAAYRKGASVAANAGKHQGRKIVMKMDIEDFFGSITFPMVLHHAFPTAYFPPAVGVMLASLCCCHDRLPQGAPTSPAISNLVMKPFDEYMEAWCGEREIVYSRYCDDMTFSGVFDGSEVKGKVYGFLRSMGFEPNLRKTRILTRGTRQVVTGLVVNERVRVPAPYRRRLRQEIYYCMKYGAKEHLTRTGRQAYLNDGDGGTRRYLESLLGKTAYVLLASGDGDAWFREAQVKLREMLGQDMCL

SEQ ID NO: 2186 - protein, 332 aa, unidentified
  source 1..332: note = Related to JAKNTH010000001.1; note = Enterocloster sp.
MAQADLWKYCSTEHCREMLLSFRLLGTRDWPPEKIMGCLYALSNHAQRHYRKVRIPKRSGGYRTLLVPDSLLKEVQRNLLHHVLDGFAVSASAAAYRKGASAAANAGIHQGRKIVMKMDIEDFFGSITFPMVLHHAFPAAYFPPPVGAMLAALCCCHDRLPQGAPASPAVSNLVMKPFDEYMEAWCGERDIAYSRYCDDMTFSGVFDTAEVKGKVYGFLRSMGFEPNQRKTRILTRGTRQTVTGLVVNDRVQVPAPYRRRLRQEIYYCLKYGAEEHLRRTGRDAYLKEGDAGVKRYLESLLGKTAYVLLAGGGDAWFREAQVRLKSMVRQGI

SEQ ID NO: 2187 - protein, 326 aa, unidentified
  source 1..326: note = Related to DWYS01000122.1; note = Candidatus Enterocloster faecavium
MGDGEIWKYCGKEQAVEMILSLQLLPSSGWQRERILACLYALSNHPEEHYHPVWIPKRRGGYRRLDVPDPLLKQVQRNILHHVLEGFSVSPAAAAYRKNRCAADGAAVHIGKPLVLKLDIHDFFGSITFPMVLGYGFPAAYFPEEVRVLLASLCCCRQRLPQGAPTSPALSNLVMKHFDEAMAAWCGPQNIAYTRYCDDMTFSGDLNPGAVIGRVRGFLETMGMELNHSKTAVCSQFSRQTVTGITVNQVCQLPREDRRKLRQEVYLCLRYGTGESRPADSVRRLEQILGKVSYLLQVRPDDRWFLEQREALKEMLKKERGQVYES

SEQ ID NO: 2188 - protein, 326 aa, unidentified
  source 1..326: note = Related to DWWB01000077.1; note = Candidatus Enterocloster excrementigallinarum
MGKGDVWKYCEKNQITEMILSLELLPSSRWERDQILSCLYALSNHPEEHYHPVWIPKRSGGFRRLDVPDPLLKQVQRNILRHVLEGFSVSPAAVAYQKNRCAADGAVIHRGKPLVLKLDINDFFGSITFPFVLGYGFPAAYFPEEVRVLLASLCCCRQRLPQGAPSSPALSNLVMRSFDDIMVSWCAAQGIVYTRYCDDMTFSGDFNPALVIGRVRGLLEPMGMELNRKKTEVCSQADRQVVTGITVNQVCQLPREDRRKLRQEVYLCLRHGAEGIEPAASVRRLERILGKVSYLLQVRPDDRWFLERRDMLKDMLRKERKRVYES

SEQ ID NO: 2189 - protein, 323 aa, unidentified
  source 1..323: note = Related to JAJCIC010000013.1; note = Lacrimispora sp.
MPEHLGLWKYCDKEQCKDMLLSFRLVGSDSWTDGKIIACLYALSNHAKEHYHKTELPKKRGGRRILMVPDPLLKQVQRNLLHHVLEGFSVSPAACAYRKGASPLANASLHTGKRLVLKLDIRDFFGSITFPMVLHHVFPSTYFPPAVGTLLASLCCYRDRLPQGAPTSPAVSNLVMKPFDDHMLEWCRSRRITYSRYSDDMTFSGDFDPGEVIRKTESFLRAMGMELNREKTRVCAAGGRQSVTGIVVNEKPGLPRDYRRALRQELHYCMIYGVEEKSAACLRSLLGKTVYLLSVNPEDQWFQGAEAFLREELKKIEEKGEEK

SEQ ID NO: 2190 - protein, 317 aa, unidentified
  source 1..317: note = Related to DWWT01000008.1; note = Candidatus Enterocloster excrementipullorum
MNNMDIWKYASAEQYKDMLLSFALLSGPDWPPKRIMACLYALSNHPEAHYHALSVPKKSGGVRRLLAPDPLMKQVQRNLLHHVLEGFSPSEAAMAYRRGVSAKDHAARHCGQRVVLTLDIQDFFDSITFPQVLARCFPIIYFPRPVGVLLASLCCAYERLPQGAPTSPAVSNLVMKPFDEHMLAWCGERDITYSRYCDDMTFSGDFDFREVKGKAEGFLEAMGMALNRKKTRVSFRGGRQAVTGLVVNERPGVPREYKRRLRQEIYQYRKFGLPGTETDSEKYRARLLGKIRYVLSVHPEDAWFAQAEQELKRRNPS

SEQ ID NO: 2191 - protein, 328 aa, unidentified
  source 1..328: note = Related to NZ_PGET01000001.1; note = Clostridium celerecrescens
MYHTDLWKYCTKEYCRDMLLSFRLLGNTSWPDQKVMACLYAFSNHTERHYRTVRIPKRDGRQRSLMVPDYMLMRIQRNILHHILDGYAVSSSATAYHKGAGVVSNARVHTGKHVVVKLDIKDFFGSISFPMILKSVFPVRYFHPAVGTMLTALCCCNDFLPQGAPTSPAVSNLVMKHFDESINKWCENKGISYTRYCDDMTFSGDFNPGLVIRKVSGFLNSMGFELNETKTRILYRNGRQAVTGIVVNEKLQVSLDYRRKLRQEIFYCQKYGVNSHLKRIGNAAGIPENQYLLSLLGRIQYILLVNPEDQWFQEAEQKLLAVLGRKSE

SEQ ID NO: 2192 - protein, 328 aa, unidentified
  source 1..328: note = Related to NZ_AZUI01000001.1; note = Clostridium indolis
MYQTDLWKYCTPDYCRDMLLSFRLLGNTRWPDQKVMACLYAFSNHAERHYGIVLIPKKNGKSRKLLVPDYMLMKIQRNILHHILDGYSVSGCATAYHKGAGVVSNAAVHRGKNVVVKLDIKDFFGSISFPMVLSSAFPVQYFPTSVGTMLTALCCCNDFLPQGAPTSPAVSNLVMKHFDESINKWCEGKGISYTRYCDDMTFSGDFNPGLVIRKVSGFLNAMGFELNETKTRILYRNGRQAVTGIVVNEKLQVSRDYRRKLRQEIFYCLKYGVKSHIEKLGNDARISEDQYVLSLLGKIRYILLVNPEDHWFQEAEEKVLAVLGRKAG

SEQ ID NO: 2193 - protein, 332 aa, unidentified
  source 1..332: note = Related to NZ_JHWJ01000001.1; note = Clostridium aerotolerans
MYGTELWKYSTPEHCREMLLSFKLLGEDWPDQKAIGCLYAISNHTERHYHTVLIPKSDGTKRKLLVPDDLLKMIQRNITKHVLSEFEVSSCAAAYRKGTSVLTNASVHTGKKLVLKLDIEDFFGSITFPMVLNGAFSGRYFPPSVGTMLTALCCYRDYLPQGAPSSPAISNLVMKPFDDYMKVWCEKRNISYTRYCDDMTFSGDFQPGPVIRKVSGFLNDMGFSLNQGKTRIISWGRRQTVTGIVVNRKPKVSPEYRRKLRQEVFYCLKYGAKSHIMVTGREEPDEERERRYLRSLLGKIQYLLFINPDDIWFAKAKGKIQSILETSYACLL

SEQ ID NO: 2194 - protein, 326 aa, unidentified
  source 1..326: note = Related to NZ_MCIA01000032.1; note = Lacrimispora algidixylanolytica
MYQTELWKYSTKKHCQDMLLSFQLLGEDWPDQKVIACLYGVSNHTERHYHTAMIPKSDGTKRQLLVPDDLLKMIQRNIARNVLSGFELSSCASAYCKGTSVLKNASIHTGKRLVLKLDIEDFFGSITFPMVLNGAFSSKYFPPTVGTLLTALCCYHDYLPQGAPSSPVISNLVMKPFDDYMKVWCEEKNISYTRYCDDMTFSGDFQPGHVINKVSGFLDAMGFALNREKTKILSSGRRQTVTGIVVNERPHVSPDYRRRLRQEVYYCLKYGVKSHITMTGREEPKPEIERHYLFSLLGKINYLLFINPQDLWFKQAEGKIRSILDH

SEQ ID NO: 2195 - protein, 336 aa, unidentified
  source 1..336: note = Related to NZ_QJKD01000014.1; note = Hungatella effluvii
MHEPDLWKYCTAEHCREMLLSFRLLEGEEWTDDKVISCLYAVSNHTEKHYNRLRIPKKGGGVRQIQAPDLLLKTIQRNILHHILEGLELSPCAAAYHRGASIRDNAARHTGKNVVLKLDIKDFFGTITFSMVQQRAFNSRYFPVPVGTLLTSLCCLRDTLPQGSPASAAISNLVMKPFDEYMDGWCRERDIVYSRYCDDMTFSGDFAAAEVIGKVKGFLDAMGFELNRSKTKVLTRHTRQTVTGIVVNDRVSVPAAYRRALRQDIYYCRKFGVREHIRSRSDKKYLELGEAGEVKYLMSLLGKIGFVLSVTPGDVWFMEAEEAVKTLLKEYQGQAS

SEQ ID NO: 2196 - protein, 337 aa, unidentified
  source 1..337: note = Related to NZ_WNME01000006.1; note = Hungatella hathewayi
MHEPDLWKYCTAEHCREMLLSFHLLEGEEWTDEKVISCLYAVSNHTEKHYSRLRIPKKGGGVRQIQAPDPLLKAIQRNILHHILDGLELSSCAAAYRRGASIWENAACHTGKMVVLKLDIKDFFGSITFPVVHRSAFNSRYFPASVGTLLTSLCCLNDCLPQGSPASAAISNLVMKPFDEYMDGWCRERSITYSRYCDDMTFSGDFSAAEVIRKVKGFLGAMGFELNRSKTKILTRRTRQLVTGIVVNDKVSVPASYRKEVRQDVYYCMKFGVQAHLERRGEEKYLKMGPAGEVRYLTSLLGKIGFILSAAPGDIWFTEAKEAVKSLLREAAEPVPE

SEQ ID NO: 2197 - protein, 333 aa, unidentified
  source 1..333: note = Related to NZ_QSGP01000002.1; note = Enterocloster aldenensis
MGEPGLWKYCTAGHCREMILSLRLLEGEEWTERRVLSCLYAISNHTEKHYNKQKLIKKGGGVRHILAPDPVLKTIQRNILHHVLEGLEVSPCAMAYRKGASVRLNAACHMDKQVVLKLDIKDFFGSITYPMVHRGAFNSRYFPVPVGTLLTSLCCCQDRLPQGSPASAAISNLVMKPFDTYMEGWCRDRGIVYTRYCDDMTFSGDFRVSAVYGKVNGFLGAMGFELNQSKTKVLTRHVRQTVTGMVVNDKVQVPLPYRRALRQEVYYCLKYGVKEHLRHRGETAYLAMGEEGELRYLQSLCGRIGFVLSADPEDKWFREAADLVTGNIKTYLK

SEQ ID NO: 2198 - protein, 331 aa, unidentified
  source 1..331: note = Related to FOZH01000006.1; note = Enterocloster citroniae
MYDTDLWKHCTPRHCREMILSFSLLEGEEWTDERIISCLYAVSNHTEQHYTCLKIPKKGGGVRRVMAPDPLLKTIQRNILHHILEGYEIPCCATAYHKGASIRGNAMVHLGHEVVLKLDIKDFFGSITFPMVGQRAFGRQYFPEPVGVLLTSLCCYNDRLPQGSPASAAVSNLVMRPFDRYMAAWCGQREVIYSRYCDDMTFSGDFDVSEVMNKANGFLGAMGFELNRSKTKVLTRQERQTVTGIVVNEKLQVPSSYRRELRRDVHYCLKYGVQEHLKRRNERTYLDMGKDGETRYLMSLSGKIRFVLSVNPQDRWFREADDRVKRLLRYM

SEQ ID NO: 2199 - protein, 333 aa, unidentified
  source 1..333: note = Related to NZ_FNWC01000007.1; note = Coprococcus sp.
MDNQRLWQHRSKEEDKEAILSLNLLERANVPKEKTLKCIYAVSNHIEEHYREVFIPKKKGGRRKLLVPDYLLHTMQKNILRIILSEEKVSKYAKAYCPGRRIRDNAFAHVGAETILELDIKDFFENITYIMVYQCVFSGEYYPPAVRTLLTQLCCYRDYLPQGAPTSPMISNLVMFSFDQYMGKWCEEREICYTRYCDDMTFSGKFDVREVKQKVRSYLQVLGFELNLKKTKVLKQYNRQSVTGIVVNEKAQVSKTYRRDVRQAVYYCGKYGVQEHLQRTGAQMWLQKGEERYLQHLMGKVNYILQVNPEDCTFQEVRKNLLRIQRQCKGGKP

SEQ ID NO: 2200 - protein, 319 aa, unidentified
  source 1..319: note = Lachnospiraceae bacterium; note = Related to JAGZOR010000071.1
MWKYCTDEEAIRSFHLTDGLRCKEGKEIQTLFAVSNHVEEHYHIAYIPKKKGGRRKLLVPDVILGRIQKNILRNILAERKVSSYAKAYVKGVGIVENALPHSHAEIILKLDIEDFFENITYLMVYQKAFPEKYFPPAIRTMLTHFCCYNDYLPQGASTSPIISNLVMYSFDEYMGKWCEERKISYTRYSDDLTFSGNFDVKEVKHKARSFLEKMGFSLNEKKTRVLKPYQRQTVTGIVVNEKPNISKNYKRQLRQEIYYCEKYGVAEHLRQKGICDKEEITYLKELLGKVNYVLQINSDNMEFREAREKINKMLLKVKG

SEQ ID NO: 2201 - protein, 338 aa, unidentified
  source 1..338: note = Related to NZ_OIWX01000001.1; note = Blautia sp.
MAGNDLWKYCEAKEAEDVLRSFHLLEGTGVSDEKYLACLYAVSNHTEEHYHTAVIQKKNGGMRKLSVPDTLLRTIQRNIVKNVLCERSVSQYATAYRKKASVMENARPHVGAEMVMKLDIKDFFDCITFQMVYQYAFPAIYYPPSIRMLLTSLCCRNDCLPQGAPSSPAISNLAMRSFDEYMGAWCGERQMQYTRYCDDLTFSGTFDQKEVKQKVRNFLHVLGFELNRKKTRVQDQSHRQTVTGLVVNEKMQVSREYRNQLRAEIYYCQKYGVTSHLNKMGNPAWMREDEPDGKRYLQYLLGKINYVLAVNPHDGHFCKKREELSLMVREISTRSNTL

SEQ ID NO: 2202 - protein, 339 aa, unidentified
  source 1..339: note = Related to NZ_CP035945.1; note = Blautia producta
MAERDIWRYCTAEQVEEVLRSFRLLQGTKVRGDRYMACLYAVSNHIEKHYHIAVIPKKNGGTRKLSVPDILLRTIQRNIVKYVLPERFVSQFATAYRLNASVLMNACPHVGTEQVLKLDIRDFFHSITFQMVYQSAFPAVYYPPAIRMLLTSLCCFMDCLPQGAPSSPAISNLVMKPFDEYMGSWCEERQIQYTRYCDDMTFSGNFDVKKLKLKVKNYLYKMGFELNEQKTKVQRQYQRQIVTGIVVNEKPQVCREYRRQLRAEIYYCGKYGVESHLQRMGISGGGSESPQDPERYAQHLLGKINYVLSVDPGDKYFLEKRDEILLLVKEFRGDSIISK

SEQ ID NO: 2203 - protein, 329 aa, unidentified
  source 1..329: note = Lachnospiraceae bacterium; note = Related to DNJM01000030.1
MSSGQLWKYCTSDQVKEVLLSLHLLDGVPIKEEKRLACLYAVSNHTEKHYHSAAIPKKNGQVRRLFVPDPLLMRIQKNILRHVLAEEAVSEYATAYRAGSAVIENVRPHVGKKKILKLDIQRFFDHITFPLVYQYAFPAVQFPPAIRRLLTELCCYKDYLPQGAPTSPAISNLVMKPFDEFIGAWCAKRKITYTRYCDDLTFSGEFDEKEVKCKVRSYLEAMGFDLNRKKTRLARQCSRQTVTGIVVNEKPQVNREYRRQLRAELYYCRKYGVKSHLERIYGQKRQIEDEDCKTYLRQQLGKVNYVLQVNPADPYFFQEVARLKKELKE

SEQ ID NO: 2204 - protein, 363 aa, unidentified
  source 1..363: note = Lachnospiraceae bacterium M18-1; note = Related to KE159610.1
MIMGGKDLWKYCTAEQVRITLRSLHLLDGVHMEEEKYFSCLYAVSNHPELHYRQASVPKKGGGVRNLLVPDHLLCRIQKNILRHVLADFPISDYAMAYKTGTAIVENAKPHAGMKEILKLDIRNFFDSITYFQVYRNAFPAVYYPPPIRTMLASLCCCRDSLPQGAPTSPAVSNLVMKPFDEYLGAWCEERGIRYTRYCDDLTFSGKFDRREVQNKVRGFLAAYGFELNEKKTRLQKAHQRQTVTGIVVNEKPQVSREYRRKLRAEVYYCSKFGVESHLQRYGGEGPQKESVPREAGEACVRYLQKLQGKINYVLQVNPEDPEFCRAKELVKEMLEARGCSAETEKKSSERGENDDRKSKKVI

SEQ ID NO: 2205 - protein, 351 aa, unidentified
  source 1..351: note = Related to QXWX01000071.1; note = Lachnospiraceae bacterium
MKGKDLWKYCTSEQVHAVLRSLHLLDGVRVEEEKYFSCLYAVSNHPERHYHPASVPKRGGGTRKLLVPDHLLCRIQKNILRHVLADFPVSDYAAAYKPGTAVTENAKPHVGAKEILKLDIRNFFDSITYLQVYRNAFPAVYYPPPIRTMLANLCCCRDSLPQGAPTSPAISNLVMRPFDEYMGAWCRERGIRYTRYCDDMTFSGEFDRREVKNKARGFLAAYGFELNETKTRLQKAHQRQTVTGIVVNEKPQVSREYRRKLRAEVYYCGKFGVESHLQRCRGEEGTKEISREMEGACVRYLRQLLGKINYVLQVNPEDAEFCRAKELAREMLAARSCPADFPDAKELQKNK

SEQ ID NO: 2206 - protein, 337 aa, unidentified
  source 1..337: note = Related to NZ_RHJS01000002.1; note = Schaedlerella arabinosiphila
MGGKDLWKYCTQEQVRAALRSLRLLDGVHIREENYFSCLYAVSNHPEQHYHPASVPKKGGGVRRLLVPDPLLCRIQKNILRHVLAEFPISEYAAAYKPGTSIVENAEPHVGAKELLKLDIRHFFDSITFFQVYGQAFPSTCYPPAIRTMLANLCCCRDSLPQGAPTSPAVSNLVMKPFDEYMGNWCQERGIGYTRYCDDMTFSGEFDRREVQNKVRGFLAAYGFELNEQKTRVQKAHQRQTVTGIVVNEKPQVSRAYRRKLRAEIHYCSKYGVESHLQRRREGQAPEKERLMEADCVHFLQQLLGKINYVLQVNPEDTEFCRAKEIVKEMLAERASL

SEQ ID NO: 2207 - protein, 340 aa, unidentified
  source 1..340: note = Proposed Wansuia hejianensis; note = Related to CP060635.1
MTTYLSRCASREYDLWKYCTKEQIHEMLLSFRLLEGAPVREEKKLACLYAVSNHVRQHYHTAQIVKQSGGVRRLLIPDALLGTIQRNLLHHVLDGFSVSAYATAYKKKATVLDNARAHVGRERIMKLDIENFFSSITYPLIYQSVFPAIYFPPAVRRMLTEFCCYEEYLPQGAPTSPAISNLVMKSFDNYMGAWCEEREINYTRYSDDMTFSGLFDEKKLKRKVRNYLLAMGFELNEKKTRLLGRHTRQTVTGIVVNEKPDVGRAYRRKVRAEVYYCKKYGAVEHLRRCEKKEWMNGGQPDAARYLQHLLGKIQFVLQISPEDAQFRAAREDVQSMMRNI

SEQ ID NO: 2208 - protein, 337 aa, unidentified
  source 1..337: note = Related to CP084061.1; note = Blautia sp.
MTTTLSNYDNDLWKYCTKEQIKDMLLSFRLLQGAPVREEKELACLYAVSNHIKKHYHTAQIPKRNGSVRRLLVPDALLNTIQKNLLHHVLDGLSVSVYATAYKKKTTVLDNALSHVGQEQVMKLDIENFFENITFPLVYQSAFPAIYFPPAVRRILAELCCYEDYLPQGAPTSPTVSNLVMKSFDNYMGAWCEERGIHYTRYSDDMTFSGVFDEVELKNKVKNYLLTMGFVLNEKKTKLLGKHTRQTVTGIVVNEKADVGRAYKREVRAEVYYCKKYGVMEHLRRCNKKEWMTEGESDTVRYLRHLLGKIQFILQISPEDVQFREAREDIRRLLRDI

SEQ ID NO: 2209 - protein, 332 aa, unidentified
  source 1..332: note = Related to NZ_LT574838.1; note = Proposed Bariatricus massiliensis
MTDQNLWKYCTREQSNEMLLSLGLLEGTGVKPEAALACLYAVSNHTGRHYRTAQIQKRGGGVRRLLVPDALLNKIQRNLLHHVLDGLPVSTYATAYRKRMSVVDNAAPHVGQALILKLDIKEFFENITFLMVYQSAFPAVYFPPAVRKLLAELCCYEDYLPQGAPTSPAVSNLVMKPFDEYMGSWCGERGICYTRYCDDLTFSGSFDWREVKHKVAGYLRVLGFELNEKKTRILKPHVRQTVTGIVVNDRLQTARSYRRQVRSEVYYCTKYGVEAHLRHLGNKGESYGDSRDVMHYLQHLLGKVHFILQASPEDEEFRRAKEEIERLMKEQE

SEQ ID NO: 2210 - protein, 337 aa, unidentified
  source 1..337: note = Related to NZ_CABLBR010000003.1; note = Ruminococcus gauvreauii
MSGNDLWKYCTAEQEKEMLISFRLLDGIQMKEEKYLACLYALSNHADEHYHAAAVKKRGGGVRRLMVPDALLGAVQRNILHHILDGITPANASKAYRRGVTIADNALPHVGAKQIVKLDIRDFFENITYLLVYQYAFPAVYFPPAVRTMLTALCCCRECLPQGAPTSPAVSNLVMKSFDQYMESWCCRRGIRYTRYCDDMTFSGSFDAKELKNKVKSYLQVMGFQLNEKKTRVLKRHCRQTVTGIVVNEKPQVSRDYRRNLRSEIYYCLRYGAKEHLSRLGNSKWMTEEGPDTERYLRHLLGKINHVLQVNPEDEYFLWAREKVREISSRATKDEIR

SEQ ID NO: 2211 - protein, 397 aa, unidentified
  source 1..397: note = Related to GL945165.1; note = Lachnospiraceae bacterium 1_4_56FAA
MAGQDFWKYCTTEEIGRTLRTFDLLKGMDVPEEAYLPCLYTVSNQIETHYHPVVIPKKSGGRRKLLVPDALLRTIQRNLLHHVLEEFQISEFACAYKKGTSIVDNARPHVGAKLVLKLDIQDFFDQITWILVYQNAFPGTHFPPAIRKMLTEFCCVRDRLPQGAPTSPTVSNLVMRPFDVHMGEWCREREIRYTRYCDDLTFSGAFAPEEVIRKVRGFLQVYGFELNRKKTRVLGRGNAQSVTGIVVNEKAQVSRAYRRKLRQEVYLFDRYGIKTEEGPKNDEKERMRLLGKMRYVLSVNPEDVWFGNMYKKWKVGADSRKRTEEMQSISEEGGVAMKARVNEGCISCGACVATCPEVFRFDENDLAVAYADVTDETEAQAKEARDGCPVDVIDLEA

SEQ ID NO: 2212 - protein, 333 aa, unidentified
  source 1..333: note = Related to WQPN01000006.1; note = Clostridium sp.
MSDLWKYCTAEQCREFLLSLELVGDSGWPDDKKLACLYAVSNHVEKHYHTAVIKKRSGNERRLLVPDPLLKGIQQKILHNVLEDYAVSRYATAYHKGAKLKDNAAPHVGKEKILKLDIENFFENILFKQVLQSSFPKKYFPPAVGTMLAYLCCYYDYLPQGAPTSPAISNLVMKPFDESMGAWCEERGISYSRYCDDLTFSGDFDAEMVKRKAGAFLGEMGFQLNRKKTRVISRGQQQNVTGVVVNCKPQVSKEYRRKLRQEIYFCRKYGIRGHLERIGDRKYLDLGEAGIERYRLRLIGKVNYVLQVNQDDRDFIGCLGDLTSGVKGFSKKP

SEQ ID NO: 2213 - protein, 323 aa, unidentified
  source 1..323: note = Related to PKUU01000015.1; note = Clostridium sp.
MSDLWKYCTEEQCRQFLLSLELVGKDGWTDDKKLACLYAVSNHVEEHYHTAVIKKKNGKERLLLVPDPLLKGIQRQILHNVLEERPISKYAMAYHKGASLKDNAAPHVGKEKILKLDMENFFQNILFSQVLQSAFPGKYFPPSVGTLLTYLCCYYDYLPQGAPTSPAISNLVMKPFDESMGKWCEERGIAYSRYCDDMTFSGDFDADMVKRKAGAFLNHMGFCLNHKKTRIITRNRQQNVTGVVVNCKPQVSKEYRRKLKQEIYYCKKYGILGHLERIGDKKYLELGDAGIEKYRLRLIGKMNYVFQVNPEDKEFRGYLKDFV

SEQ ID NO: 2214 - protein, 328 aa, unidentified
  source 1..328: note = Related to AP025571.1; note = Clostridium symbiosum
MENTGLWKYCTPEQSREFLLSLRLLGRTDREDGEQLACLYAVSNHIEKHYHPAEIRKRDGSIRRLLVPDPLLKKIQRNILHNILDQMPVSPYATAYHKGAGIRLNARPHSGAKLLLKLDIKDFFENILFSQVYQQAFPTIYFPPSVGTILTYLCCYRDYLPQGAPTSAAISNLVMKPFDTYMGAWCGEKGIRYSRYCDDMSFSGEFDADTVIRKAGGFLKAMGFELNTKKTKAVSCHQRQEVTGIVVNQKPQLSKEYRRRLRQELHYCGRFGLRSHLEAIHDTRFLPLGEAGIQRYRMSLLGKINHILYVNPEDAWFLNARQIVRTLR

SEQ ID NO: 2215 - protein, 330 aa, unidentified
  source 1..330: note = bacterium 1XD42-8; note = Related to RAYU01000170.1
MSRLWRYCTKEQCRDLLLSFQLFGETNWSFEKQIACLYTVSNHIEAHYHSIIIPKKDGSKRQLDIPDYILKKIQKNILHHIIEKFSVPECATAYQKGKGILNNVTPHIGKKTVLKLDIKDFFHSIIFPMVYARAFPEEYFPPSIRTLLTYLCCYRDRLPQGAPSSAAISNLVLKPFDTYMELWCKDRNIQYTRYCDDMTFSGNFHKKEVMKKVQHFLHLSGFSLNYKKTKELSSNRRQQVTGIVVNSKPQVSKEYRRRVSQEIYYCQKFGVLSHLKYIDDKEHLPLGQIGVRKYVSSLQGKVQYILYINPEDKLFRKLLDESIAKIWDSL

SEQ ID NO: 2216 - protein, 332 aa, unidentified
  source 1..332: note = Related to JAGZJZ010000010.1; note = Clostridiales bacterium
MGDQNLWKYCTREHCRKLLTEFQLFGEMNWSKERQIACLYALSNHISDHYHTAVIPKQDGTCRKLCIPDTLLKLVQRNILHHILDGLTVSSYATAYRKGVTILNNVSCHTGQEKILKLDIHDFFGSIPFILVYQSVFHSDRFPPSVGTLLTHLCCYNGCLPQGAPASAAISNLVMKPFDEYMGNWCGERKITYTRYCDDMTFSGSFEAYKVKNKVRSFLKVIGFELNEKKTKLLLAGQRQAVTGIVVNEKPQVSKEYRKKLRQEVYYCLKFGAASHLEHMNHDESGSKEGAERYLQQLLGKINFVLQVNPEDEYFRAARERLRKNQNERVNR

SEQ ID NO: 2217 - protein, 328 aa, unidentified
  source 1..328: note = Related to NZ_FMJR01000027.1; note = Robinsoniella peoriensis
MGDHRLWKYCTAEHCRQLIMEILLFGEINWPEERQIACLYALSNHIPSHYRTAKIPKRDGTCRRLCIPDTLLKMVQRNILHHILDPIPVSSCATAYRKGVSLISNVSGHVGQEKILKLDIHDFFGNIPFILVYQRVFHSYRFPPAVGTLLTHLCCYEGCLPQGAPTSAAISNIVMMPFDEYMGEWCAKRGITYTRYCDDMTFSGSFEAYKVKNKVRGFLQVIGLELNEKKTKLLLAGQRQAVTGIVVNCKPQVSGEYRRKLRQEIYYCCKFGAASHLQHVQDQKYGTDATENIRYLQKLLGKINFVLQVNPEDKYFKTARESLKNLVT

SEQ ID NO: 2218 - protein, 328 aa, unidentified
  source 1..328: note = Related to NZ_FQVI01000010.1; note = Lactonifactor longoviformis
MGNTDIWKYCTGEQCRDMLLELRLLGNVDWSREKQLACLYSLSNHAENHYHLKEITGKGGRQRTLQVPDAFLKKVQKNLLRNVLDGLPVSSYATAYRKGKSILCNAVPHTGKGKILKLDMRDFFGNITFFQVRQSVFGGLLFPGSVGTLLTHLCCYRDYLPQGAPTSGAVSNLVLKSFDESMGNWCRIREITYTRYCDDMTFSGSFDSREVKNKVESYLRILGFELNPKKTKVLDSGTRQMVTGIVVNEKPQADRDYRRRLRQECHYCLKYGPDPGRVSSNKSKEAYLAGLVGKVNYVLQINPEDMYFKEIKRQLTQLQREAGEFPMQ

SEQ ID NO: 2219 - protein, 333 aa, unidentified
  source 1..333: note = Related to NZ_SGXF01000003.1; note = Cuneatibacter caecimuris
MSGEEMWKYCTGEQCRDLLRSLDLLRGTGVKQEQEIACLYSLANHAEAHYRRARIPKKNGGVRKLQIPDGMMKKVQRNLLHHVLDGLEPSPYATAYRKGAGLKENAAPHTGKKQILKLDLENFFENITFSLILENVFPSRLFPPAVGVLLTNLCCYRDYLPQGAPVSAAVSNLVMRPFDDYMGSWCGEQGIAYTRYCDDMTFSGDFDARKVKNKAQNFLKVMGFSLNAGKTRLYGQGHRQSVTGVVVNCHPQAARTYRKKLRQDLYYCEKYGVAGHLKRQGRDLGQEDAAGASFRYLQMLAGRAAFVLQVNPEDSWCREAKGRIARLQSELWV

SEQ ID NO: 2220 - protein, 328 aa, unidentified
  source 1..328: note = Candidatus Fimimorpha excrementavium; note = Related to DVJD01000043.1
MIWRYCTAEQCRELLYSYRLFGERKWSMEEQERCLYTLSNHAEQYYRNVWIPKKNGKKRKLMIPDPILAEVQRNILTQILADMPVSEYAKAYRKGLGLREMVQEHQGQNTVMCLDIRDFFGNITFFMVYQQVFSSLRFPPAIGTLLTNLCCFKDTLPQGAPTSPAISNLVLKPFDEYMGQWCRKRGIVYTRYCDDMVFSGELDPKTVKNKVRGFLRVIGFSLNEEKSSVRRQSQRQTVTGIVVNEKIQAAREYRRRVHQEVYYCRKFGVDDHLAKIGKDKKEPMDRQRYLLSLLGKLNYILQMNPQDGQAKSDLAALKEIIVSLGEKN

SEQ ID NO: 2221 - protein, 319 aa, Escherichia coli
  source 1..319: note = Related to CP065613.1
MDATRITLLALDLFGSPGWSADKEIQRLYALSNHAGRHYRRIILSKRHGGQRLVLAPDYLLKTVQRNILKNVLSQFPLSPFATAYRPGCPIVSNAQPHCQQPQILKLDIENFFDSISWLQVWRVFRQVQLPRNVVTMLTWICCYNDALPQGAPTSPAISNLVMRCFDERIGEWCQARGITYTRYCDDMTFSGHFNARQVKNKVCGLLAELGLSLYQRKSCLIAACKRQQVTGIVVNHKPQLAREARRALRQEVHLCQKYGVISHLSHRGELDPSGDLHAQATAYLYALQGRINWLLQINPEDEAFQQARESVKRMLVAG

SEQ ID NO: 2222 - protein, 319 aa, unidentified
  source 1..319: note = Related to NZ_BNAA01000006.1; note = Pseudocitrobacter faecalis
MDATRVCLLALDLFSSPGWSANEEIRRLYALSNSTSKHYRTIVLSKRDGGERQILAPDYLLKTVQRNILRNVLSHFPVSPFATAYRPGSTVVHNARPHLSQPQILKLDIEGFFENISGLLVWRVFRQTTLPNAVVTMLTHLCCYRDALPQGAATSPAISNLVMRRFDERMGRWCQERHIVYTRYCDDMTFSGEFSARQVRNKAAALLAELGLRLNKRKTALIPAYKQQTVTGIVVNEKLHISREQRRLLRQEVHYCLKFGVAAHLSHSGKSTESALCYLQRLQGKIAWLLQVNPDDRAFRRALRDVQQMIRQIALPGTR

SEQ ID NO: 2223 - protein, 356 aa, unidentified
  source 1..356: note = Related to NZ_LS483470.1; note = Leminorella richardii
MRRANALSTFSRLRDRLYRIVAADAFFKHQWDKEPTLDATRACLLALELIGRSDWSADREIRCLYALSNRSERHYRKIVLTKRDGGSRVLHAPGFLLKTVQRNVVKNVLSHFPVSPFATAYRPGSSTLCNASPHVGRKQILKLDIEKFFDNIRFTQVYRLFNKTELPAGAVTLLTHLCCYRDALPQGAPTSPALSNLIMARFDDLLGIWCKERDIAYTRYCDDMTFSGDFDAHQVTNKVRGLLNDMGFTLNSRKSRRIARGSQQTVTGIVVNHRPQLPSEFRRALRQEVYFCQKFGIASHLERIGSSETPLRYLQSLLGKIAYLLQINPDDAEFQRAKAAIGQLLKAETSLSYRAD

SEQ ID NO: 2224 - protein, 323 aa, unidentified
  source 1..323: note = Related to NZ_JMPN01000024.1; note = Leminorella grimontii
MDAARACLIALELTGKTACPADKEIQCLYALSNRSDRHYRKIVLTKRSGGLRTLYAPDILLKSVQRNILRNVLSLFPLSPFATAYREKCSTLDNASPHVAQSNVLKLDIENFFDSITFFHVHRLFKKTELPAAVVTLLTHLCCHRDVLPQGAPTSPTISNLVMKRFDDVIGLWCQERDIVYTRYCDDMTFSGDFDARQVKNKVRGLLYDMGFTLNARKSRLITANQRQTVTGIVVNQKPQLTRDIRRKLRQEVYFCQRFGVASHLVQTGDFNPQESPREQRLRYLQSLQGKIAYLLQINPDDAEFQNARSAVRQLLKEESASA

SEQ ID NO: 2225 - protein, 314 aa, unidentified
  source 1..314: note = Related to NZ_RBIZ01000005.1; note = Yokenella regensburgei
MNAAQLSLVSLELTGHPYWSPHKQLRCLYALSNHSERHYRTLSLPKRSGGMRNIQVPDPLLRQVQRHILRHVLSLLPLSPFATAWRPEYSLRHNVLPHLGKKQVLKLDIENFFPGIIFPQVQQLAFAKTCLPYAATTLLSHLCCYRDRLPQGAPTSPMLTNLVMRPFDDYIGDWCQQQEIAYTRYGDDMTFSGDFDARRVQNKVAGFLGEMGMVLNEGKTRVMRRGQQQIVTGIIVNESTPRAPREMRRALRQALYYYGKYGASAVPEGFDEQQWLQSLHGKITFILQIHPEDAALQHARGILQRQLKAIRSQP

SEQ ID NO: 2226 - protein, 311 aa, Enterobacter sp.
  source 1..311: note = Related to OBEF01000007.1
MNAAQLSLISLELTGHPHWSPAKQLRCLYALSNHSDRHYRELQLPKRSGGIRTIHVPAPLLKSVQRNILRHVLSLLPLSDYATAWRPGYTLLNNVLPHVRQKQVLKMDIDNFFQRIIFPQVWQQAFAKTRLPQATITLLSHLCCYRDRLPQGAPTSPTIANLVLRDFDNYIGRWCAEQEIAYTRYGDDMTFSGDFDARRVRNKVKGFLAELGFELNHDKTRLMSQGQRQIVTGIVVNGPYPQAPATLRRELRQTLYYYEKFGWSPAHSEMTERHWLQTMQGKIEFILQIRPNDSEFLHARHNVRRWLKRCA

SEQ ID NO: 2227 - protein, 345 aa, unidentified
  source 1..345: note = Related to NGMM01000007.1; note = Enterococcus sp.
MSRDIWKYITVEQCNEFLLSFQLLGETTLSNKEQITCLYSLSNTLEKHYEQYTLVKSNGGTRKITKPDERLKLVQKNILANILSQRSVSIYATAYQKGVGLIMNAQPHTEKQQILKLDIEDFFDSISFSQVYAYGFPRSYFPKATAGLLTNLCCYNHCLPQGAPTSPMISNLVLRSFDDSIGQWCVEKGISYTRFCDDMTFSGTFDATTVKNKVQAFLVELGFSLNKKKTRVISKHEQQTVTGIVVNEKSQAPRTYRKQLRQEIYYCMKFGVSSHIARKTAVAPHLIEQRTIENYLLSLLSKTNFILQINPLDEEFLQARTQLKVLLTEPVSYTHLDVYKRQVYR

SEQ ID NO: 2228 - protein, 333 aa, unidentified
  source 1..333: note = Related to WLYM01000046.1; note = Erwinia sp.
MSHRDLWKYCTPAKNREFLLSLQLLGQTELSDAQQISCLYSLSNHLEAHYRTYFLIKRNGSKRKISAPDLLLKKVQKNILTVCLTNRTCSPYATAYRKGVQLLENATPHLGQKQLLKLDIEDFFGSITVPMIARSAFPRTYFPSSVAGLLTQLCAYDDCLPQGAPTSPLISNLVMKPFDDSIGQWCAQRQITYTRFCDDLTFSGDFAPKEVKKKVQNFLFELGFTLNKIKTKQLSASQRQSVTGIVVNTKAQVPRSYRKKLRQEIYYCLKFGVRSHLIHQHTTSQPVLEQEEDQRYLQQLIGKTNFILQVNPSDQEFLQAKKALKELLQANYT

SEQ ID NO: 2229 - protein, 336 aa, unidentified
  source 1..336: note = Related to NZ_NGKC01000006.1; note = Vagococcus acidifermentans
MPYFLGGIRPMNKSIWKYITTDQCNDFLLSFNLLAPTNLSPEKQLACLYAVSNSIESHYTTTYLKKKTGGHRVIHEPSPLLKKIQKNILVHVLEPQACSVYATAYQKEKSLLDNAAPHIGKKQVYKLDIDDFFDSISFTMVFQRAFPREYFPPQAAGILTQLCCFNDCLPQGAPTSPMISNLVLKPFDDYIGQWCRERNIAYTRYCDDMTFSGEFNVKKLHHKVRAFLEALDFSLNQKKTKLLATGKQQIVTGITVNEKMQVPKKYRREVRQSAYYCLNYGTASHLKRMNEGNGELDPETYLNSLLGKINFILSVNPSDKEFSLLKEEISKLLSHS

SEQ ID NO: 2230 - protein, 327 aa, unidentified
  source 1..327: note = Related to NZ_FYBT01000001.1; note = Listeria goaensis
MQNQDVFGYATNAQINDFLYSLQLFGASDWSKEKQIGALYAISNHIEDHCTLFQVPKRNGSERTICAPSPLLKTVQKRILFAVLSERPVSEFATAYKTGVSILDNAAGHVGQKYVLKLDIENFFGSILFQDVMNFAFPRALFPKRVSALFASLCCYHDCLPQGAPTSACISNIVLKPFDDYIGRVAKEMGAVYTRYSDDMTFSGDFDTKKMYYKAKLFLEAMNFTVNEAKTQILTKKSQQKVTGLVVNEKVQVPKNYRKTVRQEAYFATKYGLTSHLAYRQNVQAAEVTQNAAFRYKLSLLGKINYILLANPEDQEFKKWQNEIKSL

SEQ ID NO: 2231 - protein, 327 aa, unidentified
  source 1..327: note = Related to KQ130610.1; note = Listeria fleischmannii
MNHQEVFGYATDAQLSEFLYSLRLLGPSAWPKEKQLATLYAISNHLENHYKTFTVQKRNGQMRNIYAPSPLLKGVQRRILVSLLNERQVSPFATAYKNEGSIFFNAAKHARQKYILKLDIEDFFGSILFPDVMNYAFPKAIFPKRISGLLTSLCCYHDALPQGAPTSAAISNIVMKPFDDYMGKLASEMGINYSRYSDDMTFSGDFDTAYMYRKAKMFLNDMNFSVNHAKTKVLTRKMQQKVTGLIVNEKVQVSKAYRKKVRQEAYYVSRFGLRNHLAFIQQLNEVEISKEAVKRYQLVLLGKINHILCANPNDKEFLNWREKIKGL

SEQ ID NO: 2232 - protein, 333 aa, unidentified
  source 1..333: note = Related to NZ_FXUT01000001.1; note = Listeria costaricensis
MNSHFWKNCSAQEERAFLLDLNLLRQYGDAWSDKEKIALLYTVSRTINQHYLTVKIPKRTGGLRTLHAPDPLLKMIQKNILSLLETRTLSAFATAYRKGGSILANATPHVGKKQLLQLDLLDFFDSLSFPMVMAAAFPKTVFPDNTRMLLTNLCCLNDALPQGAPTSALISNLIMRPFDDYIGEWCKERQIAYSRYSDDLTFSTNEGDLTLVKRKVEHFLEAMQLNLHPAKTKYTDQSMRQCVTGVVVNQHPQVPRRYRSMLRQEIYYLEKFGLTGHLACLKEKGEVAADLSEKQYLRKLIGKVQFVCAICPESAGFQDAYWRLQKLAISFEE

SEQ ID NO: 2233 - protein, 333 aa, unidentified
  source 1..333: note = Related to JAJFDR010000002.1; note = Anaerovorax odorimutans
MRYTNLWKYCDIQQCQDFLLSLELFDESRLTRQERLKCLYAVSRHAEKHYRKTFRKKADGSLRPLLEPDYLLKQIQRNLLCNVLERVPVSEYATAYRKGVSVRDNAAAHVASPQILKLDIENFFGSITDSMVFTKAFPREYFPYPAASLLTAICCYEGYLPQGAPTSAAISNLIMKDFDRYIGNWCREKGVNYTRYCDDLTFSGDFDWVEVKNKVRAFLNAMGFEMNKKKTKLLTAGQRQIVTGVVVNEKLQTPRAYRRELRQIYFYMKKYGMRSHLHNKLGREAANEEMASYLEHVLGRVNFVLQIKPEDGCFKEMKAWILEKKKEEAHECL

SEQ ID NO: 2234 - protein, 324 aa, unidentified
  source 1..324: note = Candidatus Ventrisoma faecale; note = Related to DVGX01000291.1
MDLWRYCTAEKWQEFLVSLDLLGSAPADREAYFRCLYALSNHPEAHYRTLSVPKRGGGRRTLREPDALLKKVQKNILRHILAGAPVSEYACAYRKGMGVRQNAAIHLGQPMILKLDIHDFFGSITFPMVMWSAFPGTLFPPAAATMLTSLCCFRDVLPQGAPTSAAISNLVMEPFDRHMGAWCAARGIRYSRYCDDMTFSGVFDAGEVEAKVRAFLEVMGFSLNKKKTKLMTAGRRQTVTGLVVNEKLQVPREYQRALRQELYFCETYGVRSHLERKNGRAPSEEEAARYLESLAGKAAYVASVAPESENARRMQEKIKKLIKK

SEQ ID NO: 2235 - protein, 332 aa, unidentified
  source 1..332: note = Related to LR134531.1; note = Pragia fontium
MPDTDVWKYCTTAQIKQFLVSLRLLGNTDWSDEKYIASLYAVSRNINNHYQQTTLLKRDGTQRHLLVPDKLLKKIQKNILRNLLQDVPLSAHATAYRQGTDIVANAQAHLGQRQILKLDIVDFFGSITFMMVCRSVFPSLYFPPSVGTLLTNLCCYNDALPQGAPTSPAISNIVMTPFDNYIGKWCQERKIVYTRYCDDMTFSGDFEAKQLKNKVRAFLQEMGFSLNQHKTKLFTCHTRQLVTGIVVNEKLQVSREYRKQLRQELYFCQKFGVLSHLTQINNGLIAKQEDVESYLQSLLGKANFIVQVNPQDAYFLQAQSLIKQLIRTHRAE

SEQ ID NO: 2236 - protein, 332 aa, unidentified
  source 1..332: note = Related to PDDX01000001.1; note = Budvicia aquatica
MPDMPLWKYCTTAHYLEFLISLQLFGDTDWCAEKQISCLYTISNDVNAHYQRTTILKRDGTPRHLLAPDPLLKKIQKNILRNILAPVPVSPYATAYHKGADVVANAAAHLGQKLLLKLDIEDFFGSIIFPMVRRSAFPDIYFPPAVSTLLTHLCCYNDALPQGAPTSPTISNLVMKPFDSHIGEWCSARGIIYTRYCDDMTFSGDFDAKAVKNKVGHFLQALGFSLNKEKTKLLTRHTRQSVTGIVVNQKLQLSRDYRRQLRQEIYFCQKFGVVSHLKRMNYPLESGDVERYLQALQGKVNFLLQVNPGDDVFRQAMSGIKQMIKANRNSQY

SEQ ID NO: 2237 - protein, 334 aa, unidentified
  source 1..334: note = Related to NZ_PQSP01000009.1; note = Saezia sanguinis
MPDNDLWKYCTAEHCKELLLSFRLFGNTAWTGEKQIACLYALSRHIGKHYARAVIPKRDGSARHLLVPDPLLKQVQKNILHHVLAEMPVSPHATAYHPKANVFANATPHLRQPQVLRLDIEDFFGTITFPMVYSQAFPYVYFPPSVRTLLTHLCCYRDYLPQGAPTSADISNLVLKPFDDHMGRWCSERGITYTRYCDDMVFSGDLDARAVKNKVQNFLQAMGFSLNLKKTRLSTRHQQQVVTGLVVNEKVQAPVQYRKALRKEIYFCQKYGVQSHLTQTADQTYLPHGHNGVMRYLASLLGKVNFVLQANPQDAYFQQAKSAIQHMRAQLKLA

SEQ ID NO: 2238 - protein, 321 aa, unidentified
  source 1..321: note = Peptococcaceae bacterium; note = Related to JAFYPD010000088.1
MDFSQSQIEEVLALPLLTDKTPEKRLKTLYALSNHAEEHYHPVTAAKRNGGRRKILVPDALLKQVQRQILHNILEKQPISRYAKAYHPGAAIRENAAVHLHQPGILKLDIENFFPSILFPDVLSSCFSSQRFSVPMGTLLTNLCCYQGYLPQGAPTSPAISNLVLYHFDVWIGQWCGQQHIRYTRYCDDLTFSGDFDAALVQGRVEGYLQTMGFMLNQKKTRWMTAHQQQMVTGVVVNEKMQVSRAYRRNLRQEIYYCRKYGVQSQAAYAAGKDAAEIGPGDGKRYLQSLLGKINFVLQINPDDAEFQRAEEEVKSWLTAK

SEQ ID NO: 2239 - protein, 343 aa, unidentified
  source 1..343: note = Related to JAFRDE010000015.1; note = Ruminococcus sp.
MYIDHNEVIFQPFDVEYVVERGLERAMEEAFAFHQNCRLPFLMDVSQLAGFLSLTKKETFRFVFACDSMYRTFSLPKRTGGTRQIDAPMPELSWAQYRITREILNKLPISQYATAYHKGARLTQNASPHTGRRYLLKIDLSDFFHNIRMTDVHSRVFTPYYPKQIGYFLSLICCKDGTLAQGAPSSPAISNIVMRCFDEPFGQWCKKRGLSYTRYCDDITISGDVPLYRAYEKASLWLNNMGFTVNEKKTRFITDASRQTVTGLTVNEKVSVPSDYKRKLRQELYYVEKFGIRSAADHMRLPDALKYCQSLMGRINYVLSVEPANESFLRAKDALSGQFAFCV

SEQ ID NO: 2240 - protein, 343 aa, unidentified
  source 1..343: note = Related to JAFRBD010000130.1; note = Ruminococcus sp.
MYIENNEVIFRSFDVNYVAKHGLEQAMDEAFAFHEKCRLPFLMDIAQLAGFLSLTQRETYRFVSKCSRMYRSFDLPKRTGGTRRIDAPLPELSWAQYRIDRTILRKIPISRYATAYHKGARLTRNALPHTGKKYLLKIDLSDFFHSIRISDVHGRVFAPYYPKQIGYFLSLICCKDGSLAQGAPTSPAISNIVMRCFDEPFGHWCEKRGLSYTRYCDDIAISGDVPLYRAYEKASLWLNNMGFTVNEKKTRFITNASRRTVTGLTVNEKVSVPSDYKRKLRQELYYVNKFGILSAAAYLKLPDALKYCQSLMGRVNYVLSVEPENESFIKAKEALSGQFAFCV

SEQ ID NO: 2241 - protein, 345 aa, unidentified
  source 1..345: note = Related to JAFRBX010000029.1; note = Ruminococcus sp.
MYIDKDEVIFEFFDVEYVTKHGLEQAMDAAVAFHQKCRLPFLMDISQLAAFLSLDRRELFGLVKRCDTMYRSFLLPKRTGGYRQIDAPAYELTAYQYRILHRILGRIPISRYATAYHRGAALTKNASPHTGKRYLLKIDIKDFFHSVRLSDVHARVFAPYYPKQIGYLLSLLCCKDGRLAQGAPTSPAISNIVMRCFDEPFGEWCEKRGLSYTRYCDDITISGDVPLYRALEKASLWLNNMGFTVNEKKTRFITNASRQTVTGLTVNEKVNVPSDYKRRLRQELYYAAKFGVSSAADYKGLTDAEQYYQSLMGWLNHVLSVEPENESFLKAKQALRERYAADRRI

SEQ ID NO: 2242 - protein, 349 aa, unidentified
  source 1..349: note = Related to JAFORM010000263.1; note = Ruminococcus sp.
MIVKNDSVTFEPCDMPFTRKFGCDEAAKMVLDFKAFHPKLPFLYDTHQLADFLKTGRKTLFDLTNHPEACYSTVSVPKKSGGTRTLNVPNDRLKAIQRKILYEILAYLPVSKHAAAYHKGARLTDNAAAHIHHRYLLKLDLSDFFGSIRFDSVFCSAFNAHYFPRQIGVMLTSLCCFDDVLPQGAPTSPALSNLVMKRFDNSFGAWCSARGFSYTRYCDDIAVSGNCPVYPAYKKARLLLENSGFEINDAKTRFVTDAGRQTVTGLTVNEKLSVPSDYKRKLRQELYYAKKFGLENVIQKQNLTDYISGGKADAARYAMHLLGKLHFVLSVEPDNAYFRNARQFLITQL

SEQ ID NO: 2243 - protein, 344 aa, unidentified
  source 1..344: note = Related to JAFOUX010000084.1; note = Ruminococcus sp.
MLVSDNEVMFFESDMRFVKRFGLEAATDMVLDYSAINKTPFIYDFFQLSSFLRILPSDLRKLLDDIPGSYRSLQIPKKSGGYRELNQPLGRLPDIQERIYTGILKRLKSSPYATAYHQGAHLSDNAAPHIGKRFLLKLDITDFFGSIRFDMVLSSVFNTSLYPRHIGAMLTSLCCLEDVLPQGTCTSPTLSNLVMKRFDDIFGAWCKRHGFDYTRYSDDITVSGNTSLYPAYCAAKSMLHKMGFELNERKTHFITDSFRQTVTGLTVNEKVNVTAAYKRKLRQELYYTDRFGIESAAQYLHQPDAKKYYQQLMGRLNFVLSIEPDHTYFIKAKEKLSEQRAEII

SEQ ID NO: 2244 - protein, 331 aa, unidentified
  source 1..331: note = Related to JAFUNJ010000009.1; note = Clostridia bacterium
MRITEGTVRFDGCDRHFAEKFGAHQAAEMVLDFASTNTHPFLYDTYQLAAHLGLRRKALFELVRRPGRHYRTLRIPKRSGGSRTLSVPDDRLKTVQRTVLHTILCHFPASAYATAYQPGATLRQNAAPHCGKKYLLKLDLEDFFGSIRFDQVYGAVFHTRRFPKQIGAMLTALCCKDDALPQGAPTSPQLSNLVLKWFDDTMGAWCQRRGIAYTRYCDDITFSADRPLYDAYRKAVGLLEHQGFSINEEKTRFVTAAGRQTVTGLTVNEKVGVPADFKRALRQQVYYALKFGAEPPEYRRLLGKVQFVLQTAPEHPWFCDAREELIRRLKG

SEQ ID NO: 2245 - protein, 354 aa, unidentified
  source 1..354: note = Related to JAFRAJ010000055.1; note = Oscillospiraceae bacterium
MHFEGEKIVFSAADIERAKRTGIENMLLRADQYCSAFSIPYICDLFELSTELGLPAEDLARIGSRASMKYRCYYIKTGSGKFRKIEEPDFELRIVQNRILNHILRYYRISEHAAAYHKGASVKNNAMPHVGKRYLLKMDLSDFFGHITDSMLMDTVFSEQHFPYPVGRTLTDICTRNGSVPQGACTSPAISNIVMKGFDDRMGRWCSYRGISYTRYSDDLTFSSDEPLYPAYRKARRMLEEMGFGINDDKTHFITSAGRQQVTGLVVNDKLGIPADYRRRLRQEIYYVLKFGARDAFSRSDDCRNEPGMTLRRYLLRLIGKTEYVLQIRNDDRFFREAKIKLAEEIAKLSSAEE

SEQ ID NO: 2246 - protein, 352 aa, unidentified
  source 1..352: note = Clostridia bacterium; note = Related to JAFSIW010000012.1
MYTQNGRITFEKSDLKFLQKHGLSKAVVIYEEHCAHSNLPFVTDHHQLAGLLGCYTNVLFQTLRTVDELYYDAAIPKATGGYRTLQVPTHPLRYMQTVILHSILDKLPVSPYATAYHKGARITDNAKPHQHKKYLLKMDLQDFFSSITFEQVLSGVFHKGRFPTHVGVSLTALCCKNGVLPQGAPTSPALSNLVMSHFDGVMGEWCCRQGFSYTRYCDDITVSGNRPLYAAYQKAKGLLENMGFELNEKKTRFVTAAHRQTVTGLTVNQGIGVTADYKRNLRQAVYYTVKFGAADHIRQRNLTRFMVNGVPQTERYLAHLEGQIRYVLSVEPDNRAMVKLLADLSASPPYMG

SEQ ID NO: 2247 - protein, 337 aa, unidentified
  source 1..337: note = Clostridia bacterium; note = Related to JAFNUN010000059.1
MIINKKYESIVFDESDMNFVSKFGIQEATDMVFDYLSTNKTPFIYDVFQLADYLQIKLPKLFRLVNKADELYSNVVIKKRNKSDRILSVPDYYLGSVQKRINRKILSKIDISKYATAYYKGSNLLKNVENHCGKKNILKMDITDFFSSITFGMVLSSCFNTSRFPRNIGYMLTTLCCKDDCLPQGTSTSPAISNIVMKNFDDILGNWCEKRGISYTRYCDDLTFSSDEDLYPVYVKAKSMLNDMGFQVNEKKTHFIKNSNRQEVTGIVVNDHPQLSKDYRRKLRQELYFVFKYGIKDALEHINKKEVSNKEIYSYACQLSSKISYVLFINPNDKEFV

SEQ ID NO: 2248 - protein, 353 aa, unidentified
  source 1..353: note = Related to JAFSEL010000040.1; note = Ruminococcus sp.
MKVVNETVEFFECDMNMVSKIGLMEAVEMVLDFSSTNTVPFIYDTYQLSDMFAIGRKNLFSLIRNCDQNYKQINIKKSNGDIRVLYSPRTRLKAIQNIILKEILYKIPVSKYATAYHKGAKLIDNAKPHCGKKYLLKMDLRHFFDSITFTQVYSSVFNTCRYPKQIGTILTTLCCHQDVLPQGAPTSPALSNIVMKSFDDYFGKWCEKRNFSYTRYCDDITVSGDSSVYPAYLKAEALLENMGFEINQNKTHFITNTNRQEVTGLVVNERARVSSDYRRKLRQEIHYVTKYGILDALKHLKDSGYESVYSYYSSLMGRINYVLQIEPENQQMLNLKADLEKSLEKYEWQTMLQ

SEQ ID NO: 2249 - protein, 353 aa, unidentified
  source 1..353: note = Oscillospiraceae bacterium; note = Related to SVPW01000009.1
MLIKGQSVTFHADDMHFVKKFGIMEATNMVLDFASTSNLPFVYDTYQLASLLQLRRSSMFKIVRKCNSYYRDVELKKNNGKVRYISAPLDILKWTQKCILTNILEKYPVSKFATAYRKGLKLVDNAKVHTSKKYILKMDLKDFFPSIGFEQVYSCVFNTRHFPKQIGVILTSFCCRNGVLPQGAPTSPAISNIVMRNFDDIFGAWCEKQGFSYTRYCDDITVSGNKSLYVAFVKAKAMLEKMGYEINTKKTHFLTNASCQTVTGLTVNERARIPSDYRRNLRQEIYYAQKFGVKDAVMRANREEYIVDGKVDEHRYISHLEGKVQYILQIEPENEYFKKALKTVQNLRPLGNF

SEQ ID NO: 2250 - protein, 366 aa, unidentified
  source 1..366: note = Related to JAFUKO010000119.1; note = Ruminococcus sp.
MIIRNGTIEFGHGDMHFVEKVGLSEAVEMVLDFKSQNKIPFVYDTYQLADLLMIRRKDLFSLSKNADSFYTYATIKKRDGSKRILCVPDAYLKSVQRTILSTILSKLPVSEYATAYRKGCKLQSNAQPHCGKKYLLKMDICNFFDNITFMKVYSSVFNTRHFPKQVGVMLTQLCCRNDVLPQGAPTSPAISNLVMKSFDDTFGAWCLRHNLSYTRYCDDITVSGDIPLHNVYLKASEMLHKMGFEINKRKTHFVKYTDRQSVTGLTVNECIRVDSKYKKQLRQDIYYTLKFDVVSAMKRSLSFEFDENEDIDSAVIKYLNSLIGKTAYVLQIEPDNEYFKKLLKKLTDLLDETKLDIRRSKYFTFY

SEQ ID NO: 2251 - protein, 365 aa, unidentified
  source 1..365: note = Related to JAFOED010000001.1; note = Ruminococcus sp.
MYIEDNIVKFEYCDMSFLKKFGVDVAADMYLDFKSVNKIPFIYDTYQLADFFGIRRTNLFKVTKNIDKFYYTTTIKKRSGGVRKLNVPDDTLKFMQRCILKRILSEFKVSKYATAYKKGATLKDNARVHSAKKYILKLDLKDFFDSITFMQVYDAAFSTRYFPKQIGVMLTTLCTRQDVLPQGTPTSPVLSNLVMKNFDDSFGAWCEERGFSYTRYCDDITVSSDNELKGVYSKCKFMLTKMGFEINEKKTRFLTNGSRQTVTGLTVNSSVKVPSPYKKELRQAVYYTLKFTAADALKRDKNFERKTDLPIDEEALRYLNCLIGKVAYVLQIEEDNVYFKSALIKLVNRKDELEFNIKRENNYNF

SEQ ID NO: 2252 - protein, 326 aa, unidentified
  source 1..326: note = Clostridia bacterium; note = Related to JAGBTD010000211.1
MIEDFYSVNSNKLPFLTDQRQLASMLGIELRTLYSILKSINANYTTHKFVQKNGKVRTINEPSTKLKSIQRLIYFRILQHLPVSKYAKAYRPRITIKQNALPHIGKKYLLKMDIKDFFPSITFTRVYGAAFNTKFFPKYIGTLLTTLCCKDDCLPQGAPTSPALSNLVMKNFDEYLGKWCEEKGIAYTRYCDDLTFSSDMPLYGVYLKAKYMLENMGFDVNEKKTKFISSKNRQTVTGLTVNKKLNISSVYKRELRQEVYYVLKFGAKTAILRGGHEDYIIGGETLKVDYLYHLLGKVNYVLSIERDNKWFQESKGYLTDMIIKYS

SEQ ID NO: 2253 - protein, 360 aa, unidentified
  source 1..360: note = Related to SVPP01000010.1; note = Oscillospiraceae bacterium
MLNKKEMQKMKITKGHISFEQSDMHFVEKFGISEAFRMVGDYVSERKTPFVYDTYQLAYLLGIGRKDLFSLVKTVDNHYRPVNILKKNGNIRTLIIPSSKLKRIQSVIAGRILSCYSVSEYAYAYLKRKTIYDNASVHCGKKYLLKMDITDFFSSICFDRIYSAVFNTKYFPRQIGVMLTALVCNDDVLPQGAPTSPAISNIVMASFDRLIGTWCKERGVSYTRYCDDLTFSGNVPLYGVFKKSKSLLEEMGFEVNEKKTRFITSSDRQTVTGLTVNEKVSVPSDYKRKLRQEVYYVLKHGIVNTVLFTENKEFISDGQVDEEKYYLSILGRVSYVLQIEPDNRFFSEARKRIMEDRYKT

SEQ ID NO: 2254 - protein, 349 aa, unidentified
  source 1..349: note = Oscillospiraceae bacterium; note = Related to SVJN01000007.1
MQIFIDDVTFDAWDLHFVEEFGVFRATEMVLDFFEHNRHPFLYDTYQLAHFLQVEQKQLLTILGRCDTLYRKVKLPKKNGGVRIISAPLRDLKQMQKIILEHFLKKLPVSEHATAYKEGGTIRKNASVHCGKKYLLKLDIEDFFDCISAERVYKSAFHTQYFPQKIGKILTRLCTKNGYLPQGAPTSPMLSNLVMRPFDMVMGNWCKKHNIGYTRYCDDITFSADVPLYVAYVKAKSLLEKMDFCLNEEKTKFIRSSNRQVVTGLTVNECIHVTADYKRKLRQEIHFVLKFGLKDALLHTTPNPFVTEQAVHTERYFQSLMGRIHFVLQIEPENRYFLEAEQKLKGINH

SEQ ID NO: 2255 - protein, 414 aa, unidentified
  source 1..414: note = Related to QUJR01000007.1; note = Butyricicoccus sp.
MPKSDTLRRIANHFMILDSPPLNQTILYCKGLIFGRTLHMKIEGSCVTFEPCDAAFVKKFGPLEAANMVLDYHSVHPNMPFLYDAEQLAGFFDISCGELNHIVNHIQKEYKKAFLPKKDGTYRSLYIPSIRLQFCLGPIKDKILSQLPVSKFATAYQKGSSTRKNAEPHIGKKNLLKLDITDFFGSISFEQVLCAAFNTRYVSKQVGFLLTSLCCKNDALPQGSPTSPALSNIVMRRFDDQIGRWCNQRQITYTRYCDDMTFSSDRPLYGVYQKVKKILFEMGFELNEAKTHFISNADRQTVTGLVVNEKLSIPSSYKRNLRQEIYYTLKFGIEDSIVHGNRLNFLEDGQPIRCPTYMTHLIGSVQYVLQIEPENRWFLNAKQKLLDYARAYFRAEGLGEEYYLHRSRLREKDE

SEQ ID NO: 2256 - protein, 333 aa, unidentified
  source 1..333: note = Oscillospiraceae bacterium; note = Related to DMLP01000060.1
MPCRRYIRGKAPPDNTPTNKRITPLFSVRLRFYRVILYCKGLYSFRLKYYSAAVIFMNIIDSNVVFGSGDAEFVKKFGLFEAAQMVLDYKSRNNLPFIYDTYQLADFLGIKRKELFFISKNTDKYYNAFEIKKKNGKPRRLYAPASKLKACQAAINRLILKNLPVSEYAAAYQKGSQISKNAAPHIGKRYLLKLDITDFFGSIRFEQVYSAAFNTRYFPKQTGVILTELCCLNDALVQGAPTSPALSNIVMYNFDNSIGLWCKKRGIAYTRYCDDMTFSSDRPLYGVYQKVKKMLFEMGFELNEAKTHFISNADRQTVTGLVVNEKLSIPSSY

SEQ ID NO: 2257 - protein, 359 aa, unidentified
  source 1..359: note = Related to JACJKY010000027.1; note = Proposed Phocea massiliensis
MLIKKNRIIFEQSDMAFVEKFGVLDAAEMVMNYKTVCTLPFVYDADQLAEFLKIGRKDFFDLIKNCDTCYRPISLKKKSGTYRQIYAPNDILKRIQKTILDKILSKLPISQYAKAYRMGGTLIDNAAAHIGKRYVLKLDITDFFGSISFEQVYSAAFHTKYFPKQIGVLLTMLCCRKEVLPQGAPTSPALSNIVMCHFDNYIGSWCEARAIAYTRYCDDMTFSSDRPLFGVYQKVKTILGEMGFELNEKKTHFILNTSRQSVTGITVNEKLSVPIHYKRKLRQEIYYTLKFGLVEQIVRLGKTEFFMDARPNVQKYYNHLLGQIGFVLQIEPENNWFQNAMIKLKSSSFLQGEMELWRR

SEQ ID NO: 2258 - protein, 354 aa, unidentified
  source 1..354: note = Related to NZ_AP023418.1; note = Vescimonas coprocola
MKIEKDTVTFEAPDADFVTKFGIQAAADMVLDFHCFHPQLPFLYDARQLAAFLSTSRQKLLYYVRHTAAAYHPVTIPKRNGDVRILSVPDDTLRRWQRKICRELLAYLPVAPQATAYRKGGAISGNAAPHVGKRYLLKLDISDFFGSICFEQVHSAAFHTRYFSRQVGFLLTSLCCKDGALPQGAPTSPALSNLVMRNFDTSMARWCQRRGIVYTRYCDDLTFSADRPLFAVYSKAKNMLAEMGFDLNEAKTHFITNAGRQSVTGLTVNEKVSVPAGYKRSLRQEVYYTLRFGLADSILRGGHATLLTDDLPDTERYRQQLLGRIQYVLQIEPENRWFREAKQKLLSCDDRPKV

SEQ ID NO: 2259 - protein, 355 aa, unidentified
  source 1..355: note = Candidatus Fimenecus excrementavium; note = Related to DVGI01000013.1
MIVKENTVIFEACDMAFVKKFGIAQATEMVLDYKSVNPLPFLYDTYQAAKFLGVGRLTLFQYAKNPEQGYKLITLKKRSGDKRRIYAPDIVLKHLQTGILRKILIYFPVSPYATAYSKNCTLRNNAAPHVGKKYLLKLDITDFFGSIRFDQVYSAAFNTRYFPKQIGVILTSLCCREEALPQGAPTSPALSNLVMRNFDNSLGRWCQKRGIAYTRYCDDMTFSSDKPLYPVYEKVKSMLYDMGFTLNEKKTRFVTSAGRQSVTGLTVNEKVAVSSDYKRKLRQEIYYALKFGLEDSIRFAKRTEFMRDGVLDAERYAQHLIGKANYVLQIEPENRWFREALERLQWTLKCLEMQG

SEQ ID NO: 2260 - protein, 342 aa, unidentified
  source 1..342: note = Related to SVPJ01000007.1; note = Oscillospiraceae bacterium
MHIQNGAVTFEPHDMWFVKRVGFEAACEMVLDYASQNKLPFLYDTHQLAHFLHIPRRYLFRWFRDMSSCYTPIALTKRSGGVRHLHVPVDPLMCAQRRILQDIVSRLPVSPYATAYVKGKRLTDNAAPHCGHRYLLKLDITDFFSSIRFDQVYSAAFNTTRFPKLIGVMLTALCCYEDVLPQGAPTSPALSNVVMRRFDDRIGEWCKKRGIAYTRYCDDMTFSSDKPLFAVYQKVRGMLAEMGLSLNEKKTRFVTHASRQSVTGLTVNERVAVSSDYKRDLRQQVHYALKFGYADALAKRGDTTFENGDHYAHHLIGRVRYVLQIEPHNTWFRDALPRLLWK

SEQ ID NO: 2261 - protein, 394 aa, unidentified
  source 1..394: note = Related to SVPN01000018.1; note = Oscillospiraceae bacterium
MILRFASACIRAICTATVRRFLVFEKGGVCVRKIGDTLIFTSSDMPFVKRFGIEEATKMVGDFYAEHDLPFLFDTYQLSSELGLRRKTLFSLTRNPEKLYYPVTLSKKNGGTRKLHVPFTVLRGIQRHILNAILNKLPVSSYATAYRRKHQPLHNAAPHCGKRYLLKMDIRDFFGSIRFDQVYRAAFHTRHFPVQIGAMLTSLCCYQERLPQGAPTSPALSNLVMKHFDEQMGEWCQKQGIAYTRYSDDLTFSADVPLYHVYKKAKAFLEHMGFELNDKKTHFITNASQQSVTGLVVNGDTPTVSRKTRRALRQELYYVQKYGLGDAIMRGNRTAFIKDGRPLVYRYLNHLEGRVGYMLHVMGEDDELKNALQMLHRRRQNLLIDAGVVLCDDD

SEQ ID NO: 2262 - protein, 350 aa, unidentified
  source 1..350: note = Related to NFIH01000004.1; note = Pseudoflavonifractor sp.
MYIRENGTIYFHEWDRPFVAKFGEHTATQMVLAFQAEHRGLPFLYDTHQLAAFLQMNRKRLFDLVKQVDEHYDQVKIVQKNGKMRVLHVPDGALKAVQRQIQRNILMHFLPSPHATAYIRRRTLVDNAAPHVGKKYLLKLDITDFFGSIQFAQVYRSAFCSPYFPKQVGVLLTRLCCWQGALPQGAPTSPALSNLVMKSFDVYLGDWCQKHAIAYTRYCDDMTFSADRPLYMVYQKVQIMLEHMGFSLHEDKTCFVTRASRQCVTGLTVNETVSVSRVYKRRLRQELYYAQKFGLADSLRHTQRGGFFTGDTPDVERYRNHLLGQVGFVLQVEPENRWFQHARNALKTMR

SEQ ID NO: 2263 - protein, 361 aa, unidentified
  source 1..361: note = Related to JAFQCR010000001.1; note = Clostridia bacterium
MIVKNGAVEFSDVDMRFVEKFGIFKATEMVLDFHNLNKTPFIYDTHQLASFLGYGRRLMFLVTKDPESHYFPTEIPKRDGTARKLLIPDTLIMSMQRHILDGILKHLKPSRYATAYAPKTNIKQNAQPHIGKKYILKTDISDFFGSIRFEQVYSAAFNTRLFPKQIGVMLTELCCYNGYLPQGAPTSPALSNLVMKNFDNNIGYWCEKHGISYTRYCDDMTFSSDKPLYNVLQKLTKMLDEMGFELNAKKTKFVTSSSRQSVTGLTVNERLSVSRDYKRNLRQELYYGFRFGFEGAVSRTKHPEFFDDNNHFMHESYYNSLLGRVRYILSIEPNNTEFSEALDRLKQYDMYQYRKLPRIVY

SEQ ID NO: 2264 - protein, 355 aa, unidentified
  source 1..355: note = Related to JAGAOS010000040.1; note = Clostridia bacterium
MKIVKNHIMFGAEDTNFIKKFGLSEALEMVENFRTLNNLPFIYDSLQLAGFLDIPLGVMFRMVRKGCDSLYHSHTIKKKNGGERQLYSPYCVLKRCQSIILRNILMKLPVSKYATAYKPKVSIVDNANPHIGKKYLLKMDITDFFDSISFEQVYSAAFNTRYFPKHIGVILTNLCCRSDSLPQGAPTSPAISNIVMKNFDNNIGNWCEERGISYTRYCDDLTFSSDKPLYHLYVKVKKMLYNMNFEVNENKTRFVTSASRQSVTGITVNQKLTVSREYKRELRQKIYYVLKFGVKSSLVYETNGFLGDDVNAIATHMLNVLIGKINYLLSVEKGEGNNYFKKAKGILILMRDELE

SEQ ID NO: 2265 - protein, 349 aa, unidentified
  source 1..349: note = Clostridia bacterium; note = Related to JAFVIF010000076.1
MKIKGNTVFFDSSDKSFIKKFGFSAAADMVMDFRSQNKLPFIYDLLQLSGFLSVDFKDTVRFLKKGCDNDYRTLTIKKRNGNDRILNVPSPTLKRCQRIIYNEILKNLPVSKYAKAYKKGVHLQDNASPHVGKKYILKIDITDFFGSITFREVYSAAFNTRYFPRHVGYVLTVLCCKDEALPQGAPTSPALSNLVMKGFDENIGKWCEARGISYTRYCDDMTFSSDEPLYHVYKKVTSLLEEADFSVNQSKTKFITNASRQSVTGLTVNQKVSVNREYKRTLRQELHYLFLYGAENCLIKTDNKQYFTNGKPDKNRYLSSLEGRIVFVLSVEKDNPYFKTALEKLRALY

SEQ ID NO: 2266 - protein, 354 aa, unidentified
  source 1..354: note = Related to SVOI01000004.1; note = Oscillospiraceae bacterium
MFINGQSIKFQNSDMAFVKKFGLIAATEMILDYKKKNSVPFIYDTFQLSQFLDISNKQVYRAVRNCDKTYSYVTIKKKNGNDRMLLVPGKQLKRIQRIILRRILNKIPVSEYATAYKKGATLYSNASPHTNKKYLLKLDITDFFNSIDFLTVYRFVFIKYYPKQISYMLTKLCCKNGFLPQGAPTSPALSNLVLKSFDDYIGEWCKKRGVTYTRYCDDMTFSGDRPLLDVYKKVKNVLDKNGFDLNENKTVFVSSGNRQSVTGLTVNEKVNVSKDYKRKLRQEIYYALKFGFEDAIIKSDNKNFITVENGVEIADSMKYQDSLIGRVNYVLQIEPDNAWFRTKAKELAEKAVFD

SEQ ID NO: 2267 - protein, 353 aa, unidentified
  source 1..353: note = Oscillospiraceae bacterium; note = Related to SVOH01000020.1
MYIKDGTVRFDACDKNFVKKFGLIEAANMVLDFSSTHNIPFVYDVWQLSVYLGENPKCLWPIVKHVDDMYKVCFVPKRNGGTRQLCSPNSRLKAIQHNVLKKFLNNMPVSKYATAYIKGKTLSDNAKLHTNKKYVLKMDISDFFGSIHFDKIYNSAFNTTLFPKQIGYMLTSLCCRKDVLPQGAPTSPALSNIVMKRFDDYIGDWCKGRGISYTRYCDDMTFSSNKPLYNMYVKVKKVLEDMGFELNDKKTHFITSNSRQSVTGLTVNRKVSVSKDYKRALRQEVYFALKFGLAESIMHGDKTDFVKNNAPDTAAYYHNLLGRVSYVLQIEPNNNYFCEAIRELRTGKILAQI

SEQ ID NO: 2268 - protein, 357 aa, unidentified
  source 1..357: note = Related to JAFOYN010000067.1; note = Clostridia bacterium
MKENSFTISFEQHDMPFLKKYGLFKAMRKVRNHNKKYKVPFIDDTYQLAHALSITRKQLFDLSRNANKHYKQILLKKRKGGVRVINAPDPELKDIQRRILRRILYKSEISKYATAYAPDRKLKDNATPHVNHKYLLKMDITDFFGSITFLEVISSAFNSKIYPTQIGAMLTALCCKDEVLPQGAPTSPMLSNIVMKNFDNAIGGWCEKRDITYTRYCDDLTFSADIPLYNVYQKVEDMLIQRGFEVNESKTKFITNSGRQTVTGLTVNEKVSIPRDYKRQLRQEIYYALKFGLSESIVYGNKTEFMDSRGPNCWRYYQHLKGKLNHVFQVEPNNMWFRDADEKLWVAYIQPNMRYPY

SEQ ID NO: 2269 - protein, 352 aa, unidentified
  source 1..352: note = Related to JAFOFE010000078.1; note = Clostridia bacterium
MKLNKISVSFEHQDLHFLKKYGFFKAASMAKKHYKKYDVPFITDIYQLSHLFHDFNKNVFKLSKNANKHYKKKILRKSNGGIRILHAPDETLKFYQRRILEKILYKIPISKYATAYVPGKKLQDNASPHIKHKYLLKMDITDFFGSITYMQVISTAFNSNMYPVQIGAILTSLCCKDDVLPQGAPTSPMLSNIVMKNFDDILGHWCEKRNITYTRYCDDLTFSANIPLYHVYNKVSEMLEKRGFEVNEAKTKFISNTSCQKVTGLTVNEKVAIPKEYKRQLRQEVYYALKFGLKDSIIKGKKKEYIEFGVPDIHRYYDHLNGKLTYVLQIEPQNEWFENAHKKLKNLYTLCT

SEQ ID NO: 2270 - protein, 358 aa, unidentified
  source 1..358: note = Clostridia bacterium; note = Related to JAFXAP010000013.1
MKLNKFTVSFEQQDMHFLKKHGFFKASSMVKKHYKQHNTPFIYDTYQLANELRIFHKDVFELSKNIRKHYKLIMLRKKNGGLRYIYSPDANLKHAQLQILKNILNNIKISPYATAYVKGKNLKDNAKPHTNHKYLLKMDITDFFGSITYLQVLSTAFNRKRFPTQIGAMLSSLCCLNDVLPQGAPTSPALSNIVMKNFDDIIGAWCKKRNITYTRYCDDLTFSANSPLYNAYIKVKNMLEERGFELNEEKTKFITNSSSQRVTGLTVNEKVSIPKEYKRQLRQEVYYAIKYGLADSIVKGNKSEYINYGKPNIHSYFSHLEGKIFYVLQIEPDNTWFVKAAEKLNDRFCYEIKSTQCT

SEQ ID NO: 2271 - protein, 352 aa, unidentified
  source 1..352: note = Related to JAFTLW010000024.1; note = Clostridia bacterium
MRFHNGILSFDASDRYFLEKHGLHNTIKAAGKHYDSYETPFIRDTYQLAHQAGTFRKTLFELCKNTSKHYKTITLKKKSGGVRYIHAPDGTLKCAQQYILRNIVNKIAVSPYATAYVKGKRLHDNAAPHTNHRFLLKMDITDFFGSITFLEVISSAFPAKMYPVQIGAMLTSLCCLNDVLPQGAPTSPMLSNIVMRSFDDFIGSWCQKRGVTYTRYCDDLTFSSDAPLYGVYLKVKETLENRGFTVNEHKTKFITNASSQRVTGLTVNEKVSIPKEYKQQLRQEVYYAVKFGLANSILFGNKTDFVKNGVPDPVSYYEHLLGKLQYVLQIEPHNQWFGKAIKDLCDRYYLSK

SEQ ID NO: 2272 - protein, 350 aa, unidentified
  source 1..350: note = Related to SVRX01000013.1; note = Oscillospiraceae bacterium
MKKASNIIRNIQVFVKKLIGIFANSHSSKKQKSNKGISKELQSLADTLGTTTGELFALSKKADSCYKEIRIPKRSNGFRIIHSPNGKLKKVQKKILQSIISKAETSPYAMAYKKGKNLKDNADPHINHLYLLKMDISDFFSSITFHQVLSSAFPSTLFPTQCGVILTSLCTKDGVLPQGAPTSPALSNLVMKSFDEHIGFWCNERGIVYTRYCDDLTFSADYPLVVLSYKIEDMLNRWGFQVNKKKTKYIFFSSRQTVTGLCVNKKVSIPSDYKKTLRQDVYYALKFGLEDSMIHGKKNDFFENGKWDTARYKCHLIGKVNYILQIEPENKWFQAAKENLSKSFDPPLNS

SEQ ID NO: 2273 - protein, 355 aa, unidentified
  source 1..355: note = Clostridia bacterium; note = Related to JAFVQI010000036.1
MMVKRFITRFEKQDMHFVAKHGFFRAARMVRAHKKKHNAPFIADTYQLAHELGVRRRELFGLTRHPEYHYRILTLRKRNGGLRVLHAPLYQMKQVQQHILKRILPHLPVSPYATAYVQGKALADNAAPHVGHKYLLKMDITDFFGSITYLQVLSTAFPSTFYPPQIGAMLTDLCCYKEALPQGAPTSPTLSNIVMCRFDNAIGGWCKKRGIAYTRYCDDLTFSADTPLYHVYEKVKDKLEGMGFAVNERKTHFVTAASRQTVTGLTVNEKVAIPADYKRQLRQEVYYAIRFGLADSINQGGKPFRTIGNNPDVRRYYNHLNGKLNYVLQVEPHNRWFACAKEDLRRQFEDEICRW

SEQ ID NO: 2274 - protein, 361 aa, unidentified
  source 1..361: note = Related to JAGBGQ010000166.1; note = Clostridia bacterium
MIINDWSVRFENADAHFVEKYGFFHACHKVRQHVEKYDTPFVQDTHQLAATLALRHRQFFRLLREADAQYERVEIPKKNGGVRVLYAPNPLLKRVQFLILRLFLDGMPISRFATAYCKGKSLRDNASPHTGHTYLLKMDITDFFDSITFPQIVGTAFPKDMYPSHIRAMLTALCCRNEQLPQGAPTSPAISNLVMRRFDDVLGEWCEKHDIAYTRYCDDLTFSANKPLFAVHQKATAMLEGMGFTVNEAKTRFVKNTSRQAVTGLTVNEKVSISAEYKRALRQELHYAIKFGIRDSLVKGLKTAFLTNGQPDTERYYRHLRGKINYVLSVEPQNTWFADALKRLEVVYHWEVYEYVRYGKR

SEQ ID NO: 2275 - protein, 347 aa, unidentified
  source 1..347: note = Oscillospiraceae bacterium; note = Related to SVPL01000026.1
MIVRKDGVVLKKEDDNYIKKFGLMKAAEIAIEYKQTHKTPFIHDLFQLAAFIGPGKRSFFKLLKNVNNEYSFFEIKKKNGGFRKIYAPSPELCRAQRVILRGILSCYDVSPYASAYIEGKGLISNAQPHTNKKYILKMDITDFFGSISFEQVISTVFNKNYFPSAVGYALTTLCCYKGYLVQGAPTSPMISNLVLKHFDDVMGVWCEKRGISYSRYCDDITFSANEPLFCAYSKAKAFLSEMGFEINKKKTRFVSHTSQQNVTGLVVNEKVSVPKEYKRDLRQKIYYFLKFDKKDTAFKQSGREYYSYINYLLGRANYVLSIEPNDKFLKESILVLREKSDVEYWNE

SEQ ID NO: 2276 - protein, 328 aa, unidentified
  source 1..328: note = Related to RKDE01000011.1; note = Clostridiales bacterium
MFYRKYHSCIFKGYIMNDFSLTEIFNMREKEIYYVSNHISKHYKRVEIPKKTKGVRILYIPSKKLIYMQRIILNAFLSEYKISECATAYHKGSTLVSNALPHRNKKYVLKLDIEDFFGSITYGRVYKMFFKHFPVKYAKLFTELCCYNDKLVQGAPTSPAISNIIMLDFDNRVESYCKENNISYTRYCDDITLSADFSLDRTYHRIKKELQKAGFELNKRKTHFVKNTHQQKITGVVVNEKIQVPIEYRKKLRQELYYLYKFGANNVILKNNYTDYISNGNTLDVKYINSLLGRINYVLQIDPDNNEFAKEKEKLCSYVQQIKIQKIF

SEQ ID NO: 2277 - protein, 304 aa, unidentified
  source 1..304: note = Related to JAFUWO010000134.1; note = Eubacterium sp.
MLESTFNMSKRELYYVSNNIGKHYKKIIIKKKSGENRTLYAPDKKLKYIHRIILKEFLSDYKISACATAYHKGAQLVDNALPHINKKYLLKLDIKDFFPSIMFGRVYKLFYSKFPEEYAKLFAELCCYDDCLVQGAPTSPAVSNIVMLNFDNELEAWCKSNFISYTRYCDDITLSSDEPLVSAYHYVKKLLNKNGFEVNKKKTRFIKHTHGQYVTGIVVNEHLQVTREYRRKLRQDLYYLYKFGARDVILKNKLDDYILGKTTLNAKYMQSLMGRINFVLQVDPDNKEFKEEKTKLINYMNIRI

SEQ ID NO: 2278 - protein, 322 aa, unidentified
  source 1..322: note = Related to NZ_HG005285.1; note = Candidatus Stoquefichus massiliensis AP9
MWKYMNQEMCNQFLLSLHLIDGDLSDQEKIKLLYTISNTIENQYEIIKIKKNSGKLRTIYCPHPLLKSIQRKILHQILNHKSISSYAKAYHPHIGLKENALPHVHQKRILKLDIQDFFNHIQFINVYESCFSLAYFPKPIGMLLTQLCTYHDDLPQGAPTSAYISNLVMKDFDEEIGDWCSQRNISYTRYSDDMTFSGDLIPADVIRKVKQYLNPLGLKLNYQKIHVINHSQQQNVTGIVVNEKIQVPRLYRRKIRQTMHYIEAYGLQSHLEKIGYQKSPERYLNHIYGQVLYILQINAQDKEFQIYKDKLKEYENSYTFSV

SEQ ID NO: 2279 - protein, 315 aa, unidentified
  source 1..315: note = Candidatus Stoquefichus sp. SB1; note = Related to NZ_LN852692.1
MWKYMDQNQSQEFLLSLHLLHNQLSDKEKVKMLYSISNSIEENYNIIKIKKRNGSLRTIYQPHTNLKLIQRQILKTILNNRSVSTYAKAYHKNIGLKDNAYPHVHQKRILKLDIKDFFEHIQFIDVYNACFSLAYFPQSIGHLLTQLCTYHGYLPQGAPTSAYISNLVMKEFDEQIGEWCENKHICYTRYSDDMTFSGDFNPREVIQRVRKALYPLGLEINNQKIHVIGNGQQQNVTGLVVNQKVQTSSRYRKKVRQAIYYMKKYGLESHLSAIQYQQSPQNYLHHLYGQVQYILQINPLDQEFQSYQEYLKKIK

SEQ ID NO: 2280 - protein, 317 aa, unidentified
  source 1..317: note = Related to DVII01000099.1; note = Candidatus Coprovivens excrementavium
MIIHTKEDCNNFLLSLNLINKNISDSEKLRLLYTLTNPIEKNYKIYKIRKKNGQFRQIYIPNNLLKSIQRKILKNILNNKKISIYAKAYKKGVCLKDNAYPHLNKKIILKLDIINFFDNIEYYDIYRTCFSKEYFPPSVGHLLTNLCTYESRLPQGAPTSAYISNLVLKEFDEEIGHWCDEHNISYTRYSDDMTFSGDFNPQEIIKKVRHYLNYLNLKLNNKKIKVISNSKQQRVTGLVVNKKIQVPKKYRYKIRQEVYYIKKYGLLSHLQKINYEDKPLHYLNSLLGRLNYLLSINSNIEFIKYKEYLTKLRKTYL

SEQ ID NO: 2281 - protein, 313 aa, unidentified
  source 1..313: note = Firmicutes bacterium; note = Related to SVAU01000015.1
MINHTKEQSKEFLLSLNLINSKDVLKKLYSISNRIESNYKVYKIRKHNGKYRTIYSPNTLLKSIQRNILKNILNNKKISKYAKAYHKNISLKDNAMPHLNKKIVLKLDIIDFFENIEYPTIYRYCFNEIYFPKSVGHLLTTLCTYESRLPQGAPTSSYISNLVMNDFDNTIGEYCEQNNISYTRYSDDMTFSGDFNPSKLITIVRRELYKLGLKINNKKIHVINNSQQQNVTGIIVNKKIQVSSSYRNKIRQIIYYIKKYGLKDHLNRINYQESPSTYINSLYGKTLYVLSIDKTNKEFINYKEYLKELKKAI

SEQ ID NO: 2282 - protein, 318 aa, unidentified
  source 1..318: note = Candidatus Fimihabitans intestinipullorum; note = Related to DVML01000007.1
MWKYIGTKECNDFLLSLHLIDCLDQRKYIKTIYSISNNIEKNYKIYKIKKSNGGYRTIYEPNPLLKQIQKRILTSILNHKAISRYAKAYHKGTQLKDNAFPHVNKNMMLKLDIKNFFETITFLDIYNSCFSIEYFPKSVGMILTYLCTYDNHLTQGSPTSPYISNLVMQEFDEELGSWCDLMGISYTRYSDDMTFSGQFNPRKIISKVRKMLYRLGMELNDSKTHVVYKSSSQKVTGVVVNEKMQVSKRYRNKIRQEIYYIKKFGLNSHLKKCNIDINSITYVNILYGKILYVLQINETDKEFIKYKQFIKDLKGNIG

SEQ ID NO: 2283 - protein, 317 aa, unidentified
  source 1..317: note = Bacilli bacterium; note = Related to JAFRQS010000031.1
MWKYIGTKECNDFLLSLNLFNCKDENHYIKTLYSISNNIENNYRIYKIKKRNGKYRTIYEPNPLLKHIQKQILINILNNKTISEYAKAYHKGISLKDNANPHINKDIILKLDIKDFFENISFLNIYNSCFQIEYFPKSVGMLLTTLCTYDDHLTQGSPTSAYISNLVMKDFDEELGSWCKENSISYTRYSDDMTFSGSFNPSDIIKKVRKMLYSLGLQLNSDKIHVVTKNACQTVTGLVVNNKVQVGIKYRKEIRKEVYYINKYGLQSHLKKINIKDKNKYLNSLYGRILYVLQINKNDKEFISYKKIINKIKSDLS

SEQ ID NO: 2284 - protein, 317 aa, unidentified
  source 1..317: note = Related to FR887372.1; note = Clostridium sp.
MWKYIGKEECNEFLLSLKLFNCKDKKKYLNTIYSISNNIENNYKIYKIKKKNGKYRTIYEPNSLLKHIQRQILVKILDNKAISKYAKAYHKGINLKDNAIPHLNKELILKLDIKDFFENISFIDVYNSCFSIEYFPKSVGMILTYLCTYDDYLMQGAPTSAYISNLVMKEFDEVLGLWCEENNISYTRYSDDMTFSGEFNPREVIVKVRKMLYKLGLELNNKKIHIIHKSSNQNVTGIVVNEKVQVSAKYRKEIRQEIYYIRKFGLESHLKKRNIDIEKEKYINILYGKILYVLQINNKDNEFNKYKKFMNDFKNKF

SEQ ID NO: 2285 - protein, 318 aa, unidentified
  source 1..318: note = Firmicutes bacterium; note = Related to DLWG01000243.1
MWKYIGLKECNEFLLSLNLFDCKDEKKYIRTLYSISNNVENNYKKYKIKKSNGKYRTIYEPSLLLKHIQRQILNNILNDRMISSYAKAYRRGSSLKDNAIVHQNKKIVLKLDISSFFDNISFIDVYNSCFSIEFFPKSVGMLLTSLCIYNDYLPQGAPTSAFISNLVMRSFDEEIGSWCSLKNISYTRYSDDMTFSGDFDCKEVINKVRKMLSIKGLELNKDKIHVIKNSSCQKVTGIVVNNKVQVCSNYRKSIRQEIYYIKKYGLESHKKYRNILSSNRKYLNSLYGKVSYVLQINRDDKEFIDYKNYLLKLLKDNL

SEQ ID NO: 2286 - protein, 316 aa, unidentified
  source 1..316: note = Related to JAFRAB010000047.1; note = Erysipelotrichaceae bacterium
MWDYIGVKECNDYLLSLHLFDCEDERKYIRTLYAIANNIRNHYRKFQIRKHNGKMRTIYEPSGILKHIQKRILGEVLEDLKVSPYATAYTRGKSLLDNACPHVGCKMILKLDIKNFFENIWFLDIYNSCFPIELFPKSIGMLFTYLCTYDDHLVQGAPTSAYISNLVMRDFDYAVGNWCRQQGIEYTRYSDDMTFSGDFDPAAVIRKVRRELYRLDMELNDSKTRVIYRSHRQCVTGVVVNEKPQVSKKYRKEIRKQMYYIEKYGLSEHLKRTGKAEKGYLETLKGCICYVLQINPDDAEFRQYLKKANELLYADK

SEQ ID NO: 2287 - protein, 316 aa, unidentified
  source 1..316: note = Related to JAFWHJ010000089.1; note = Erysipelotrichaceae bacterium
MWDYIGVKECNDYLLSLNLFDCDDRQKYIRTLYAIANDVRKHYTKYQIRKHDGKMRTIYEPSGILKHIQKRILTEVLEDMRVSPYATAYTKGKSLLDNAQPHVGQKMILKLDIRHFFENIWFLDIYNSCFPIELFPKSVGMLFTYLCTYDDHLVQGAPTSAFISNLVMREFDYEVGNWCNQKNISYTRYSDDMTFSGDFDPSGVIRKVRRELYKLDMELNDSKTRVIRRSHRQCVTGLVVNEKRQVSREYRKEIRKQIYFIQRHGLSEHLARIGRDEKGYLERLKGSICYVLQINPDDAEFRKYLEDIDELSYANK

SEQ ID NO: 2288 - protein, 322 aa, unidentified
  source 1..322: note = Bacilli bacterium; note = Related to JAFTRC010000024.1
MWKYITKEQVQEFLLSLNLLDNKLNDKDNINKLYSISNNIENNYKIFKIKKRNGKFRTIYEPNYTLKNIQRKILNNILNNKSISKYAKAYKKGTSLKDNAKEHLNKNIILKLDIKNFFESIQFIDIYNSCFPIEYFPKEIGMLLTFLCTYNNYLPQGAPSSSYISNLVMKEFDEYIGDYCDKNNISYTRYSDDLTFSGNFNPSIIIKKVRKDLLKMGLEINDSKTHIIKKGNRQSVTGIVVNEKLQISSDYRKEIRKQIYYIKKYGIESHLEFTNNNISEIKYLNSLYGKINYVLQINKDDNEFIEYKKYINKLLKEKRPKN

SEQ ID NO: 2289 - protein, 321 aa, unidentified
  source 1..321: note = Bacilli bacterium; note = Related to JAFQQQ010000003.1
MWKYITKEQTKDFLLSLNLIDDKLSDKEKINILYSISNNIENNYRIFKIKKRNGKLRTIYEPNPTLKNIQRRILNNILNNKSISKYAKAYKKGICLKDNAVEHLNKETILKLDIKDFFENIKFSDIYDSCFSIEYFPKEIGMLLTHLCTYNNHLTQGSPTSAYISNLVMKEFDEYIGDYCEDNNISYTRYSDDLTFSGNFNPSNVIKIVRKALLKLNLEINDDKTCIINKGNRQTVTGITVNEKAQICSTYRKNIRKEIYYIKKFGIDSHLKFTNNNITPLKYLRYLSGKINYVIQINNNDKEFLKYKIYINELLREKRVD

SEQ ID NO: 2290 - protein, 317 aa, unidentified
  source 1..317: note = Bacilli bacterium; note = Related to JAFQTN010000005.1
MWKYLSKDKEKEFLLSLHLINGVNDEDILNKIYTISNNIEKNYKIFKIKKRNGKTRTIYEPNPNLKIIQKNILHNILEDRYISYSAKAYKKGISIKDNANEHVDKDMILKLDIKNFFNNITYIQVYCSCFKEIYFPKSIGTLLTNLCTYNDSLPQGAPTSSYISNIIMLDFDIKIGEYCKENNVSYTRYCDDMTFSGNFSKMEIINLVKSELKKLGLTLNHDKTKLITKKNRQYVTGIVVNKKAQVSIDYRKEIRKNIYYIKKYGLNSHMNYQKMSLPKEKYLNILLGRINFVLEVDKANKEFIEYKKYILKLIKDR

SEQ ID NO: 2291 - protein, 317 aa, unidentified
  source 1..317: note = Related to HF998250.1; note = Coprobacillus sp.
MWKYTTKEVCNDYLLSLFSFDLISSNQETLKLLYKISNNKEKYYHVIKIKKKSGGYRTIYQPSPTLKYIQKTILDKVLKEKGISKYAKAYYNGASLTTNAKPHLNQKIILKLDIKNFFPSTNYLTIYKACFSKELYPKSIGTLFTSLCTYQDFLPQGSITAPYISNLVLKDFDNGIGTFCQKRNINYTRYCDDMTFSGNFDPHHIIKCVANKLHKIGYELNKKKIHIITNNKRQEVTGIVVNKKLQVPKDYRHKIRQELYYVTKYSLSSHLERNNIKDKETYLQSLYGKILYVLQIDPSNKEFIKYKELISLELNKM

SEQ ID NO: 2292 - protein, 317 aa, unidentified
  source 1..317: note = Related to HF993109.1; note = Mycoplasma sp.
MWQHLTKKQINNFILSLNLISFNNLSNKEKLKLLYTISNHGEKHYKVFKIPKKNGGYRTIYEPDYTLKMIQENILTNVLNERIISSYAKAYKKGLSLLDNALPHLRQKIVLKLDIKDFFPSIDFLKVYKKAFPRHIYPEAVASLLTNLVTYNNTLPQGAPTSSYISNLVLRSFDIKIGSFCQSKNIAYTRYCDDMTFSGEFNPQEIINLVKTELFKENFILNKKKIKIIKSNKAQIVTGIVCNEKLSIPRTYKKFIRQNMYYINKYGLNNHLKYINYLDSKDYLNKLYGQILFVLQIEKNNKEFLNYKNELIKLKEN

SEQ ID NO: 2293 - protein, 319 aa, unidentified
  source 1..319: note = Related to DVMT01000048.1; note = Candidatus Aphodocola excrementigallinarum
MFRYLSLDKYNDLLSSFNLVNTTDIKKINKMLYNISNNIDANYEEIIIHKKTGGLRFLYAPSKELKSIQKRILKNVLEEKKLSRYSYAYRKKVSVLDNAKPHVKKDVIVKLDIKDFFDNITFSMVYDSCFNETLYPKKMGMLFTNLCVYNNRLPQGAPTSGFISNIVLRNFDEKVGSYCEKRKISYTRYSDDLTFSGNFNVKDLIKYVNKLLYEYNFRLNKKKIKVVSKKTRQQVTGIVVNEKVNIRRNYKRKIRQEMYYIKKYSLKSHLKNIAYKCDEKTYLLNLLGRINYVYNITKDTEFYNYKKDVTKLVKKLDLK

SEQ ID NO: 2294 - protein, 317 aa, unidentified
  source 1..317: note = Firmicutes bacterium CAG:822; note = Related to HF990861.1
MLDNVTKDMANEFLLSLNLIDEKLSDKEKIRKLYTLSNNIEKNYKKTVILKKDGNKRIIYEPNYTLKKVQRNILDNVLSGFKVSKYAMAYVKGKSVKDNANMHVNKKLILKLDIKDFFNNISFMDVYNKVFLEEYFPKQARTVLTYLCTYNEFLPQGAPTSSYISNLIMQDFDEKIGLFCEKNNISYTRYSDDMTFSGDFNVKMVIFKVKDELKKMGMQLNYDKIHVIYSNMSQQVTGITVNEKPQVLKVKRRKIRQEVYYIKKYGLYSHLKRINVKDEFSYLRSLLGKINFVLMVNSEDLEFFKYREFILKIFNNL

SEQ ID NO: 2295 - protein, 313 aa, unidentified
  source 1..313: note = Firmicutes bacterium; note = Related to SVAM01000009.1
MWKYLTKEHKKEFILSLNLIGGKFSDTEKLNILYAISNNSEKYYTTKYINKKDGTKRELLVPNKTLKNIQKNILNNALNDLEVSKYACAYIKNKSLKDNASPHINQKVVLKLDIKDFFTSITFEEIYKVIPNELFPTSIKVLMLKLCTYYDYLPQGAPTSPYLSNLVLKNFDNYIGTYCKERNINYTRYCDDLTFSGDFDVKKLKNKVQAFLEEIGYNLNDKKTKVIKNNKRQIVTGLVVNEKVNIPISYRKKIRQEMYYINKYGIDSHLKYINNTNKEKYINSLKGKINYCLNINPNNTEFQSYLKKLNNLL

SEQ ID NO: 2296 - protein, 315 aa, unidentified
  source 1..315: note = Related to JAFWVI010000074.1; note = Ruminococcus sp.
MIDTDVLIISETLDVPVNKLYMLSNNYTSRKKHRRSKYENYHMVVIHHGIVHKKRMLSVPNAFLKTVQRRILDQYLYQLEESEYSTAYCKGKSLLDNASPHVGKECVLKLDISHFFDSIDDDMVYLVMKRLGLSVPATALLTHLCTYRAKLPQGAPTSPYIANLAMKQFDEKLGRWCSERNIAYTRYCDDMTFSGSKAAIRESRIISKVRSMMYRMGFMLNDKKTVFISSSQQQRVTGIVVNEKPVLSRTQRRAIRQEVYYCQKYGAAKSIKRRKLNISPDKYLHSLLGRIAFALQIEPDNSEMKGYFETVKNMI

SEQ ID NO: 2297 - protein, 315 aa, unidentified
  source 1..315: note = Related to FPJT01000001.1; note = Ruminococcus flavefaciens
MLDADIIKISEALDVPVNKLYMLSNNYKPRKKRRGSTYENYHTVVIHHGRGHKNRRLSVPNAFLKMVQRRILECYLYQLEVSDHSTAYCKGKSLLDNASPHVGKECVLKLDISHFFDSIDDDMVYLVMKHLGLSVPATALLTHLCTYKTRLPQGAPTSPYIANLVMKQFDEKLGCWCRRNNITYTRYCDDMTFSGTKSAIRESRIISKVRSKLYHMGFTLNDKKTVFISSSQQQRVTGIVVNEKPVLSRSQRRAIRQEVYYCQKYGAVESINRKGLDIPSDKYLRSLLGQIAFAMQIGPDNAEMRRYFDTIKNLI

SEQ ID NO: 2298 - protein, 317 aa, unidentified
  source 1..317: note = Related to JAFTYF010000065.1; note = Ruminococcus sp.
MIDADVMKISETLDVPANKLYMLSNNYTARKKRRGSKYENYHTVIIHHGRGHKNRKLSVPNAFLKMVQRGILEQYLYQLEISEYSTAYCKGKSLLDNASPHVGKECVLKLDISHFFDSIDDDAVYLVMKRLGLSIPATTLLTHLCIYKARLPQGAPTSSYIANLVMMQFDERLGSWCSERNITYTRYCDDMTFSGNKADIRSANVVGKVRRMLYRMGLTLNDKKTVFISSSQQQRVTGVVVNEKPTLSRSQKRSLRQEVYYCQKYGAAKSINRRGLDISPDKYLHSLLGRIAFALQIEPENAEIKEYFETVKNLINT

SEQ ID NO: 2299 - protein, 314 aa, unidentified
  source 1..314: note = Related to NZ_JAEF01000007.1; note = Ruminococcus flavefaciens
MYNDIPYIAETLRVPVGKLYMLSNNYKPRKKRKGSIYENYHTVVIHHGRGHKNRTLNVPNAFLKLVQRRLLDNFLYQLKVSEYSTAYCKGNSLLDNAAPHVGKECVLKLDISHFFDSIDDDKVLFVMKRLGVSITATVLFTHLCTYKGKLPQGAPTSPYIANLVMKQFDEKLGHWCSEYNITYTRYCDDMTFSGYKADIHSAKVVGKVKRMLYHMGFTLNDKKTVFINSSQQQRVTGIVVNEKPTLSRSQKRTLRQEVYYCQKYGAAESINRKGLDISPDKYLHSLLGRIAFALQIEPDNSEMREYFETVKNLI

SEQ ID NO: 2300 - protein, 318 aa, unidentified
  source 1..318: note = Related to JAFPPE010000436.1; note = Ruminococcus sp.
MDSDVISIAENLGTTAAKLYMLSNNYSPKNKRHGSRYANYHKVTIQKPGSHKSRTLHVPNGFLKMIQRRILDKYLYTLEVSEFSTAYRKGTNLLDNALPHVGKECVLKLDISDFFGSIDDDAVYMAMKGLGLSVPATALLTHLCTYHGILPQGAPTSPYIANLVMRHFDGKLGKFCISRNIAYTRYCDDMTFSGSREDILRAKLPGKVKAMLAARNFILNDSKTVLVYASRQQRVTGIVVNEKTTVPRSSRREIRQQVYYCRKFGAQDCIRRKGLDITPEKYLSGLLGRITFALQTDPENKQMQEHFRTVREMIGKLT

SEQ ID NO: 2301 - protein, 317 aa, unidentified
  source 1..317: note = Related to JAFXEJ010000141.1; note = Ruminococcus sp.
MTDSDVLKIASEIEISVNKLYMLSNNNSPRHKSRKKKHRNYHTVIIHRGRGHRNRILSVPNTLLKLVQRKILDCFLYQLETSEYSTAYCKGKSLLDNASPHIRKECVLKLDISHFFDSITDDSVYLVFKQFGLSVPATSLLTHLCTYKGKLPQGAPTSPYIANLVMKNFDKKLGKWCKERNITYTRYCDDMTFSGDKTSVRKNKIIVKVKAMLGSMDMKLNDKKTIFISSSQQQRVTGIVVNEKAAIPREMRRSIRQEVYYCTKFGISDSLQQQRLDISPDKYLHSLLGRISFALQIDPYNSEIQKYFDTVKQLMNA

SEQ ID NO: 2302 - protein, 317 aa, unidentified
  source 1..317: note = Related to JAFVBU010000121.1; note = Ruminococcus sp.
MIDKDVLQISETLGVPVGKLYMLSNDYIPRKKSRKSKYNNYHTVVIHRGRGHKNRVLSVPNNFLKMVQRRLLERYLYRLDVSECSTAYSKGKSLLDNASPHVGKECVLKLDISHFFDSIDDDMVYMIMKQFGLSDPATALLTNLCVHNCKLPQGAPTSPYIANLVMTHFDEKLGAWCSERSIAYTRYCDDMTFSGTKEAVKSSHIIRKVKRMLYRMGFELNEKKTVFISSSQQQRVTGIVVNERPQLTREMRRSIRQEVYYCTKYGVKESLQHRGLDISEQKYLHSLLGQISFALQIDPQNEDMRRYFDTVKNLMNT

SEQ ID NO: 2303 - protein, 317 aa, unidentified
  source 1..317: note = Related to JAGAMS010000071.1; note = Ruminococcus sp.
MIDADVIKISETLDVPVGKLYMLSNDRFPRKRRRKSKYTNYHTVIIHRGRGHRNRKLSVPNSFLKMVQRRILEHYLYNLDVSAFSTAYCRGKSLLDNASPHIGKEYIVKLDISHFFDNIDDDMVFMIMRQLGLTMPATSMLTNLCVHNGRLPQGAPTSPYIANLVMKHFDEKLGVWGAENNITYTRYCDDITLSGTKKAIESSHPVGKIRRMLYRIEFNLNEKKTVFASSSQQQKVTGIVVNEKPQISREMRRAIRQEVYYCAKFGVTESLKRNGLNISAKEYHHSLLGRISFALQVDPANDEMQSYFNTVKNLISK

SEQ ID NO: 2304 - protein, 320 aa, unidentified
  source 1..320: note = Related to UETD01000003.1; note = Ruminococcus flavefaciens
MTDVDVMLISEVLGVPVRKLYMLSSDRVPRQKRGGSYSNYHQSVIYTGRTKKKRVLTVPNGFLKLVQRRILDRCLSKLPVSEYATAYRKGTSVRDNALLHTGKEFIIKLDISGFFDSINDDAVYMVMKQFRLSPRATSLLTHLCVHRGVLPQGAPTSPYIANLVMKHFDEHIGAWCAERNITYSRYCDDMTFSGSRDDLLGSRLVGKVGRTLYAMGFTLNREKTVFAGSSQRQTVTGLVVNEKADLPREKRRELRQEVYYCLKYGVREHLSQRGSSDAPLRYINGLMGRLAYQLQQRPEDEKLREWFVQIKKLRESEGDK

SEQ ID NO: 2305 - protein, 317 aa, unidentified
  source 1..317: note = Related to NZ_ATAX01000036.1; note = Ruminococcus flavefaciens
MTDVDVMLVAEVLGVPVHRLYMLSSDRMPRNKRGGSYSNYHKSVIYSGRSKKKRVLTVPNGFLKTVQRRILHRCLYKLPVSEYATAYCKGRGPADNASPHTGKDYIIKLDISDFFGSINDDAVYMVMKQLKLTPRATSLLTHLCVHNGVLPQGAPTSPYLANLVMKHFDGRIGSWCAERNISYTRYSDDMTFSGRRGDLLASGLTGRVRNMLYSMGFELNSKKTVFAVCSQRQTVTGAVVNEKVNVPSELRRKLRQEVYYCTRFGVEDHLARCGSGEAPKAYISGLLGRLSYALQLRPDDEWLRSGFEKIKAMSNDI

SEQ ID NO: 2306 - protein, 319 aa, unidentified
  source 1..319: note = Related to JAGPNI010000006.1; note = Ruminococcus sp.
MTDSDVLAVSHALDVPVGKLYMLSNERIPRQAKSSSSKYKNYHTVVIKKGLFRKSRKLSVPNALLKMTQRRILHQYLYRLELSSFSTAYQPGRSLKDNASPHLHQEYLIKLDISKFFDNIDADMVYSVMRQLGLSQAATVLLMRLCVHNSVLPQGAPTSPYIANLVMKRFDEHLGEWCGRRGINYTRYCDDMTFSGRKTDLLTCDLVRKVRRMLHGMGFELNERKSLFLSCANQQKVTGIVVNEKLQVPRELRRQLRQEVYFCLKFGPKESMKRRGLKTSPEQYLHSLLGRIAFALQIDPDNLEMQGYHSQIKELTAQL

SEQ ID NO: 2307 - protein, 319 aa, unidentified
  source 1..319: note = Related to JAFUAO010000003.1; note = Ruminococcus sp.
MTDRDVTELSRALGVPVGKLYMLSNERIPRKPKRGSSKYKNYHTVVIKKGLFRKSRKLSVPNGLLKMTQRRILHQYLYRLEASRYSTAYQPGRSLRDNASPHLGQEYLIKLDISKFFDNIDADMVYNVMRQLGLSRAAAVLLMRLCVHNSVLPQGAPTSPYIANLVMKPFDEHLGDWCRARGINYTRYCDDMTFSGRKADLLTCHLVGKVRKMLRRMGFELNDKKTLFLSRGSQQKVTGIVVNQKLKVPRELRRTLRQEVYYCTKFGAEESLKRRRLDMAPEEYLRSLLGRIAFALQIDPEDSEMQGYHSQIKALAAQK

SEQ ID NO: 2308 - protein, 320 aa, unidentified
  source 1..320: note = Related to JAFZOZ010000090.1; note = Clostridia bacterium
MADADVIKIAQSLGVSVKSLYMLSNNPMRLREKRRKPRYENYRRVVIHRGRGRKNRVLSVPNEFLRRVQRGILKKYLYNLEPSEYATAYLPGFSVRANALPHTGKEFIVKTDILHFFDSIDEELVWRTVRELGFSIPATTLLTDLCVYRDRLPQGAPTSPHLANLVMRRFDEKIGAWCKERGITYTRYCDDMTFSGQKDALCGVGLIGEVRKELHRIGLQLNDEKTAFIPASQQQRVTGAVVNKKTRLSRDARRELRQAVYYCEKFGVKEHLAHRNDPSAPEEYLRSLLGKISFALQLDPTDGEMREMFRKIKKLTDGSK

SEQ ID NO: 2309 - protein, 325 aa, unidentified
  source 1..325: note = Related to NZ_HF545616.1; note = Ruminococcus sp.
MNDIDNDIIRISEELDVPLKKLYMLSNNRIRYHKRNQKKCYSNYRKVIIHRGRGHKNRVLKVPNEYLKLVQRRILERYLYTLSVSEYATAYCKNSSLLKNAEPHIGQQRVLKLDVSGFFDSIDFGKVYGVMCELGFSKPATTLLTNICTYNSILPQGAPTSPQISNLMMKRFDERIGKWCGERGINYTRYCDDMTFSGGKAVLNAKEITQLVSRALWKMGFKLNMKKTTLIGSSQRQQVTGIVVNEKAQISSKQRREIRQEIYYCEKYGVSQSLFFKGADITPEKYINSLLGRISFALQIDPADVKMHEYFKVVKKLKSEVCVEK

SEQ ID NO: 2310 - protein, 319 aa, unidentified
  source 1..319: note = Candidatus Saccharibacteria bacterium; note = Related to JAFWIW010000020.1
MNEQEVNYMSSLFLGASTLEKRDLINLMPNKIVRKYYIRHDIPKRTGGIRVIYEPSQTLKTVQRRINRWFLKDAPVSDFAFAYVKGRCILDNAKPHVGKPILLKLDIHHFFDNIHFESVFDIFKSLGFSENFARLVAGLTTVDDYLPQGAPTSPALSNLFLKEFDEEIGEYCSKNDIVYTRYSDDLTFSMYRFNPDLVKFVREKLGALGLELNRKKSKIICGPLQKRVTGVVVNNKPQVPRSYRHKIRQEMYYISKYGLDASLNTRNITDKEKYVSCLLGQINFVLQINKNDDEFKKYREILMTPSLDNLRSQLTNLLN

SEQ ID NO: 2311 - protein, 310 aa, unidentified
  source 1..310: note = Related to JAFSSJ010000008.1; note = Bacilli bacterium
MNSNEKKFLLSLFSFDKNLSDNEKIKKMYIMSNRIEKYYHHFTIKKRNGTERNILCPYTQLKKIQLNILNGLLYDKSVSVFAKAYIKNSYLVDNTIIHRGHKYILKLDIHNFFENISYVDIFNIYKEYGFSNALCSLLAHLTTYNDYLPQGAPTSPYLSNLVLRNFDYKVGKWCEKQNINYTRYSDDMTFSMNEYNKDLIRFIRINLFKQGLELNNEKICLIHHSQQQKITGIVVNDKIQVDSKYRKKIRQELYYINKYGLDEHLERNKTKDKKKYLKILYGKILFVLSVDKNNKEFIKYKMIVRKILNG

SEQ ID NO: 2312 - protein, 350 aa, unidentified
  source 1..350: note = Related to JAFTUG010000010.1; note = Clostridia bacterium
MLYLNSQKALIDLLYEDWCEDISKEVFTAFIYRISNNPQNFYRRNQIYQKNGKVRNVDVPSQGLKIIQRIILKRILENIPVHNSARAYIKGSSLRDNAGAHCGRKCVVKLDIKRFFEHIDEKSVYLIFRRLSYPPDVCRMLTKLCCLKGRLPTGAPTSPYLSNLFMKKFDREMSLFCENKNISYTRYSDDITFSFDSFDKTRLIRVTRNFLGLYANGLPLNQKKIFVVTSNKKQKVTGLVVNEKTSVDKELRRNIRQAVYYIGKFGVSDHIRHLQSSEYGGWVMFIADDWHFRMVKLRYLRTLQGRISFCLCADPDNTEMKQYAEFIKEIIKKEKEEICILKMSFQNAKK

SEQ ID NO: 2313 - protein, 306 aa, unidentified
  source 1..306: note = Oscillospiraceae bacterium; note = Related to SVTP01000007.1
MIVYQELASIERDLGFSAKTLYGLSNHLEKHYHNVLIPKSDGSKRKLSVPELILKRVQRSIADHILVQFPVSNYAKAYKIGGSVQHNAQPHVGKKKILKLDIEGFFDHILYSQVKEKVFCKEKFAEPIRILLTMLCYYKESLPQGAPTSPAITNIIMYDFDQTVGAFCNERGISYTRYCDDMTFSGDFDEGEVIAFVKGELYRLGLFLKNRKTVVVPASKRQTVTGIVVNEKINLTKEYKKKIRQEMYYIQKFGIDEHLTRLGVSDKRGYLLSLMGRISFVLQTVPNDCEFAKYRKMLTQGSFQNA

SEQ ID NO: 2314 - protein, 303 aa, unidentified
  source 1..303: note = Related to SVQS01000086.1; note = Oscillospiraceae bacterium
MIVYKELASIEQDLGFSARTLYGLSNHLEKHYHNVFIPKSDGSKRKLSVPDLILKRVQKSIADNILVQFPVSRYAKAYKVGSSVQRNAQPHIGKKKLLKLDIEGFFDHILYSQVKDIVFCEEKFAEPIRILLTMLCYYKESLPQGAPTSPAITNIIMFDFDETVGAFCNKKNIAYTRYCDDMTFSGDFDEGEVITFVKKELFKLGLFLKNRKTVVLPASKRQTVTGIVVNEKLNITKEYKRNIRQEMYYIQKFGMDEHLNKLGISDKRGYLLSLKGRISFVLQTIPNNREFVEYRKVLNANLL

SEQ ID NO: 2315 - protein, 377 aa, unidentified
  source 1..377: note = Oscillospiraceae bacterium; note = Related to SVRN01000036.1
MASRHLFTHAQLIRCTSPTKDFLRKLLLNGLVPLSRNAHRSAARLRKLHLADLRLRVSPCKLVLFYDPSGKESDMIVYKELASIEQDLGFPARTLYGLSNHLEKHYHNVFIPKSDGSKRKLSVPDLILKRVQKSIADHILSQYPISRYAKAYKVGSNVQRNAQPHVGKKKMLKLDIEGFFDHILYSQVKNIVFYKEKFSEPIRVLLTMLCYYQEALPQGAPSSPAITNIIMYDFDERIGAFCNEKHIAYTRYCDDMTFSGEFDEREVISFVKEELSKLGLFLKNRKTAVIPASKRQTVTGIVVNEKLNVTKEYKKAIRQEMYYIKKFGVDDHLARLGISDKQHYIRSLAGRIAFVLQTTPSDGEFAGYKKFLAECSL

SEQ ID NO: 2316 - protein, 303 aa, unidentified
  source 1..303: note = Related to SVST01000008.1; note = Oscillospiraceae bacterium
MIVYKELASIEQDLGFSAKTLYGLSNRLEKHYHTVYVPKSDGTKRKLSVPDLILKLVQKSIADNILVQYPISRYAKAYKVGSNVQKNAHPHVGKKKLLKLDIEGFFDHILYSQVKDIVFYQEKYAEPIRILLTMLCYYHDSLPQGAPTSPAITNIIMYDFDETVGAFCDSKNIAYTRYCDDMTFSGDFSEKEMIGFVKNELSKLGLHLKKRKTAVIPATKCQCVTGIVVNEKMNLTKDYKKKIRQEMYFIKKFGLDGHLKKMGVSDKEQYLLSLKGRIAYVLQTIPNNDEFTEYKKILHSIRV

SEQ ID NO: 2317 - protein, 302 aa, unidentified
  source 1..302: note = Related to JAGALS010000020.1; note = Clostridia bacterium
MIIYKELSSIEKVLAYPAKTLYGLSNNLEKHYHTVFVPKSDGSKRKLSVPDLILKNVQRSIADHILAYYPISRYATAYKVGSSIQKNARPHVNKKKILKLDIEGFFDNILYSRVKDVVFYEEKYSEPIRILLTMLCYYQESLPQGAPTSPAITNIIMYDFDEKIGAYCTEKGVSYTRYCDDMTFSGDFDEKEVIALVTSELQKLGLFLKNRKTVVIKNTKRQTVTGIVVNEKINLVKEYKKKIRQQMYYIKKFGIESHAEHLGITDVFGYLSSLKGQVAFVLQTCTQNAEFKGYQEFLQNLK

SEQ ID NO: 2318 - protein, 302 aa, unidentified
  source 1..302: note = Clostridia bacterium; note = Related to JAFTNT010000011.1
MIVYKELCSIEKDLGYPAKTLYGLSNRIEKHYHTVFIPKSDGTKRRLSVPDLILKSVQRSIADNILAYYPISEYATAYKVGSSVQRNARPHVNKKKILKLDIEGFFDNITYSRVKDIVFYEDKFSEPLRVLLTMLCYYRDSLPQGAPTSPAITNIIMYDFDEKIGAYCSKNGVSYTRYCDDMTFSGDFNEQEVISLVKEELRKLGLFLKNRKTAVIERTKRQTVTGIVVNEKINLTKEYKRKIRQEIHYIEKFGIEGHAKKQAITDVAEYLTSLKGRIAFVLQTCPDDSEFLKYKAIVHPLH

SEQ ID NO: 2319 - protein, 302 aa, unidentified
  source 1..302: note = Bacilli bacterium; note = Related to JAFVUY010000073.1
MIVYRELNTLATDLGFPLKTLFALSNNIDKHYHNAFIPKSDGTKRKLSVPDKILKLVQKSIADNILAYYPVSKYACAYTYGSNVQKNAAPHIGKKKILKLDIEGFFDNIIYSRVKDIVFYKEKFSEPVRVLLSMLCYHRDALPQGAPTSPAITNIIMYDFDEIIGCYCNEKGISYTRYCDDMTFSGDFDEKEVIVLVKQELKKLGLFLKNRKTAVIPNTKRQTVTGIVVNEKINLAKEYKKKIRQEMHYITKFGLDEHLKRTGETDKKKYLLSIKGRIAFVLQTTPNDKEFLEYKSLLTKEK

SEQ ID NO: 2320 - protein, 302 aa, unidentified
  source 1..302: note = Related to SVHW01000007.1; note = Clostridiales bacterium
MIVYRELKSIEHDLGFSAKTLYGLSNNLDKHYHNAFIPKSDGTKRKLSVPDLILKKVQRSIADNILAYYPTSKYACAYAYGASVQKNAMPHVGKKKILKLDIEGFFDNIIYSRVKETVFFKEKFSEPIRILLSMLCYYLDSLPQGAPTSPAITNIIMYDFDEKIGSYCAEKGIAFTRYCDDMTFSGDFNEKEIIELVKSELKKLGLFLKNRKTAVVPNKKRQIVTGIVVNEKINLTKEYKKKIRQEMYYIKKFGLEDHLRKIGQSDKQRYLLSLKGKIAFVLQTIPDKNEFLEYKELLSRKY

SEQ ID NO: 2321 - protein, 301 aa, unidentified
  source 1..301: note = Clostridia bacterium; note = Related to JAFXAN010000018.1
MIVYKELKTIEHELGFPAKTLYGLSNNLESHYRTVFIPKRDGNKRKLSVPDSILKMVQRAIADNILSYYPVSSYAMAYSPGCSVQRNASHHIGKKKILKLDIEGFFDNITYSRVKDIVFFKEKFSEPIRILLTMLCYYKESLPQGAPTSPVITNILMYDFDERVGEYCREKQISYTRYCDDMTFSGDFDEKKIIAFVKNELKKLGLFLKNRKTAVVPVTKRQTVTGIVVNERINLTKDYKKKIRQEMYYIRKFGIDGHLKKLEITDKKAYLNSLKGRISFVLQTIPNDKEFLEYKNILKCQ

SEQ ID NO: 2322 - protein, 302 aa, unidentified
  source 1..302: note = Related to JAFTHO010000004.1; note = Clostridia bacterium
MIVYHELASLQKDLGFSAKTLYGISNNIAKHYHTVLVPKKDGTKRKLSVPDVMLKRVQRAIADNILSQYPVSRYATAYKPGASVQKNAGKHVGKQKILKLDVKGFFDNILYSQVKDIVFYEKKFSEPIRILLSMLCYFNDSLPQGAPTSPAIANIIMYQFDQNVGSFCKQNNVTYTRYCDDMIFSGDFDERQIVSFVTSELKKLGLFLKDKKTAVIPNSKRQIVTGIVVNQKANVARQYKSKIRQEMFFIKKFGIDGHLQKTGINNRQKYLNSLKGRIAFVLQTLPGDKEFLKYKNYLANLK

SEQ ID NO: 2323 - protein, 315 aa, unidentified
  source 1..315: note = Related to JAFVYN010000052.1; note = Clostridia bacterium
MIVYHEVATVARELGIPLKTLYGVSNNISAHYHKVALPKKNGGTRILSVPDPVLKTIQCAIADTLLPLSPVSRYAKAYKPAASVKANALPHVGKKKLLKLDILHFFDSILYSTVKEKVFPASRYAEPIRILLTMLCYERDALPQGAPSSPAITNIILFDFDETVGAFCHERGIAYTRYCDDMTFSGDFDEKEVTAFIEAELRIRGFFLNRSKTAVIRHTRRQTVTGIVVNEAPALPRATRRELRQAVYYCKTYGVANHLARIQSSTSPGKYLEKLLGKISYALSVDPDDADLQKARKTVLLLIGLEKHIPDPTQP

SEQ ID NO: 2324 - protein, 305 aa, unidentified
  source 1..305: note = Clostridia bacterium; note = Related to JAFTKF010000062.1
MIVYRELSTLERDLGFSAKTLYAVSNSIDRHYHKVTLPKKSGGTRTLSVPDEILKKIQRAIAEKLLAYHPVSQYAKAYKPAASVKRNAMPHVGKKKLLKLYILHFFDSVLYNTVKDRVFPETVFSEKLRILLSMLCYYRDVLPQGAPTSPVITNIILYDFDETIGDFCLSRGIAYTRYCDDMTFSGDFDEKEIIKTVQQELNARGFLLNRKKTAVVPSSKRQVVTGIVVNEKLSLSRSARRSLRQALYYCKTYGVSEHLAHCGIHDTPKHYLESLLGKIAYALSIDPDDSELLNCKETVTRLLQE

SEQ ID NO: 2325 - protein, 307 aa, unidentified
  source 1..307: note = Clostridia bacterium; note = Related to JAFTRY010000008.1
MIVYTELRSLEIDLGIPIKTLYAVSNNINAHYYSKSIPKSDGSQRVLSIPDEPLKKIQRAISEKLLVYEPVSIYAKAYKPTSSVRKNAVCHVGKEKLLKLDIYKFFDSINYSLVKEKVFPSNKYSEQIRILLSLLCYKGEPLPQGAPTSPVISNIIMRDFDQTVGEWCKERKISYSRYCDDLSFSGSFDETDVIEFVTVNLKSLGCILNKKKTHCFKGKEKKTVTGVVVNEKINTQKSYRRQIRQEFFYCQKFGVQEHLSRIGSSEKPYNYLSRSLGQINYVLQITPDNKEFLSYKVQILALLKEHK

SEQ ID NO: 2326 - protein, 307 aa, unidentified
  source 1..307: note = Oscillospiraceae bacterium; note = Related to SVSM01000002.1
MIVYKELQSLETDLGVTAKTLYATSNNINAHYHNKSIPKSDGSIRVLSIPDEPLKKIQRAISEKLLAYEPVSIYAKAYKPASSIRKNAICHVGKEKLLKLDIYNFFDSIKYSLVKEKVFPAKKYSEQIRVLLSLLCYKGESLPQGAPTSPVISNIIMRDFDQTVGEWCEERKIRYTRYCDDMSFSGSFDESNVIKFVEGELKSLGFILNRRKTRCFTGGNKKTVTGIVVNEKINTEKSYRRQIRQEVFYCKKFGVQEHLTHMGSPENPYNYLSRLLGQINYVLQITPDNKEFLNYKVQILNILKDNQ

SEQ ID NO: 2327 - protein, 311 aa, unidentified
  source 1..311: note = Related to JAFVSI010000037.1; note = Clostridia bacterium
MVVYRELSSIEADLGIPARTLYRLSNNIGKHYREKKIPKSDGTVRLLSVPDEILKKVQRSIAEKLLAYEPVSLYAKAYRIGGSVISNAAPHVGKEKILKLDIYHFFDSISYSSVKEKCFPAEKYAEKIRILLAMLCYHGESLPQGAPTSPIISNIILRDFDIEVGRWCSERKIFYSRYCDDMTFSCDGDFDGAEVTAFVKQKLGVLGFILNDRKTRLLKKGDKKTVTGIVVSEKLNASKEYRRTVRAEIHYCQKFGVEGHLSRTANALAENPSKYLASLMGKVNYVLQITPENKEFLEYKEYLSDIIKEFK

SEQ ID NO: 2328 - protein, 306 aa, unidentified
  source 1..306: note = Related to SVRW01000015.1; note = Oscillospiraceae bacterium
MIVYKELKSIEKELGFSSKALYGLSNNLGKHYHKVEVPKKSGGTRTLSIPDEALKKVQRAIVQSLLEFENVSFHAKAYKYNSSITKNASPHVGKEKILKLDIYRFFDNISYSAVKEKVFPAEKYSEQIRILLSMLCYYNEALPQGAPTSPIITNILMREFDNVLGEWCKKRNVDYTRYCDDMTFSGSFDEKEIIDYVIHLLCGFGLRLNDKKTKVFTSSQKQIVTGIVVNKKMNVSKAYKREIRKEVYFCKKFGVENHIEHEEIQLSPERYLNSLLGRINFVLQVCKNDKEFKEYKKIISKIIKNK

SEQ ID NO: 2329 - protein, 307 aa, unidentified
  source 1..307: note = Clostridia bacterium; note = Related to JAFTKI010000072.1
MIVYRELSTLSRDLGIPAKTLYAVSNAQDKHYRLIKIPKKDGTDRTLSIPDEILKKIQRAISEQLLSREPISRYATAYRPASGILKNALPHVGKAKLLKLDILHFFDSILYSAVKERAFPADRYSESNRILLSMLCYYRDTLPQGAPSSPAITNIIMRDFDEAVGAWCAERKIAYTRYCDDMSFSGDFDEEEVIEYIAARLKELGFTLNRRKTVVKTNSQQQTVTGIVVNQKPNISAKYKREIRQAVFYCTKFGVTEHQKQIGSSQSPVAYLQALLGKINYVLQVCPNDTSFAAYRKSVLALLEKNR

SEQ ID NO: 2330 - protein, 307 aa, unidentified
  source 1..307: note = Related to JAFVTO010000133.1; note = Clostridia bacterium
MITYKELATVEGELGIPLKTLYSVSNNVNAHYRRVLIPKKDGTYRNLSVPDAPLKRIQRAINEKLLVYEPISRYATAYRIASGIRNNALPHIGMPKVLKLDIKGFFDSVTYSLVKERVFRKEKYSEPVRVLLTILCYYKDVLPQGAPTSPVITNIVMREFDEVIGEWCGKKGIAYTRYCDDMTFSGDFDEKEVKAFVAGELKKQGFFLNAQKTVVATAAKRQTVTGVVVNKKANVSSEYRREIRKEVFFCQKYGVAEHIERLGLDVDTKNYLRKLLGRINYVLQISPDDGVFQGYKNAVTEMLANER

SEQ ID NO: 2331 - protein, 307 aa, unidentified
  source 1..307: note = Related to JAFTUH010000073.1; note = Clostridia bacterium
MIVYKELSSVEADLGFPAKTLYGLSNNLSAHYREVKLPKRDGSFRTLNVPDEILSRVQRAIADKLLSYEPISTYATAYRIAGSVCKNAVPHVGKAKLLKLDIAHFFDSVLYSTVKENAFPKEKYAEKIRVLLAMLCYCGEVLPQGAPSSPMITNIIMRDFDEAVGKRCRALGVSYTRYCDDMTFSGDFDEGEIVPFIRDELRKRGFFLNEKKTAVVPFCRRQIVTGVVVNEKLNISADYKRKIRQEVFFLRKFGVADHLRRTASPFSEKQYLMRLLGRINYVLQISPDDAKFLDYKEAVIRILKEAK

SEQ ID NO: 2332 - protein, 328 aa, unidentified
  source 1..328: note = Clostridia bacterium; note = Related to JAGBRZ010000213.1
MCGTTFRPIAIQMYCLAVVYVSMIVYTELKSVEQDLGISAKTLFSVSNSLSSHYKRVKIPKKNGSFRELSVPDEVLKKIQRAIVQKILVYEPISKYAQAYKTGASVQRNASHHVGKKKILKLDIKHFFDSILYSTVKDKCFPAERFSEPIRILLSMLCYNREALPQGAPSSPIITNIIMRDFDEKVGDFCRERNIIYTRYCDDMTFSGDFDEKPIIEFVKAALFEYGYLLNSKKTTVVSSSGRQIVTGVVVNEKMTVPAEYKAKIRQEVYFCKKFGVENHLEHIHYSKDTKAYLQSLLGRVSFVLQTEPGDQEFLEYKTYLTEILSQI

SEQ ID NO: 2333 - protein, 306 aa, unidentified
  source 1..306: note = Clostridia bacterium; note = Related to JAFTOR010000034.1
MIVYTELKSVERDLGIPLKTLFSVSNNLSAHYRTVKIPKKNGSFRELHVPDEVLKKIQRAIAKRILAYEAISTYAQAYRFGASVQRNASHHVGKKKILKLDIKHFFDSIIYSTVKEKCFPSERFSERVRVLLSMLCYYRDALPQGAPSSPVITNIIMRDFDERVGAFCKERNISYSRYCDDLTFSGDFDEKPVVEFVKTELFQRGYLLNHQKTTVASSSQRQLVTGVVVNENMTVPCEYKAKIRQEMYFCQKHGIEDHLHHIQYTGEVRAYVSSLLGRVSFVLQTEPENKTFMEYKAFLINALRRF

SEQ ID NO: 2334 - protein, 307 aa, unidentified
  source 1..307: note = Related to JAGAMD010000012.1; note = Clostridia bacterium
MIVYTELKSIEKDLGIPLKTLFSVSNNLSSHYKKVKIAKKNGGTRELRVPDYILKKIQRAICDTFLVYEPISKYAQAYRFGSSVQKNASYHINMKKILKLDIKHFFDSILYTTVKDKCFPSDRFSEPIRILLSVLCYYGDALPQGAPSSPVITNIIMKDFDIEVGSFCEKRNISYTRYCDDMTFSGDFDEKEIISFVKEKLFSCGYLINNKKTTVVKEGKCQLVTGIVVNKRLSTPSEYKAKIRQEIYFGTKYGFENHLNHTGNQTELKSYIESLLGRVSFALQTEPDNNEFKKYKAQLIKYKKSIS

SEQ ID NO: 2335 - protein, 307 aa, unidentified
  source 1..307: note = Related to JAFQLX010000091.1; note = Clostridia bacterium
MIVYRELSSVESDLGFSSRELYALSNSIDRQYRAVKLPKSDGTYRTLSVPSQKLKAVQRAITEKILVHMPVSRYATAYRYGASVQRNARVHIGKEKVLKLDIYHFFDSIRYQQLKDKVFTADRFSESIRILLSMLCYYRDVLPQGAPTSPAVSNIIMRDFDDTVGAFCAERGLAYTRYCDDMTFSGSFDYAEIIKFIKNELHKNGFILNGKKTKLVSSANRQTVTGMVVNKKLSTPSDYRRGIRREVYFIKKYGAAEHLKHIESNLSPKQYLQSLLGKIAFALEAAPFDKHLVEAKNAIISEIKKEP

SEQ ID NO: 2336 - protein, 314 aa, unidentified
  source 1..314: note = Related to JAGBUH010000087.1; note = Clostridia bacterium
MYCSGEKMIVYRELSSVEADLDFSAKTLYSLTNDIEKHYRRVEIPKHDGTFRVLYVPDTLLKTVQRRIANRILLLEPISRYATAYKRGSFIRKNASCHVGKETVLKLDIKHFFDSILYSHVKDKVFTEKRFSEPIRVLLTMLCYYKDRLPQGAPTSPVITNIVMRDFDETVGNWCNQRGITYTRYCDDMTFSGSFDVNEVKIFVKSELRKIGFFLNEKKTVSAKGTQRQIVTGIVVNEKLNVSSEYRKKLRQEVYYCRKYGVEEHLKRIGNSVDAKKYLQGLLGRISYVLEVRCDDKSFLADKEFIAGLIKQYE

SEQ ID NO: 2337 - protein, 309 aa, unidentified
  source 1..309: note = Clostridia bacterium; note = Related to JAFSIE010000307.1
MKIVYKELSSIEADLGYSAHMLYALSNSIAKHYRSVSIPKHDGTSRTLSIPDAPLKAVQRRIASVILPLLPISQYATAYRCRGGIVANASPHRGKDKILKLDIYRFFDSIMYSAVKDRVFTRDRFSEPIRVLLSILCYYDDRLPQGAPTSPAISNIIMREFDDAVGKWCSRRGITYTRYCDDMTFSGDFNAARVVAFVRRRLKKYGFLLNDKKTHVARYFNKQVVTGIVVNRKLNVPSSYRRKIRQEMYFCRKHGIEEHLKFIHDPTPPQEYIRRLLGRVGYVLSVSPDDGEFRKYRDFLRRALAQESE

SEQ ID NO: 2338 - protein, 306 aa, unidentified
  source 1..306: note = Clostridia bacterium; note = Related to JAFTLM010000135.1
MIVYRELGSLESDLGFSLKTLYALSNNIKKHYVSVEIPKRNGGVRCLSVPDEILKRVQRRITEVILSGQRVSKYATAYRYGAGILKNASEHVGKPKVLKLDILHFFDSISYSEVKENVFVKERFSESVRILLTMLCYCGDRLPQGAPSSPAITNIVMRDFDEKVGAWCKEQGIAYTRYCDDMTFSGDFDERSIIAFVKQELLKKHLVLNYGKTSVTTPGKRQIVTGIVVNQKPNISADYRRKLRQEIYYCKKYGLEEHANRIGEDDTQKYLLGLLGRVSYALQVRPDDVALKEVKRWLTQTINERG

SEQ ID NO: 2339 - protein, 306 aa, unidentified
  source 1..306: note = Clostridia bacterium; note = Related to JAFNUZ010000041.1
MIVYKELKSLESDLGFSLKLLYALSNNIKKHYSTVEIPKRSGGVRRLSVPDEILKGVQRRIAVVILSGQSVSRYASAYRYGASVVKNAAEHVGRKKVLKLDILHFFDSISYSAVKENAFPSERFSEPVRILLTLLCYYGDVLPQGAPSSPVITNIVMRDFDETVGAWCEEKGISYTRYCDDMTFSGDFDEKAVIDFVKEELRKKRLLLNYKKTSLTNRGGRQTVTGIVVNEKPNITSEYRRKLRQEVYYCQKYGVSEHTKRIGEADAKKYLRGLLGRVSYALQIRPDDAWLVKAKCELLKLIKERH

SEQ ID NO: 2340 - protein, 306 aa, unidentified
  source 1..306: note = Clostridia bacterium; note = Related to JAGBSO010000048.1
MIVYRELSSLSKDLGVSKSSLYKLSNSINKNYHKVEIPKKNGGTRVLSVPSENLKEVQRKITKVILSKETVSIHTTAYRYGASTAYNASHHVNKDVVLKLDILHFFDSILYSDVKDKVFPAEKYSEQIRTLLAILCYHKDSLPQGAPSSPAITNIIMRDFDNTVGEWCRKKNIAYTRYCDDMTFSGNFDAKEVIGFIKIQLRENGFLLNTAKTRVIRRNRSQTVTGIVVNEKINIPADYKRKLRQELYYCKKFGVNSHMARMDFDGNEMSYINRLLGKINYVLSVTPHDKQMLDYKKWLINELEYF

SEQ ID NO: 2341 - protein, 302 aa, unidentified
  source 1..302: note = Related to JAFQKX010000056.1; note = Clostridia bacterium
MIVYRELSSLEQDLGINAKILYAVSNSINKHYRETSLPKKSGGFRYLSVPDKILKSIQRQIAEVLLIHMPISKYAKAYRFGSSTLRNAKHHVGKQVVLKLDILRFFDSIRYSTVKDKVFPKEIYAEPLRILLTMLCYYKEGLPQGAPSSPPITNIILYEFDEQIGQWCREREISYTRYCDDMAFSGDFDPAEVIRFVRVQLKKMGFLLNEQKTRIQRLGQQQTVTGIVVNKKLSAPADYRRKLRQELYYCRKFGIREHLQKLGLEINEHTYRMQLLGKVNYVLQFCPDDQELKAAKKWLQAK

SEQ ID NO: 2342 - protein, 304 aa, unidentified
  source 1..304: note = Oscillospiraceae bacterium; note = Related to JAGAUY010000021.1
MIVYRELSSLEQDLGISSKTLYAVSNNISKHYHRAKLPKKSGGYRNLSVPDEILKAIQRQISEVLLIHMPVSRYAKAYRFGSSTLRNAKHHVGKQVVLKLDILHFFDSIRYSTVKDMVFPEEIYAEPLRILLTMLCYHKDDLPQGAPSSPAITNIILYEFDEVIGQWCRERGIAYTRYCDDITFSGDFDPAEVIRFVRLELKELGFLLNEQKTRIQRPGQQQSVTGIVVNEKLSIPAVYRRKLRQELYYCRKFGIQEHLQKIGLETPEDTYRMQLLGKVNYVLQVHPDDKEMLEARKWLQQSTK

SEQ ID NO: 2343 - protein, 304 aa, unidentified
  source 1..304: note = Related to JAFQIL010000045.1; note = Oscillospiraceae bacterium
MIVYRELSSLEQDLGISAKTLYAVSNNLNKHYRKAKLPKKNGGFRNLSVPDEALKTIQKRIAEVLLIHMPISKYAKAYRFGGSTLRNAKHHVGKQIVLKLDILHFFDSIRYSTVKDVVFPEKIYAEPLRILLTMLCYHKDALPQGAPSSPAITNIILYEFDEQIGGWCRNQGIAYTRYCDDMTFSGDFDPSALIQFVRLELKKMGFLLNEQKTRIQRSGQQQTVTGIVVNEKLSIPADYRRKLRQELYYCRKFGIREHLQKIGLDIPEDAYRMQLLGKINYVLQLYPDDRDMIAAKNQIIAKSR

SEQ ID NO: 2344 - protein, 304 aa, unidentified
  source 1..304: note = Oscillospiraceae bacterium; note = Related to JAFQNL010000019.1
MIVYRELSSLEQDLGISSKTLYAVSNHINKHYHKATLPKKSGGFRTLSVPDEALKSIQRRIVEVLLISMPVSRYAMAYRYGSSTLQNAKHHVGKQLVLKLDIFRFFDSIRYSTVKDKVFPEEIYAESLRILLTMLCYHKDALPQGAPSSPAITNIILYEFDERVGQWCRDQGIAYTRYSDDMTLSGSFDPAEVIRFVRLELKKMGFLLNEQKTRIQRPGQQQSVTGIVVNERLSIPADYRRKLQQQLYYCKKFGVQSHLTKIGLEVSEATYRMQLLGKINYVLQLSPNDRDMLEARRWLQQSAE

SEQ ID NO: 2345 - protein, 303 aa, unidentified
  source 1..303: note = Oscillospiraceae bacterium; note = Related to JAFVXA010000039.1
MIVYRELSSLEQDLGFSARTLYAVSNNLTKHYHETKLPKKSGGFRKLSVPDQVLKAMQKRITEVLLIYMPVSRYAMAYRFGSSTIQNARYHVGKQIVLKLDILHFFDSIRYSDVKDKAFPTAIYEEPLRILLTMLCYHKDALPQGAPSSPAITNIILYEFDEQIGQWCRERNITYTRYCDDMTFSGDFDPAEVICLVRQELKKLGFLLNEQKTRIQRPGQQQTVTGIVVNEKLSIPSDYRRKLRQELYYCRKFGMQEHLQRTGSEISADTYRRQLMGKINYVLQLTPDDRDLLQAKEWLSNEG

SEQ ID NO: 2346 - protein, 306 aa, unidentified
  source 1..306: note = Related to JAFTVM010000054.1; note = Oscillospiraceae bacterium
MIVYRELSSLEQDLGIRAQTLYAVSNNLGKHYRNAKLPKKSGGYRTLSIPDAVLKSIQKQIAEVLLIHMPVSRHAKAYRFGSSTVRNAKPHVGKPIVLKLDILHFFDSIRYSTVKDKVFPAEIYAEPLRILLTMLCYHRDALPQGAPSSPAITNIIMYEFDELVGQWCRERNIAYTRYCDDLTFSGDFDPYEVIRFVRQELRNMGFLLNEQKTRIQRSGQQQSVTGIVVNEKLSIPASYRRRLRQELYYCRKFGVSEHLRKSGLEILESTYRMQLLGKVNYVLQVSPDDQDMLDARRWLQQTSKSC

SEQ ID NO: 2347 - protein, 310 aa, unidentified
  source 1..310: note = Candidatus Faecousia faecavium; note = Related to DVGO01000036.1
MIVYRELSSLERDLGIPAKTLYAVSNSLSRHYRMVSIPKKTGGVRNLMVPDTALKTIQRRISDVLLAHMPVSSYATAYRFGTCTLRNAAVHVGKPVVLKLDIYHFFDSIPYSLVKEKAFPAHIYAEQIRTLLTMLCYHKDVLPQGAPSSPAIVNIILANFDERIGRWCTQRGIAYTRYCDDLTFSGDFDPKDVIAFVEGQLKSLGLLLNTNKTRVQRQGQQQLVTGVIVNEKPGVPAVYRRQLRQEMHYCQKFGVGEHLKFLGQGISEEAYLRQLLGKVNYVLHIVPDCEEFQQYRTWVLQKLQNISLAK

SEQ ID NO: 2348 - protein, 309 aa, unidentified
  source 1..309: note = Related to WNBA01000006.1; note = Pseudoflavonifractor sp.
MIVYREAPTLARDLGVGLHTLYALSNRLSAHYHTVELTKPNGGVRRLTVPDEALKGVQRSIARNLLACRELSPYATAYRYGAGTVRNASAHVGKARLLKMDIYHFFDSVNYSAVKDAVFPAEVFSEPLRILLTMLCYYQDALPQGAPTSPAVANILMRDFDEDVGGWCARRGIAYTRYCDDLTFSGDAGLAGAYRYAEARLREKGFLVNRRKTLYLDAGRRQCVTGLVVNEKVDVPAEYRRALRQELYYCKKFGLEEHLRSVGWEGDPTAYARRLLGRFSYALQIRPEDRALLEGKAWLVEELNRRAGK

SEQ ID NO: 2349 - protein, 306 aa, unidentified
  source 1..306: note = Related to KE159708.1; note = Oscillibacter sp.
MIVYREAASLARDLGVELKTLYALSNSLPAHYRTVEIPKADGGVRRLTVPDEALKRVQRAILNNLLVHMPVSPYATAYRYGGGAVCNAARHVGRPQVLRLDIRHFFDSVRYSAVKDAVFPPEIFSEPLRVLLTMLCYYRDALPQGAPTSPAIVNILLRDFDRRVGGWCRERGIVYTRYCDDLTFSGEDLSGVRAVTEAELRDLGFFLNERKTRLRSAGQRQTVTGLVVNEKVRVPREERRAIRQAVYCCRRFGLEDHLARTGVGLTPEACLNRLLGRVGYVLQADPDCAWALEARRWLLEERRRRI

SEQ ID NO: 2350 - protein, 313 aa, unidentified
  source 1..313: note = Related to DXIA01000170.1; note = Candidatus Pygmaiobacter gallistercoris
MIVYTHTETLAQDLGIPAATLFGVSFHLDRHYRRVTLPKRDGGVRTLCVPDPILKKIQRRILRVLLFHRPVSPYATAYRPGVGLRANALPHCGRQCVLQLDIRQFFDSVRYLQVKEIVFPKEIFSEKLRVLLSCLCYGRDGLPQGAPTSPAISNLLLRDFDLRVGDWCAARGIRYTRYCDDLTFSGAFDPKPVIRMVSDALWREGFVLNPRKTRFSRSGQRQTVTGVVVNDRPRLDAARRRALRAELYYCRRFGVADHLSHIGDPRTPRAYLLSLLGRLDFALSLGAEPQLAEGRRWVLEQLKPSKQKEEIDG

SEQ ID NO: 2351 - protein, 310 aa, unidentified
  source 1..310: note = Related to JACONZ010000001.1; note = Anaerofilum sp.
MIVYTETATLERDLGIPAKTLFAVSHDLKRHYRRVELSKADGTVRVLSVPDAVLKKIQRSINANLLAYMPISPYATAYRPGGGVRRNALPHCGQEQLLKLDIRRFFDSVRYTQLKETVFPAAVYAEKLRVLLSILCYSKEGLPQGAPTSPAIANILLRQFDETVGGWCGARGIAYTRYCDDLAFSGRFDPAAVICTVQEALRREGFSLNAQKTRLAGPGGRHLVTGAVVNLRPRAPAEERRALRQELYYCEKFGVRGHLVQTGDPRTAQAYLAALLGRLDYALSLSPEPRLAQGRRWVLDRLREERTARP

SEQ ID NO: 2352 - protein, 307 aa, unidentified
  source 1..307: note = Related to CP048436.1; note = Flavonifractor plautii
MGIVYQEGPSLARDLGLPLRTLYAVSNRIPAHYHRAEVPKRDGGVRVLRVPDPVLKDIQRRIARVLLSGMPVSPHATAYRYGAGVVENARRHVGRPELLKLDILHFFDSIRYIQVKEAAFPAEIYAEPLRTLLSMLCYDRDVLPQGAPTSPWIANLVLRPFDEKLGAWCRARGVVYTRYCDDLAFSGTALDGVEERAEEGLRALGFRLNRAKRALCRDGQQKRVTGLVVNERVAVPACCRRRLRQELYFCRRRGVEEHLRAVGLAEGREQCLRRLLGQVDFWLQAQPDSQEAAEYRRWLLDEMRDGR

SEQ ID NO: 2353 - protein, 309 aa, unidentified
  source 1..309: note = Related to JAGZAL010000035.1; note = Butyricicoccus pullicaecorum
MKIVYREASTLARDLGIPLDILYAVSNRLDAHYHTAVLPKRDGGTRTLTVPDGLLKRIQRAILETLLVHMPVSRNATAYHYGARVTKNAAPHAGKRFLLKLDIARFFDSIRYTSVKEAAFPPEIYAEPLRILLAMLCYHRDALPQGAPTSPAISNLVMRPFDEQVDGWCRARGIVYTRYCDDMTFSAGRPLGGVHGFVQDALGGMGLLLNERKTARFHAGQRQTVTGLTVNDRPNVPPAYRRALRQELYFCRKFGAASHLAHIGLDMDVPTYLHRLLGRVSFWLQADPGNQEAAAYRRWTLAQLDSALP

SEQ ID NO: 2354 - protein, 313 aa, unidentified
  source 1..313: note = Eubacteriales bacterium; note = Related to BQNX01000001.1
MIVYRELSTLAGDLGVSGRTLYAVSNSLPKHYRTVELPKGDGAVRRLSIPDRELMEIQRRILNRLLVYMPVSPYAAAYRRGVDHAAGARPHIGRPVLLRLDIRHFFDSILYSDVKEYAFPAHIYAEPLRVLLSILCYCGDALPQGAPTSPVVSNLVLRDFDLETGAWCSARGISYTRYCDDMAFSGAFDPVEVSRLIAGKLRERGFFLNEEKTRAMFAGQRQTVTGLVVNERLNLPREYRRALRQELYFCRRFGVSAHLARTGAAPEPEACLRSLLGRVSYVLQISPENREMLGYREWLLQELALLHSGERDS

SEQ ID NO: 2355 - protein, 309 aa, unidentified
  source 1..309: note = Oscillospiraceae bacterium; note = Related to QALD01000098.1
MIVYRELETLTRDLGIGAGVLYAAGNRPEAHYRTVSITGGNGTVRTLSVPDPMLMAIQRRILFRLLVHMPVSPQAAAYRCGVSTLSAARFHIGKPVLLCLDIRHFFDNIRYADVKRYAFPPDIYAEPLRVLLTRLCYLRDALPQGAPTSPAISNLVLADFDRALTSWCAPRGIAYTRYCDDLALSGDFDPDQACEIAAALLRQHGFLLNPAKTRIRRAGTRQQVTGLIVNERPSVPREYRRALRQELYYCRRFGVASQMQRRGFCGKETSYLQSLLGRVNYLLQIRPDDVAAKQDRDWLLALLHTQQTP

SEQ ID NO: 2356 - protein, 311 aa, unidentified
  source 1..311: note = Clostridia bacterium; note = Related to JAFURT010000015.1
MPDRIVYNELSSIELDLGFTAQQLYAVSNSLHRQYRQVKLPKANGGYRTLSIPSPLLKAIQRRITTVLLAQEPVSPYATAYRYGGGPLRNARQHVGRQMVVKLDIRGFFDHILYSDVKDAAFPADRYAEPLRVLLAMLCYYGDSLPQGAPTSPAISNIVLRSFDDAVGAWCRAHGIVYTRYCDDMTFSGPPEVTEVIPFVQAQLEQRGFYLNRRKMVVAHRGCKQTVTGLVVNRRLNVPAGYRKKLRQELYYCRKFGLVQHLAHIGDTTPPMTYARRLLGRVNYVLAVSPDREEFREYRHYLTEWCQTYTE

SEQ ID NO: 2357 - protein, 312 aa, unidentified
  source 1..312: note = Related to JAFBIO010000002.1; note = Fournierella massiliensis
MIVYRELSSLVRDLGVEAKTLYALSNSLEKHYHQVKIPKRDGGYRQLSVPDEQLKRVQRQIDRVLLARMPVSPYATAYRCGCGIGRNALPHLGQPGVLKLDIRHFFDSIPYTAVKERAFPGTIYGEPLRVLLTMLCYYRDSLPQGAPSSPAITNIIMAKFDARVGQWCAQREIRYTRYCDDMTFSGSFDPQEVVAFVRPLLREMGFFLNEKKTRFLPAGRRQVVTGIVVNEKPGLPAEYLRRLRQEVYFCQKYGTADHMARCGIQGPASGYLRRLLGRVNYGLQILPGKKELLEARAWLMKEMAREQEGDRP

SEQ ID NO: 2358 - protein, 314 aa, unidentified
  source 1..314: note = Related to NZ_CP044227.1; note = Flintibacter sp.
MIVYRELSSLVRDLGIPAKTLYGVSNTVETHYHKVQLPKRDGGVRELSVPDPILKHIQRRITQVLLLPMPISRYASAYRYGASTLRNAAPHAGQPGILKLDIRHFFDSILYSTVKEKAFPPEIYAEPLRILLAMLCYYRDTLPQGAPSSPAITNIIMAQFDEDVGAWCRSRSIRYTRYCDDMTFSGAFDPREVKAFVSQKLREMGFFLNESKSKYLPAGQRQTVTGLVVNEKPAVPSDYLRSLRQELYFCQKFGVSDHMAHLGIKESEAHYLARLLGRVNYVLQITPGKKEWAQARAWLLVQLSSLNDSSPVIS

SEQ ID NO: 2359 - protein, 308 aa, unidentified
  source 1..308: note = Related to JACJJD010000020.1; note = Pseudoflavonifractor sp.
MIVYRELSSLARDLGVDARLLYAVSNSLDRHYRQVCLPKKDGGVRTLSIPDQLLKTIQRRITQVLLVHMPVSPYATAYRYGGSAWRNAAPHVGQPALLKLDIRHFFDSILYATVKERAFPPEIYAEPLRILLTMLCYYRQSLPQGAPSSPAITNIILSGFDQEVGAWCAGKGIRYTRYCDDMTFSGLFSPEEVTSFTEARLQPFGLFLNGRKTRFIPAGRRQVVTGLVVNETVGVPAHYLRTLRQELYYCRKFGVSGHMARLGVPEPEARYLARLLGKVNYVLQVTPGKREFQQARAWLLQALAHCEG

SEQ ID NO: 2360 - protein, 320 aa, unidentified
  source 1..320: note = Related to NZ_CP034413.3; note = Dysosmobacter welbionis
MIVYRELSSLVRDLGIPAGTLYAVSNTLDRHYIRRQLPKSSGGVRELSVPDPLLKHIQRQILRVLLVHMPVSPYATAYRYGGSTLCNAAPHVGKPCVLKLDICHFFDSILYSAVKETAFPAEVYAENLRILLAMLCYGWDRLPQGAPTSPCITNILMRDFDNEVGAWCRERQIAYTRYCDDMTFSGDFARDEVLRCVEPRLRALGFYLNPGKTKWLPADRRQLVTGIVVNKKCNVPSEERRALRQELHFCQKFGISGHMARAGIDGPEDRYLAQLLGRVNYQLQITPGRRELQEARDWLIKAQPQYGGGRETSPAEKQIL

SEQ ID NO: 2361 - protein, 310 aa, unidentified
  source 1..310: note = Related to NZ_LR130816.1; note = Intestinimonas sp.
MIVYRELSSLVHDLGISARTLYAVSNGLDQHYRRAELPKADGGVRALSVPDPLLKHIQRRITQVLLVHMPISPCATAYRYGGSVLVNAAPHVGQSAVLRLDIQRFFDSIRYTSVKEAAFPADIYAEPLRILLGMLCYHREGLPQGAPSSPAISNIVMADFDAQVSAWCRERGLTYTRYCDDMTFSGAPVPSEVVSFVSDRLRPLGLFLNRRKTRYLPSDRRQLVTGIVVNQALNTPAEYRRKLRQELHFCQRYGVAAHMAWQGLTCSEDAYLARLLGQVNYALQISPGRSDLEQARAWLRAGGGRTEPHT

SEQ ID NO: 2362 - protein, 320 aa, unidentified
  source 1..320: note = Related to NZ_JADCKB010000012.1; note = Ructibacterium gallinarum
MHILYGFSRRKGPNHMIIYRSIDTLAKDLGFSPKTLYAVSYQTDRHYEQVSFACGGKTRLLSVPDPLLKSIQRSIYRNLLCHMPVSPCAAAYRFGTSIAQHARLHAGQKLVYQMDIQNFFDHILYSTVKDKAFPEIIYSPSLRILLTMLCYYRDRLPQGAPTSPVIANLVLKDFDEKVCAWCRQRHIRYSRYCDDLTFSGSFDPVSLYEFVKGALYQEGFYLNPKKTRLLSQSRRQTVTGLVVNQQVSVPSAYRRQVKQEIYYCQKYGITAHMSRQNIADTPEHYLRSLLGRVDFILYYHQDASWAMDGRQWLITQLKNF

SEQ ID NO: 2363 - protein, 303 aa, unidentified
  source 1..303: note = Related to JAGBHD010000062.1; note = Oscillospiraceae bacterium
MIIYKEISSIEQDLGYDIKTLYSISYSLHRHYISIKMPKKQGGYRILSIPDAPLKCIQKRIAEVLLSQINISPYAIAYRYGGSTLRNAAPHINKDIVLKLDIHDFFNNILYSTVKEKAFPKEKYSENIRILLSVLCYYNDTLPQGAPTSPAISNIIMCDFDNTIGSWCKKHSIAYTRYCDDMTFSGSFDPKEVIKCVESELKKMRLFLNKKKTIVARKSNKQIVTGIVVNEKLNIPRQYKKDIRQALYYCRKFGVENHMADANINDTNEHYILKLLGKVNYVLSVCPNDKEFINYRDFLKGLI

SEQ ID NO: 2364 - protein, 303 aa, unidentified
  source 1..303: note = Clostridia bacterium; note = Related to JAFXAP010000004.1
MIVYKEISSIEQDLEYDIRTLYSISYSLHRHYHSIKISKRQGGYRVLSIPDMPLKCIQKRIADVLLSQITISPYAKAYRYGGSNIKNATPHINKDIVLKLDIRDFFNNILYSTVKEKAFPKEKYSENIRILLSMLCYYNDALPQGAPTSPFISNIIMCEFDNAVGSWCGKHGVAYTRYCDDMTFSGNFNPNEVIKYVRFELRKMGFFLNNKKTIVAHKSNKQIVTGIIVNKKLNIPRKYKKDIRQAIYYCKKFGVYNHMESTNINDTVESYILKLMGKVNYVLSVCPNDKEFMGYRNYLKSLI

SEQ ID NO: 2365 - protein, 308 aa, unidentified
  source 1..308: note = Related to DVKV01000137.1; note = Candidatus Faecousia intestinavium
MIVYRELSSLERDLGFPASTLYAVSNRLNRHYRKVELPKGDGPLRTLSVPDNLLKTIQRRIAQVLLSTLPVSPYATAYRPGGSVVKNARPHVGKPVVLKLDIYHFFDAVCYSRVKKEIFPPEIYSEQNRILLSMLCCYQDKLPQGAPTSPAISNRILLEFDQEIGSWCARQGISYTRYCDDLTFSGDFAPGDVIRLVRERLKVRGFLLNNRKIQVLRQGQRQSVTGVVVNQSLQAPVSLRRELRQQVYYCRKFGVSDHLARTKQTVSEEDYLRRLLGQVNFALQINPADQELADARQWLLAEIRRKRT

SEQ ID NO: 2366 - protein, 310 aa, unidentified
  source 1..310: note = Clostridia bacterium; note = Related to JAFQDF010000039.1
MRSYSIVYKDIYALSGDLGVSPRILYSLSNRISGHYHTVAIPKKNGTYRKLSVPDDILKYVQRRINKVLLCYMPSSGYAMAYEYGKSILKNANPHSNKKCILKLDIDDFFDTVKYSQVKEKAFPAAHFAENLRVLLSQLCYNGEGLPQGAATSPKIANLILRDFDERIGSWCAQRDITYTRYCDDMTFSSDKGLDGVYKYVRDELFKEGFLLNKDKTKFIDSHHRQKVTGIIVNNSPKVPTEYTKKIRQEIYYCRKFGISEHLSHTDSDKSLCEYLASLLGRINYVLSVTPKNEEMKDYKDQVTIWQKSL

SEQ ID NO: 2367 - protein, 305 aa, unidentified
  source 1..305: note = Clostridia bacterium; note = Related to JAFUMW010000045.1
MIVYKSLESVEADLGVSLKTLYAVSNNLQSHYRNVELPKKNGGIRHLCVPDDVLKHIQRRITEVMLVHMPISKYAGAYRYGASVIHNASAHLGKKRILKLDISKFFDSVLYSQVKEYAFPEIIFSEKVRVLLSILCYYKESLPQGAPSSPAISNIIMRQFDEKVGAWCEERSISYTRYCDDMTFSGDFDANDVKKLVERELGKYGFYLNPVKTKTVTSDHRQSVTGIIVNEKLSLPSEYRRKLRQELYYCRRYGVDAHMERIGVSGSAGSYLSRLLGKVNYVLSVRKDDAEMKEYKAWLVAELKK

SEQ ID NO: 2368 - protein, 310 aa, unidentified
  source 1..310: note = Related to JAFPLT010000171.1; note = Lachnospiraceae bacterium
MIVYHELSSLCADLRLSPRTLYAVSNAMEKHYHTVRIPKKSGGFRKLTVPDDLLKMIQRRITEALLLPLPVSAAASAYYPGRGIKRNALPHVGKPVLLKMDIYHFFDSVLYRDVRDCAFPAEIYSEPLRVLLTTLCYGMNELPQGAPSSPAISNRILYRFDEKVLKLCRKQGIHYTRYCDDLCFSGDFDAEALRKEVTKLLIEEGFFPNRKKTKVQKGGTRQCVTGLVVNERANVPAEYRRKIRQELYYIGRFGLRSHMERTKAEGSELSYLRKLLGRISYCLEIDPENDEMKRDREMVLELIGERTGRQ

SEQ ID NO: 2369 - protein, 308 aa, unidentified
  source 1..308: note = Oscillospiraceae bacterium; note = Related to JAFZQQ010000087.1
MIVYRELSSLSTDLGFSAKALYSVSNSITKHYHPVKIPKGNGEYRQLTVPDEFLKAIQRRINDKLLCFEPISPYATAYRVGGSTKANACPHVGQKVLLKLDIRHFFDNLIYPVIKEAAFPKERYSEANRILLTILCTYQGYLPQGAPTSPTISNIVMRQFDDTVGTWCEKRGIHYSRYCDDMTFSGDFDPKPVKSMVAGELRKLGLFLNTKKMVVAGKGQKQTVTGIVVNEKASVPTGYKRKLRQELYFCMKYGTDSHMNHNEINMEKGNYILSLLGRVNYACSIETDNEELKSYRDWLLLESQETKR

SEQ ID NO: 2370 - protein, 334 aa, unidentified
  source 1..334: note = Oscillospiraceae bacterium; note = Related to SVKP01000140.1
MGLRIQRDSCHILTVLLHGNRGRRACCMIVYWELSSLSTDLGFSPKALYSVSNSIGRHYRLVQIPKGNGELRRLTVPDRFLKAIQVQIYEKLLRLEPVSPHAAAYRPGGSTLVNARPHVGQAVLLKLDIRHFFDSLIYPQVKDAAFPVERYSEANRILLAILCTYRGILPQGAPTSPAISNIILRNFDDTMGEWCGRQGVRYTRYCDDMTFSGDFDPAAVIEKTAAELKNMGLYLNAGKTVVARKGQKMIVTGIVVNEKTSIPRDYKRKLRQELHYCTEYGLASHLAHTHSQMEQRDYVLSLLGRVNYALSVEPANAELGQYRVWLTEAMKQIS

SEQ ID NO: 2371 - protein, 304 aa, unidentified
  source 1..304: note = Clostridia bacterium; note = Related to JAFWAC010000028.1
MIIYKEFSSLLSDLGFSGKTLYSVSNHINRHYHPVKIPKANGEFRELNVPDKLLMTIQRAINNKLLCLENVSRFAMAYKPGSSTKMNAVAHVAQPVVLKLDIRHFFDHLIFPLIKEKAFPAARYSEQNSILLTFLCTYKDALPQGAPTSPTISNIIMKDFDNFVGGWCNERGIAYTRYCDDMTFSGDFDPKAVIILVKKELKKLGLYLNDKKTVVVRKGQRQSVTGIVVNEKRSIPIEYKKRIRQEMHYCMKYGVASHLERIGIDEAPKTYTLKLLGKINYVLSVEPNNSNMRQYRSWLMEQKF

SEQ ID NO: 2372 - protein, 306 aa, unidentified
  source 1..306: note = Related to JAFQMR010000111.1; note = Clostridia bacterium
MIVYKELSSLTSDLGFSSKALYSVSNHIGRHYRAVSVPKGNGESRRLHVPDALLKAIQRRINDRLLSLEAVSAYATAYRAGGSTKRNAAPHVGKPVLLKMDIRHFYDSLIYPLVKEKAFPKERYSEQNRVLLSLLCIYNDTLPQGAPSSPTISNIIMRDFDERVGQWCAQQDITYTRYCDDMTFSGDFDPHPVIRFVRKELQSLGLFLNNRKTVVARTGQKQAVTGIVVNETTHIPSGYKAALRQELYYCRKFGIASHLLHCGIDESPERYAQKLLGRVSYVLSVEPQNRQMQDYRAFLQSCLQSR

SEQ ID NO: 2373 - protein, 308 aa, unidentified
  source 1..308: note = Related to NZ_JACOPN010000001.1; note = Flintibacter sp.
MVCKSYSDLERLLGISVKALYSVSNASWKHYRSVKIPKNDRGEFRELHVPDEFLKTVQRRIADRLLSAYPVSPYATAYRPGGSTIVNARPHVGKNVLLKLDIHHFFDNILYATVKEKAFPAEDYSESIRILLTILCVHKDALPQGAPTSPVISNIIMRDFDCTVGGWCDARGIAYTRYCDDMTFSGDFDSREVVSLVRTELRKMGLFLNEKKTVRAVRGQRQSVTGLVVNEGLRIPAAYRKKLRQEVYYCRKFGVAAHLQRMGSGERAEEYLPKLLGRINYACSVMPDDQELRQERRWVMQQLHTLER

SEQ ID NO: 2374 - protein, 310 aa, unidentified
  source 1..310: note = Related to SVSR01000007.1; note = Oscillospiraceae bacterium
MIVYKELSSLTNDLGFSVKALYSASNHISSHYHKAKILKKTGEYRELSVPDDFLKSIQKRIVEKLLVYEEVSPYATAYRYSTSIIKNARVHLHNNTILKLDIRHFFDHIIYPVVKEKAFPKEKYSEENRILLSLLCLYHDALPQGAPTSPIISNIIMKDFDNTVGAWCKSKKIRYTRYCDDMTFSGDFNIREVISFIKRELGKMGFYLNDAKTVVARSGQKQIVTGIVVNDKLNTPLLYRKKLRQELYYCKKFGIASHLRQKSIDMSEREYILKLLGRVNFVLSVGQTNKEMQEYKSWLLDQNNLFITEK

SEQ ID NO: 2375 - protein, 306 aa, unidentified
  source 1..306: note = Related to JAGBHE010000095.1; note = Clostridia bacterium
MIIYMELSSIIHDLGVSAKALYALSNHTEKHYHRAKILKGNGEYRELAVPDNFLKSVQRKIADTLLVHEEISPYATAYRYGGSVIANAEPHLGNSSILKLDIRKFFDTITYPLIKDNAFPKNRYSEKIRILLTFLCVYNDVLPQGAPTSPVISNIIMREFDNTVGAWCRQRNICYTRYCDDMTFSGELNREEIIDFVKKELKKMGFFLNDKKTAFIHDGQKKIVTGIVINKKLNTSKKYRKQVRQEIFYCKKFGVASHMKHINSDKSKNDYLLSLLGKVNFILSVDKCNAEALGYKKWLSEEIKNN

SEQ ID NO: 2376 - protein, 308 aa, unidentified
  source 1..308: note = Clostridia bacterium; note = Related to JAFSXU010000033.1
MIVYRELSSLSEDLGVSKKALYTASNHASSHYRRIKIPKGNGEFRELAVPDNFLKSIQKRIADKLLIYEEISKYATAYRYGGSVVANAKPHIKNGTVLKVDIRHFFDHIIYPIVKDKAFPAYRYSEPNRIMLSLICLYKDTLPQGAPTSPVISNIIMKNFDDCIGQWCDKKGIVYTRYCDDLTFSGNIIPGEIICFVKQELAKMGFYLNNKKTVIARNGQRQLITGVVVNDKLNIPLDYRKKLRQELYYCKKFGVSSHLSKINSEQNEEKYLQKLLGRVNYALMIDKSNAQMNGYRQWLVNELKKYNG

SEQ ID NO: 2377 - protein, 308 aa, unidentified
  source 1..308: note = Related to JAFYQP010000074.1; note = Clostridia bacterium
MITYKELSSLTNDLGFSARALYSITHNIHKHYKPVSIPKGNGEMRKLCVPDKFLKAVQRSIARNLLSYEEISPYATAYRLCGSTVVNARPHLGAEVILKLDICHFFDHIIYPVVKDKVFPGEKYSEANRVLLTLLCTYRESIPQGAPTSPAISNIVMRDFDDTVGVWCEDRGICYTRYCDDMTFSGDFSPKEVISFVRTELGKKGYFLNNRKKVIAKRGQKMQVTGIMVNEKLNVPNTYRRKLRQELYYCRKFGIKSHMEKIGVEITEQEYIMKLLGRVNYLLQVTPDDKSAKEAKLWLIKELKKASL

SEQ ID NO: 2378 - protein, 312 aa, unidentified
  source 1..312: note = Related to JAFPRS010000057.1; note = Clostridia bacterium
MFRKREGGFAVIVYSELSSLCRDLGFTARELYAASRNTDRLYRKAVLPKAGGGVRELSVPSPLLKAIQTAVYEKLLSQEPVSRYACAYRPGGGIKRCAAPHVGRGQVLTLDIRRFFDSAIYPLIKEKVFAPERYSAPNRVLLSMLCTYRDALPQGAPSSPAISNILLYGFDEAVGEYCRERGIRYTRYCDDMAFSGLFDARELTAFVESELRKLGFYLNRKKTRLVRPGQRQAVTGVIVNEKLAVPREYKRRLRQELYYIEKYGMEEHLSRLGGEAQNVDYAARLLGKVNYVLSIEPGNIEAAHWARLLKDK

SEQ ID NO: 2379 - protein, 309 aa, unidentified
  source 1..309: note = Oscillospiraceae bacterium; note = Related to JAFRLE010000126.1
MIIYNELASLEADLGYSAKQLYSLSNGINRHYHPAEIPKSDGGSRSLSVPDAQLKAVQSKIADRLLSLEDISVYATAYRPGGSIVRNALPHIGHSDVLKLDIRRFFDSITYPLIKEKAFPAKRYSEKNRILLAILCTYKEALPQGAPSSPAISNIILRNLDDAVGSWCRSRYITYTRYCDDMTFSGRISTALKKEIINTVEQQLRKAGLYLNADKTVFVHDGQRKCVTGIIVNEKVSIPAGYRRDIRQKMHYICSYGIKSHIQHTGSKLSEEEYLRKLLGRISFVLSIDPHNEEMLGYRSKLIEIRRTL

SEQ ID NO: 2380 - protein, 305 aa, unidentified
  source 1..305: note = Related to JAFQUH010000074.1; note = Ruminiclostridium sp.
MIVYREFSSLTEDLGFSGKALYSLSNKIHRHYKKVEIPKADGSVRSLSVPDDFLKAVQRRIADRLLSMEEISPYAIAYRPGGSPLKNARPHIAKNTVLKLDITCFFDHITYFLVKEKAFPKERYSERNRILLTMLCIYNDALPQGAPTSPVISNIIMKDFDNAVGRWCRERRIVYTRYCDDMTFSGDFDVCEVKNFVSGELRRMGFFLNSKKTTAVRRGQRHTVTGIVVNEKPSISANYKAKLRQELYYIMKFGINSHLEKCGIDIPAEKYLQKLLGRANYILSVEPDNKKVKEYKGWLTAQLKK

SEQ ID NO: 2381 - protein, 306 aa, unidentified
  source 1..306: note = Related to JAFQPT010000004.1; note = Oscillospiraceae bacterium
MIVYRELSSLETDLGVSAKVLYTLSNSRSSHYHTVMLPKENGELRQLSVPDGLLKSVQRKIARQLLVYEEVSPYAMAYRLGGSTLHNAVPHVGQPMVMKLDIRKFFDHCFYPLVKEKAFPAARYSEPNRVLLSLLCVYHDALPQGAPTSPAISNIILRDFDNAVGSWCAKRHIVYTRYCDDMTFSGSFDPAEVKTKVRTELRKVGLFLNDNKTVVLNGGQRQTVTGIVVNERVSVPSDYRRKLRQELYYCRKYGIAAHLEHIGSEADVRSYERQLLGRVNYVLYADPCNQEMQEYRRWLQNTLTGK

SEQ ID NO: 2382 - protein, 303 aa, unidentified
  source 1..303: note = Clostridia bacterium; note = Related to JAFUPP010000033.1
MITYKEISSLENDLGVSAKALYTLTNEIHRHYRTVMIPKDNGELRKLSVPDPFLKSVQRKIAHNILFFEEISPYATAYRPGGSTLINALPHVSKNTVMKLDINKFFDHIIYPIVKEKVFPAHKYSEANRILLTLICIYKDSLPQGAPTSPVISNIVLKDFDNKVGEFCFKRNVTYTRYCDDMTFSGEFDPQQIKRFLQNELKKLGLYLNSKKTVILKNGQQKKVTGIVVNEKPNVCAKYKRKLRQEIYFCQKYGIKNHLDKTGSCLTEAQYKAQLLGRINYCLSVSHKDKNMQGFKEWLINNK

SEQ ID NO: 2383 - protein, 372 aa, unidentified
  source 1..372: note = Related to JAFPOZ010000331.1; note = Clostridia bacterium
MNVNFLTAAASRCGQTYTFDSRFAPEKLTAQYTGPCSMGWRILLRIFSMRISIASHAFREGSSVVIVYRELSSLVSALGFSAKTLYGVSNRVTTHYRQLKIPKSNGGFRTLHIPDQLLKSIQRQINMQLLLPEPVSPFATAYRPGGSTRINALPHVGKPIVLKLDIDHFFDHAFYPLVKEKAFPAMRYSEKNRILLSLLCTYKDTLPQGAPTSPAISNMIMYDFDMAVGKWCVMHNVSYTRYCDDMTFSGMFDIAEVIAVVKDALKDWGFFLNARKTTVIRSSQRQTVTGLVVNEQVHIPSSYRNALRQELYYCRKFGIQSHLEHRHIKMEPEAYALSLLGKINYCLSIHAADPMMLEMKQWLMQQIRNNCF

SEQ ID NO: 2384 - protein, 317 aa, unidentified
  source 1..317: note = Clostridia bacterium; note = Related to JAFZOL010000002.1
MIIYREFSSLSRDLGFSGRTLYGVSHAVTKHYRPVRIPKRGGGTRELHIPDPLLKAIQTRIAETLLPLEEISPCASAYRPGGSTKRNALPHVGRQTVLKLDISGFFDHITYPLVKKKAFPASRYSESNRVLLAMLCVYKDSLPQGAPTSPAISNIVMKDFDDAVWRYCAAREIAYTRYCDDMTFSGDFDPAPLIAFVKARLKKMGLFLNEKKTAVLRQGRRQQVTGVIVNERPGVPAEYKRAIRQEVHYCEKYGAADHLSFRGDPTPPADYLMSLMGRVNYVLSIEPQNEEMRGYKTLVAAWLKEAAQPKKTPEEQP

SEQ ID NO: 2385 - protein, 307 aa, unidentified
  source 1..307: note = Related to JAFURU010000174.1; note = Clostridia bacterium
MIVYRELSSLARDLGVSGRTLYALSNHVVKHYRRVLLPKGSGEYRELHVPDDLLKMVQKRIAERLLAMEPVSPYATAYRVGGSPMLNAKPHVGAPVLLKMDIRHFFDHVIYPVVKEKVFSAERYSEKNRVLLTLLCMYKDSLPQGAPTSPVISNIIMRDFDDRIGSYCRERGIRYTRYCDDLTFSGDFDPAPIKAFVREELIKMGFYLNDKKTVVLREGQKKTVTGIVVNERLNTSSAYRRSLRQDVRFCKKYGVADHLKHIGKVGVSEYSYLSQLLGRANYILQVDKDNAEVKGYKRWIIEQMTKH

SEQ ID NO: 2386 - protein, 303 aa, unidentified
  source 1..303: note = Clostridia bacterium; note = Related to JAFTEJ010000045.1
MIIYRELSSLSDDLGFSAKTLYSVSNSISSHYRCVSIAKPGGGYRELSVPDCLLKSIQRRINEKLLWMEEISPYATAYRVLGSTKKNAFPHKGNPIVLKLDIRHFFDSIIYPVVKEKVFPNYRYSEQNRVLLSLLCVYKDALPQGAPTSPAISNIIMRDFDNKIGSWCSERGVVYTRYCDDMTFSGNFDPKPLRAHVKSELRSMGFFLNDRKSVILNRGQCHIITGVLANERLRAPSDYRRRIRQEMYFCRKYGIGSHLRRIGIEDDVAHYRLVLLGRINYALSLDPADSELVSYKKWLCEND

SEQ ID NO: 2387 - protein, 307 aa, unidentified
  source 1..307: note = Clostridia bacterium; note = Related to JAFQEI010000172.1
MIVYREFSSLAGDLGFSARTLYGVSYHRASHYQTVRIPKANGEYRELHVPDALLKSIQRRILSVILDREEISPYATAYRYGGGIAKNAAPHVGKPVVLKLDIRHFFDRVIYPLVKDRAFPADRFSESNRVLLTMLCMYRDALPQGAPTSPAVSNIIMREFDDTVGAWCARQQIAYTRYCDDMTFSGDFDPKPVIQKVRQELQKMGFFLNDKKTVVVRDGQKKLVTGVVVNRRLRAPAEYRRNLRQELYYCRRFGVSRHLEHRALQQTEGQYLRGLLGRVQFALQLDPDDRELRDDRAWLLSRISDCT

SEQ ID NO: 2388 - protein, 307 aa, unidentified
  source 1..307: note = Related to JAGAYD010000015.1; note = Butyrivibrio sp.
MVVHRELSSLCQDLGYSARALYSLSNSVSEHYHDAMIPKANGEYRLLHIPDKFMKAVQKSIAQNILSYEDISPYAMAYRPGGSTKANAFPHVGASMVMKLDVRKFFDHITYPMVKEKVFPSEKYSESNRILLSVLCVYNHAIPQGAPTSPAISNIILRDFDNRVGDWCGKSGITYTRYCDDLTFSGEFEPKEVKAFVKKELFKEGFFLNSKKTIVLRNGQRKEITGIVVNEKAAVPARYKKRIRQELYYCRKFGIDEHVKRLGLPESTEAYARKLLGRINYVLSVEPDNDEMKRGRAELLSWFQSTS

SEQ ID NO: 2389 - protein, 303 aa, unidentified
  source 1..303: note = Related to FOXO01000040.1; note = Butyrivibrio proteoclasticus
MVVYRELSSLCHDLGYSARALYTLSNSVAEHYHDVMIPKANGEQRLLHVPDKFMKSVQKSIARNLLAYEEISPYAMAYRPGGSTRANARPHVGAPMVMKLDVRKFFDHITYPTVKEKVFSSEKYSESNRVLLSVLCVYSHTTPQGAPTSPAISNIIMRDFDNRVGDWCDKRNISYTRYCDDLTFSGEFNPSEVKTFVKEELFKEGFFLNSRKTVVLRNGQRKEITGIVVNEKASVPAEYKKRIRQELFYCQKYGIDEHVKRLGLCESGESYARKLLGRINYVLSVEPENEEMKRGRTNLLLRL

SEQ ID NO: 2390 - protein, 309 aa, unidentified
  source 1..309: note = Related to JAGBKD010000016.1; note = Eubacterium sp.
MIVYRELSSLCQDLGYSARALYTLSNTVTEHYHDVSIPKANGEYRLLHVPDTFMKSVQKSIARNILEYEEISPYAKAYKPGGSTISNAEPHVGAQMIMKLDIRKFFDHITYPMVKEKVFLAEKYSEANRILLSVLCVYSHTVPQGAPTSPVISNIIMKDFDNRVGKWCSEKSITYTRYCDDMTFSGVFKPAEVRKYVGEELFKEGFFLNGQKTVVLREGQRKEITGIVINNKLSIPKAYKNKIRQELYYCRKYGIEEHIRRLEIKERPERYLRKLIGRINYVLCVEPENEEFKAGKEWASEEIKKLSDL

SEQ ID NO: 2391 - protein, 309 aa, unidentified
  source 1..309: note = Related to JAFOYD010000138.1; note = Lachnospiraceae bacterium
MIVYKELSSLCHDLGFSARALYTASNSVDQHYHTVEIPKGNGETRTLHVPDPYMKTIQKSIAKNLLAYEEVSPYAIAYRFGGSTKANAAPHVGHPVILKMDIRKFFDHITYPMVKEKVFPEKKYAESNRILLSILCVYDHTIPQGAPTSPAISNIILREYDDIVGKWCENQAITYTRYCDDMTFSGDFEPAPVIAFVKKALFEQGFFVNNKKTVVLRNGQRKEVTRIIVNQKISVPASYKKSLRQELYYCEKFGIESHLKHIKANENEEHYIERLLGRVNYILSVEPDNQEMKKYRQWLLNQKPYMTKA

SEQ ID NO: 2392 - protein, 305 aa, unidentified
  source 1..305: note = Related to FOWB01000004.1; note = Pseudobutyrivibrio sp.
MIVYRELPSLCKDLGFSARALYAASNTINKRYHKVRIPKADGDYRELYVPDDFLKSIQRSIAKNILAYEPISPYACAYRINGSTALNACTHVGEPTILKLDIRKFFDHITYPMVKEKVFPAEKYSEQNRILLSILCVYLQTVPQGAPTSPAISNIILREFDDRVGEWCKARNINYTRYCDDMTFSGSFDAKELKQFVENEIQKEGFFINAKKTVVLHDGQRKAVTGIVVNEKLSVPAEYKKDIRQIMYYCNKYGVIDHMMANKIIGYKSDYLNVLLGKINYVLSVEKSNKQFIEYRSQVKKWLAE

SEQ ID NO: 2393 - protein, 312 aa, unidentified
  source 1..312: note = Related to JAFQLL010000109.1; note = Clostridia bacterium
MITITYKELSSLTNDLGFSARALYALSNHSTKHYHKTVIPKHSGGERVLHVPDEFLKAVQRSIVRNLLAYEAVSPHARAYCYGASTVKNALPHKGHRVLLKLDIQNFFDSINYPLVKNKVFTKERFSESNRVLLSLLCTYKDTLPQGAPTSPFVSNIIMKDFDNTVGTWCNERNITYTRYCDDLTFSGDFNQDEVKTFVSQELRKMGFFLNAKKTTLLHDGQQKCVTGIVVNDKLNAPLRYRKGIRQEVYYCKKFGIEEHIKKQGIEKTREGYLKSLLGRINYVLSIDDTNEEMKSYKAWALKECKTAQLKK

SEQ ID NO: 2394 - protein, 309 aa, unidentified
  source 1..309: note = Clostridia bacterium; note = Related to JAFUOO010000022.1
MITITYKELSSLTCDLGFSARALYSLSNHASKHYHKTVIPKGSGGERVLHVPDNFLKAVQRSIVRNILSHEEVSPYARAYRYGASTLKNAMPHKGHKVILKLDIKNFFDSIIYPLVKKKVFPSERFSESNRVLLTLLCMYKDALPQGAPTSPCISNIIMKDFDNTVGTWCKERNITYTRYCDDLTFSGDFNVDEAKAFVEAELKKMGFFLNAKKTTVLRDGQKKCVTGILVNDKINAPLEYRKSIRQAVYYCKKFGIDEHLKRNGIEKAAEGYLKSLLGRINYVLSIDNTNEEMKGYKAWAVKQLKKLK

SEQ ID NO: 2395 - protein, 307 aa, unidentified
  source 1..307: note = Clostridia bacterium; note = Related to JAFXHP010000039.1
MIVYKELSSLTTDLGFSARTLYSVARMVRKHYHEVSIPKKDGTERKLSVPDELLKRIQRRIAEKILMYEDISPYATAYRVCASTLINAKAHLDKKCILKLDINHFFDSIIFPVVKNKVFTEEKYSYANRILLTALCIYEDSVPQGAPTSPVISNIILREFDFHIGSWCSERGITYTRYCDDMTFSGEFEAKEVIKEVEDALAKEGFYLNRKKTAFLKDGQRKEVTGIVVNDKVSVPKEYRRKIRSEVHYIKKFGIDSHLSHIGCNMDKVKYLMSLFGKINYALSVSPDNAEMKNCKKIIGKILYKLK

SEQ ID NO: 2396 - protein, 312 aa, unidentified
  source 1..312: note = Erysipelotrichaceae bacterium; note = Related to JAFYHQ010000006.1
MKNTYFELKTLENDLGVKAGTLYRLSNNINSHYRSVSIPKPDGSKRTLSIPDPVLKHVQKRINDVILSTMNVSVYSKAYSFGDSPLRNAIPHLKQKLILKLDIRKYFDHVTYPLIKEKVFKDDQFSESNRILLSLLCIYNESLPQGAPTSPAISNILLYDFDNVIGEWCRQRNFVYTRYCDDMTFSGNFDGLHPIDIIRKVELELKKYGLFINRKKIQSLHDGQRKKITGIVVNDKPNVPANYRRKIRQEMYYINKYGLQDHLKKTGSKQTEAEYLRSLLGRINYVLSINCSSEFEVYRTKTVSLLDALLSV

SEQ ID NO: 2397 - protein, 309 aa, unidentified
  source 1..309: note = Related to JAFRKA010000015.1; note = Erysipelotrichaceae bacterium
MMNTYFELNTLEKDLGISARTLYSLSNNINSHYHSVVIPKSDGGSRKLSIPDYSLKNVQKRINNVILSCMNVSIYAKAYTNGDSPLRNALPHLDKKTILKLDIRKYFDHITYPLIKESVFKKENFSESNRILLSLLCMFNESLPQGAPTSPAISNILLYDFDNWIGEWCRRQDITYTRYCDDMAFSAEELNSDIIIERVRLGLKKYGLYINNKKTQIIHDGQRKKITGIIVNDKPNVSIDYCKKIRQEMYYIRKFGIDSHLKAIGYEKTVDDYLRSLLGRINFVLSISFSKEFDDYRTTIAYIRNTIFS

SEQ ID NO: 2398 - protein, 315 aa, unidentified
  source 1..315: note = Erysipelotrichaceae bacterium; note = Related to JAFYHQ010000014.1
MKHTYFELETLEKDLNVHAKTLYGLSNNINAHYHSRIIKKSNGGDRVLSVPDFILVKVQNQINDVILSRMPVSVYSKAYSAGDSPLGNAAPHLRNDTVIKLDIRQFFDHVTYPLVKEKVFRKELFSESNRILLSLLCMYNESLPQGAPTSPAISNILLYDFDNRIGEWCRQRNIIYTRYCDDMTFSGDFENWDPIDIIRKVKLELKQYGLFINGRKTKILHNGQRKKITGIVVNDKPNVSIDYRKKIRQEMHYIRKYGLKNHIRKTGCDKSEMEYLRSLLGRINYVLSVNRIEEYERYRDDVVSYLRHMGLRQDL

SEQ ID NO: 2399 - protein, 323 aa, unidentified
  source 1..323: note = Related to JAFRQF010000031.1; note = Erysipelotrichaceae bacterium
MKHTYFELKTLEKDLGVSAKVLYTLSNQINRHYRSVEIPKSDGGTRKLSVPDPLLKSVQRKINEVILSRMDVSSYARAYSYGDSPLKNASSHVNKKEIFKLDIRKFFDHVTYPLIKERVFTADRFSESNRILLSLLCMYDESLPQGAPTSPSISNILLYEFDEELGIWCKERDVSYTRYCDDMTFSANSLTPEEIEHKVSSMLKQYGLFINQKKKQYIRGSRRKKVTGIVVNEKPNTPVEYRKKIRQEIFFINKYGLKDHMERIKCTDSQGSYLSSLLGRISYVLSINQSEEFEKYREQISTLLKEQDDMRIIQKSEETRRLL

SEQ ID NO: 2400 - protein, 308 aa, unidentified
  source 1..308: note = Related to JAFUCV010000276.1; note = Solobacterium sp.
MIVYRTMQALETDLGFSARTLYSAANTIDRHYHEVRIPKRDGTERILHVPDEFLKRIQRRINDVLLAGMPVSRYATAYNPGNSIMQNAQPHAGKHFLLKLDIRDFFDHITYPLVKEKVFPEHIYSEQNRILLSVLCVYHDSIPQGAPTSDLISNIVLYDFDRTVGRYCRERNIAFTRYCDDMSFSGDFDPQELTAFVSEELRKDGFFLNRKKTVTARPGQAMRVTGLSVNETVNVPSEYRRKIRQEMHFIQKYGTAQHIKRLGIGMEEQAYLNSLKGRIAYVLSVREIPEFREYLKQISLLEKRQMIQ

SEQ ID NO: 2401 - protein, 328 aa, unidentified
  source 1..328: note = Related to DS264270.1; note = Eubacterium ventriosum
MVYYKDLSTLEKDIRIPRKVLYKFSRNIFSNYKTVEIMKNNGEIRTLHVPKDNLKSIQRKIRFYILRKMPTSIYATAYIRGEGIVNNAKVHVGAENILKLDIRHFFDNITYPMVKEKVFKPDIFSEPIRILLSILCVYEHSIPQGAPTSPDISNIIMRDFDKEIGDWCKERNINYTRYCDDMTFSGKFDKEPVIEKVESELRKMGFYINNRKTTYLHSGQSKNVTGIIVNEKLSAPRKYKKEIRQEIYYCKKYGIENHMKHSVLKKKSRQLSDALKGQIDIDIDVEISTEQYINSLMGRINYVLSVEDNEEMREYKEWLYGCGNTQKF

SEQ ID NO: 2402 - protein, 324 aa, unidentified
  source 1..324: note = Clostridia bacterium; note = Related to JAFTAK010000098.1
MTNAKKKYSDLSSLALDLGFTGKELYTVSNAITRYYLEVAIPKSNGETRTLHVPSGMLKMIQTSIARVLLPKVPVSRYACAYKPGASAVKNAMPHVGAPIVLKLDIRKFFDHIIFPIVKEKAFPEKMFAEKLRILLTILCIYKEALPQGSPASPGISNIIMRDFDDKVGGWCAERGIAYTRYCDDMTFSGDFDPKPVKDLVRNELRKMGFFLNDAKTVVAHDGMRKQVCGIVVNERPSVPKDYIKKIRQEIYYIRRYGLASHLKRTNPGVDPVNYINSLSGRIRYSIYVSKASDRCADPELSGYLDVIKKEMDILAGRDYRDRT

SEQ ID NO: 2403 - protein, 341 aa, unidentified
  source 1..341: note = Erysipelotrichaceae bacterium; note = Related to SVBR01000043.1
MLAAEQHTSRVHALTGCPAAALQNILKWCQKGGRMIVYRELSSLCSDLDVSAKTLYTLSNSITSRYRTAQLLKKDGGYRTLRIPDPLLKEVQRKIVQVLLSRMEISPYATAYRYGASIKKNASVHVGQKTVLHLDIRRFFDRILFPQVKEKVFPKERYSEPIRILLTILCFDGENLPQGAPTSPWISNIILCDFDNTVAAWCRKRGIHYSRYCDDMTFSGEFDPAAVEDFVERQLKKEGFFLNRKKTRRMDRSRRQYTCGLVVNDQVSVPSSVRRKIRQEMYMIQKYGLDSHLRKIQYEGSEEEYLNSLLGRVGFVLSIQASDEFLRYKQTLLRMMKKRNI

SEQ ID NO: 2404 - protein, 310 aa, unidentified
  source 1..310: note = Related to JAFUHN010000140.1; note = Solobacterium sp.
MIVYRELSSLSRDLEVSVKTLYSLSNSISRHYHTVQLPKKDGGVRTLRVPDPLLKHVQRRIAEVLLAQTEISPYATAYHYGASIKKNAAVHTGNEKVLRLDIRQFFDHILFSQVKQKVFPAERYSEPIRVLLTILCFDEETLPQGAPTSPWISNIILKDFDDAVSAYCRSKGIHYSRYCDDMTFSGELDEKELTEFVSEQLKKEGFFLNRKKNRLMKASQRQYTCGLIVNEKVSVPSDTRRKIRQEMYMIQKYGLSSHLEAVHFEGSLEEYLYSLLGRVNFVLSIEKREEFLKYRKALLEMISGNTDTHA

SEQ ID NO: 2405 - protein, 344 aa, unidentified
  source 1..344: note = Related to DPVX01000340.1; note = Erysipelotrichaceae bacterium
MGPGTAAARRNIRKWCFGREERRMIVYHELSSLCLDLGIEAKTLYALSNNVSSHYHEVKIPKKGGGMRTLHVPDDVLKHVQKRIADQLLACEEISAYAYAYRYGCSAKMNAKRHVNQEIVMRLDIRDFFDHITFAQVREHAFPKWKYSEPLRTLLSVLCIDEDSLPQGSPASPAISNIIMRPFDDVMGEWCRRKKITYTRYCDDLTFSGSFEPNEVIAQAALFLSHLGFFLNEKKTVIRRKEQRQFTTGLIVNESVSVPPEYRRKIRQEMYYLQKYGLSSHLEQINETDEKTYLRSLLGRIRYVLYIHSSEEFRNYEAIVLKLTEETSHGRDNQKTDCDAGRAE

SEQ ID NO: 2406 - protein, 315 aa, unidentified
  source 1..315: note = Clostridiales bacterium; note = Related to SVGZ01000005.1
MIFYGLAKLEKALGYEAKTLYALSNNVKKHYHPAQIPKKNGEMRNLLVPDMALKSVQKAIAEKILQNFPVSPYAYAYRKGFGIKKNARQHTGKEKVLNLDIEKFFDHILYTQVKDYAFPKAFFAEDVRILLSILCYGEKGLPQGAPSSPAITNLVMHDFDMKIGKWCEKQGIDYSRYCDDMSFSGDFDEKAVISFVKKELRRLNMSLKREKTRVAKKGSRQTVTGIVVNEIPSVPSEYRRKLRQEIYYLKKFGAGHQLRHYGLKMTAKDYFLSLLGRVNYVLHISPDNYEMWQYRRYLKNMLRQSRLQPRRSVLL

SEQ ID NO: 2407 - protein, 323 aa, unidentified
  source 1..323: note = Related to JAGCGE010000004.1; note = Clostridiales bacterium
MAYLDPDVIAVLLHVPVHILYAFSNSSYKHYRLISIPKKNGKTRQLTVPDNDLKIIQRSIYFRFLRGREVSPAAKAYLKKGTTTENAKPHVGKPMILKLDIRHFFDNVLFWHVKEKVFTSDIYSENARVLMTYLCTYDGHLAQGAPSSPAITNILMKDFDDEILRFCGKDGVCYTRYCDDMTFSGVFEPDQVISKVAWELKKMGLHLNPAKTRVIWQGQQMNVTGLVVNDKVSVPASYRRKIRQEIHYIWKYSVEDHLKHMGREEDEQYSYLSNLLGRINYVLSIHKDDFEFQEYKDYVVMGCDGRLRYKERPYQIGIDELLG

SEQ ID NO: 2408 - protein, 335 aa, unidentified
  source 1..335: note = Related to JAFQLL010000102.1; note = Clostridia bacterium
MKRSIKKLIRPKDAAMWLYKAQSGKEVTEALMLLYDMSNNAPKYYQKKEIPKKQGGKRVLSVPVTELKRVLCCIKAEILDYIPVSDYARAYKKGGGIAHAAKEHVGHETLLRLDIEGFFDHITYKEVYKHVFGRYYPRKVAGLLTALCCYEKHLPQGAPTSPAISNIVMKGFDDEVAVFCKMNNIHYTRYCDDCIFSGKFDVGAVIKKVKSELLKMGLRLNDEKTKVISQGQRQIVLGVCVNEKMQAPAAYRNRIRQEIYYCKKYGVKNHLLRLNDERFVKKTPGGVFVDAVGYLMQLKGKISFVLSINPDDKEMREYFNLLSVSKKSTRAKKSC

SEQ ID NO: 2409 - protein, 407 aa, unidentified
  source 1..407: note = Clostridiales bacterium; note = Related to JAFZLF010000009.1
MNRSLYLPQMDSLYAFAYQYLRVNGRSCRSDDIYSCGGEIKAILDDTRPHYRKILIPKPNKKEMRTVFEVTQDLRSLQHFIKRYILDRLDAMYTSPYAFAYRLGLSARDNASAHAGHRYMLKLDIRHFFESTRAGQVYSMFRKYTPYNRQILGTLTRLVCYKGALCQGACTSPQIANLILSDFDMAIGTCCRDMCITYTRYCDDMTFSSVLPFDKSALERTVALMLQPYHYKLNTRKTRFLGPGHRLEVTGAVVNERVHAKREYRQKIRQELYYTNRYGVADHLERTRPAWYHTPCSCAQIRHFLYSLQGRINYVRMLDPDDPFLGDAQYQLFRLFLREQSAFRNIYADVGPVSQRQGSTSGFFPEEGPVGFDDLDTDLMEPPFNIPDMDPPELPFDVLGWDDPFSG

SEQ ID NO: 2410 - protein, 382 aa, unidentified
  source 1..382: note = Clostridiales bacterium; note = Related to JAFZVE010000038.1
MDSDEIYACAGEIKAILDDVRPHYRKILIPKPNQEEMRTVFKVTSDLQLLQYFIKFRILDPLDRAYTSPYAFAYRRGYSARDNASQHSGRKYMLKLDIRHFFESTRAGQIYSMFRKYTPYNKTILGTLTRLVCFNGALCQGACTSPQIANLVLSDFDRTIGSYCKCIGVTYTRYCDDMTFSAYWPFNKVAVKDMVEDLLRPYHYKLNTAKTRFLGPGKRLEVTGAVINDRVHAKREYRHKLRQELYYACKYSVAEHLERTRPKWYHSPCTAEQVRHFIYSVQGRINYIRMLDPEDPFLEYAQDLFQVLHLSEVSAFSRNGHFRGSEPDEDLPDPLDIPDLFFTDLEEPPFDVMGDYFPGEEFFHPGDYPVPGPQDDPLFGSE

SEQ ID NO: 2411 - protein, 491 aa, unidentified
  source 1..491: note = Related to JAFZQI010000003.1; note = Clostridiales bacterium
MKPTLPKMDSAYTFIKAYRRSKGYSENRNRAFRDTRELLSVLDEISEHYEKHFVSKKNSDELRTVFSVSYPLREYQEFIRAQVLTPLDLAYTSSFAYAYRRGLSTKDNAKVHEKSRYMLKLDIRHFFESTRKRLVFATFEKYTSYNRSILGILTKLVCYNGSLCQGACTSPTIANLVLADFDASVGLFCDGLGIRYTRYCDDMTFSSPFEFEAKNVEEFVRLQLKPLRYSLNDRKTRFFRPGQRLEVTGAVVNTRVRAPREYRQKIRQDLYYINKYGFIFHLEKTRPSWYSGKATEYDILHLLKIMKGRIAYVKMLDPDDPFASNARKELDAAALRYGVGDLSKMQDRQISFEIENAKILRFMTLEERLQRSVSPEVHLMVWHAMRGLEYHPEGNGGFVSDEEDDGLFSDERDVRDNRCFADEGHTSMQDANDTLPFEAVNFPTFDEVSIPPFDEDFPTFDEHRIPSFDEVIVPSPDEDKTPPLGNEFPDD

SEQ ID NO: 2412 - protein, 513 aa, unidentified
  source 1..513: note = Ruminococcaceae bacterium YRB3002; note = Related to FMTG01000031.1
MVVNWEKKRRRRLTELEQKILAERPGEPAFNAGSGDLPVIGSLMSLVMLARGNSFSSEEGFWREYRRASAMVDDTSPYYRHYPIPKANGRGYREIYTVDDGLRVYQEAIRGTILDPLDEKYSSKYAYAYRRGRSVRDNAAVHAGHGYIVKLDIKDFFDSTGKSDVYRMFSRYTNYSRAAKTVLTALVCRDGHLSQGSCTSPQIANLVMVDLDGELAAYCEPQKITYSRYCDDMTFSSDEPFDHEALIRFVSLRLRQMHYRLNCRKTKVLGPDSRHIVTGIVVNNERIRVTKEYKKKLRQEIYYIRRYGITSHLKRIRPGEYTPVFEGAGSKHEIHYLAHLLGQAAYALYIDHDDEELRAMVDYLKQAVTECVASTGTRRSEYLSVISRQILNNRMCSVNDRLKIRVSCQYDEIVVTASFRLIDDPDVREVADHYTKYSRVQRRCRGRFVKPGRGTGRGTESATESTTATGGDGIICYEVVIPERDFSRYNEAVPEVMDDITWIYSDFMKYKLI

SEQ ID NO: 2413 - protein, 526 aa, unidentified
  source 1..526: note = Related to JAFWKC010000096.1; note = Eubacterium sp.
MKLQIEDFENVKVDIKEFIEYIMPSNKQSMNKLARILYPDSNEKDYDSLTNYLYVMLDGIEKDYEEFTIKKKNGKLRTISKPNEALADIQKRIYEYILRNAPVSPCAAAYVKGKSIRDATAKHIGQPILIKIDVKDFFYNIFFDSVNDAFTNLGFDKYQAITLANFCCYKGSLPQGTSTSPMLSNLVFRDFDDEMEKLCLKYNIRYTRYSDDMLFSGSFDNEFDTKRFVPYVKFMLEDFGFQMNLSKTKIIKQGQRQTALGVVLNEKQQVTKEYRKQIRQEIHYCSEHSVKSHLEHIQDERFLLPNGEPDYIGYIDNLNGRINFALQINPDDMEMVSYKNSLKSLSSSMYQAKVVEQNQLMECLYKVFSDYVNSKIKYTILYKKLLEYGFSNSQLSKIGIYEEKIVYGFDEVYLTKDDKGNYLSLITKHSCSEHLGNVIINPYCDGFFGSRFDKNLGYLTVTSDKIAAVTSGLTNYVSFNNAPSKFFLSKKKLEMIRKYGNKVVVADCSGAEYIRLQMIANHIEVI

SEQ ID NO: 2414 - protein, 321 aa, unidentified
  source 1..321: note = Oscillospiraceae bacterium; note = Related to DOBY01000149.1
ETVYITKASGKKREINKPDIVLKSFQKSVYKNILLHIPTSYYAVAYKKGSSLRYSTAVHIGKPMILKLDIKNFFGSILYKTVQEMFLKQGYDYFMATTLATLCCYKGRLPQGTPTSPAISNIIMKDFDDKVACFCYARNIAYTRYSDDMTFSGSFDSDEVIEFVKNKLNKSGFQLNNKKTKLIKQGQRQTVTGVVVNEKQQLPKGYRKQIRQEIHYCQKYSVKSHILHTNLTAYIRPNGDVYYKEYLLNLYGRINYALQINPTDEEMLKYRSVVKSAIDKLDIIKRKINDEIFRLAVDFFTSDKYKTNKIYLYLKESGYTN

SEQ ID NO: 2415 - protein, 357 aa, unidentified
  source 1..357: note = Oscillospiraceae bacterium; note = Related to JAFYNQ010000087.1
MYWNRETNAISISAGDMKIMRQCNISMERLMQKPANPQLPPLWSILSYAMLRSDGDAAVGIWRNFRLYQKLFENPNQFYFGKEICKTDGSVRELNVPMSRLRCEQEFVFENILSKLPVDSHAYAYRKGISMQDCARPHVGKKVLIRLDIQDFFGSVTENMVYNRLLEDTGYPRKLCRFLAKLCCYQHHLPQGAVTSPMLSNIVFRPLDEKLAEFAGFCGMAYTRYSDDLYFSGDEIDVTSFISCVKLVLGNSGFRLNGKKTRVRMPQHRQAVLGLTVNEKLQVSRTYRRNLLQEIYYLEKFGKNCLGAQKEGNYLRYVQRLLGKVNYAIASGAEDPKLKAAAEMLKKRIFLIEREFY

SEQ ID NO: 2416 - protein, 354 aa, unidentified
  source 1..354: note = Related to SVKT01000009.1; note = Oscillospiraceae bacterium
MKWKERSSTFCLEPQDMQIIAQCKMSLTEMVRHDHPNKNIPPLWSVLSYVMLQSTSHANIWYRYRALREMASNTKLWYYTQYIPKSNGGARRISVPTHAIRTQQKYILAKILKGLPVSDHAYAYREGRSIQDCAKPHESQDVLIHLDLTDFFGSISENMVFLTFYRETGYSRSLCRFLAKMCCLRGSLPQGTVTSPMLSNIVFYRCDEDLARLAARYGMNYTRYSDDLYFSGNSALDVGEVLKKITRILLYYGFRINEKKTKIRRRQHRQTVLGLTVNDHIQVSRKYRRDLLQELYYLDRFGENCKGAVACGDYLKYMQQLQGKLAYVLHADPENVKMREAHSKLIRRIHQYSE

SEQ ID NO: 2417 - protein, 365 aa, unidentified
  source 1..365: note = Related to JAFQFC010000021.1; note = Oscillospiraceae bacterium
MKWEGKQVLFSAADLQVLMQARFRPDEVPDMEEVKEGLPPLWSPLSYTLWKCHGETSRKNLWRQHREALLMAKSGSGYYHHMLVRKNGGSGVRRISVPCYELRDHQRFIYKNLLSRLPLSPRACAYRKGVPLRRCAEPHCGAEVLVHLDIRDFFPSITEEKVSFALHRATGYEEELCDFLAGLCCENGRLPQGAVTSPALSNLAMAGMDGTFGAMAAMLGFTYTRYADDIYLSSSDRSADAARIVKLARDFLRSEGFELNRDKTRIIRQGRHMAVLGLSVNEKVQVSRRYRREVRQKLHYLKRYGADAQGVQEAGGQEPYALHLLGKVGYILQVNPMDQQALRARLELLTGLHRLHRGMPFWWSA

SEQ ID NO: 2418 - protein, 421 aa, unidentified
  source 1..421: note = Related to JAFSHB010000043.1; note = Oscillospiraceae bacterium
MEWDPRREKLSLSERDLKIMKDCGMTPAEILRAVESRGRIVPLWSVLSFFMLYETSESPKAFWRTYRQGETAARYRDCLYHDRKIPKRCGGVRTIAMPMWPLAQMQTCIAEKILQHIMPDDHACAYRRGMSVSDCAEPHRKKRIVIHLDIRDFFGTIREDMVFDALLRETGYSKKLVRFLSRLCCYQDRLPQGACTSPALSNLVFKPCDEAIGGFAASLGMDYTRYSDDLYLSTSGEVDTGLVIETVRKILADHGFRLHNEKTKIMGRQQRQSVVGIVVNEKLRPSRTYVRTVLKDVYYVSRFGAGSNQVAAFGDYYSYLRQLQGRVNYVRCFMPEDRAVLEAVQTVRSLIGAYHRTLLDAVTALEAQCRDGYVVVFSENYYRPLVKLKEQLAVVRRFLPRDYRFHDAEERVYAMLGEELY

SEQ ID NO: 2419 - protein, 367 aa, unidentified
  source 1..367: note = Oscillospiraceae bacterium; note = Related to JAFXTM010000067.1
MRWYPSGKLNFTAADLAVLSHPAFASKPWAGAGAWLRADPAYPPIPSALVFSLLAGPRESRPERMWKQYRKLLEIANDPAQYYVSHEIVQHRKPRTISAPFYELAQYQRWILKNILERAPTTDFAFAYKKGLTLADNARVHLGRSVIVKLDLVHFFDSITFGMVYEVFAGQLRYPQETAVLLANLCCLNGRLPQGACTSPYLSNLCFAKADGELAGYCREKGLAYSRYSDDLTFSGDRIDVKELIAFVRETVKKYGFSLNYRKIHVDGKGRRHRVTGIVCNEKLNAGADYRRKVRQEIYYLRKYGAADHLRRRNDPAYRNADGTPCVERYYAALLGRISFILQVDPEQEEFWSYRDYVRDLMLRAAE

SEQ ID NO: 2420 - protein, 358 aa, unidentified
  source 1..358: note = Related to JAFTYM010000022.1; note = Oscillospiraceae bacterium
MIWRKRERINLSELDVFVLRKYAGQTNPMEEILNSEIPENLPPILTPYHLPLFMHNFKKMYYFWENYRDIMKCSNEPREFYRRYDIMKRYGKMRTVYKVSGVLADVQHWILRNILDELPVSRHATAYAKGRKIMDNAAPHVGKKLVVKADITDFFGNVKYLSVYDVFKNAGYSKSVATLLANLCCCDGHIMQGACTSPALSNLCFTKIDSVISEFCTERGITYTRYSDDMTFSGDFAPSELITYLRRVLKFYGFTMNDKKTKVLYRHHRQTVTGAVVNDKPQPTKEYRRRIRQEMYYIRKYGVLGHMDRLKDEKSYVSPINYLENLYGRMNYVLQYTPDDEELKRWMHEVDRIEQSLF

SEQ ID NO: 2421 - protein, 330 aa, unidentified
  source 1..330: note = Oscillospiraceae bacterium; note = Related to JAFQMH010000077.1
MDEILKSNIPENLPPLLTPYHIPTLMHNFPKVISFWKSYRELIHCSNHPEEYYRCLVLPKRDGKMRKVYAVSGALAQAQHWILRNILDELPVNPHAMAYVKGRSLLDNANPHAGKKLVVKADIEDFFGSVKYISVYHVFKSAGYSERVSAVLANLCCCKGHIMQGACTSPALSNLCFAVIDEKISAFCALRGITYTRYSDDMTFSGDFAPSELITYLRGLLKFYGFTMNDKKTKVLYRHHRQTVTGAVVNERPQPTKEYRRRIRQEVYFIRKYGVLEHMDRLKDNKCYVSPINYLESLIGRMNYVLQYNPHDEELLSWMDEIDKIEQGLF

SEQ ID NO: 2422 - protein, 342 aa, unidentified
  source 1..342: note = Proposed Anaeromassilibacillus sp.; note = Related to NZ_LT835157.1
MIQTLEEFCEWLDPSVSPRILQKKVYWLRSLRSAKKKRKEYGLFWLAKRGGGYRPVASPSPGLKQVQRGILSLLAYGEIAPPATAYRPGRNLLDNAAVHVGQPILVKLDLLHFFGSIHFPSVFCAIDRTLSQNPEIAPYSKESNGKNAGSTRADSFNALLSFFFTTFCTLDGILPQGSPASPMLSNLVFFPLDQQIAAFCGQRHIHYTRYSDDLTFSGDFSPEPLIRFVYQLLRKNGFLLNPAKTIIARQGRRQQVTGILVNDHPQVGRDYRRRIRQEVHYLRRFGVASHLLHEGQTGWALHPAPYLQSLLGRIQFVLQICPYDREFLEYRAYVLRLLKSSL

SEQ ID NO: 2423 - protein, 339 aa, unidentified
  source 1..339: note = Proposed Anaeromassilibacillus sp.; note = Related to NZ_JADNJD010000005.1
MIQTPEDFCQWLQPDASIRSVQKSLYWLLSLRSARKKRREYQVFWLAKRGGGYRPVAAPSLGLKKVQRGILSLLSVGEVSPHATAYQPGCTLLRNAAPHVGQPFVVKLDIANFFGSIPFPAVYAAIDRALCRNPEIQSSAKASSAREGATESYNAALSFFFATLCTLDGVLPQGAPTSPLLSNLVFFPLDCRIAAFCEGRKIHYTRYSDDLTFSGDFSPDTLIRFIRRLLCEHGFLLHESKTVIARRGNRQQVTGILVNDRPQAGRKFRRRIRQELYYIQRFGLSSHLLHEGRTGESCAPGPYLHSLLGRIQFVLQVCPYDREFLGYRAYILQQMKHYT

SEQ ID NO: 2424 - protein, 344 aa, unidentified
  source 1..344: note = Related to NZ_LN868536.1; note = Proposed Anaeromassilibacillus senegalensis
MLRTLEDFCRAVYPGLTPEQFRKNSHQLAAYADSRKRRKSYRECWIPKKHGGARRILVPSPGLKQIQRAAAALLKNGSVSPYATAYQTGRSVLDNAAPHVGRELLVKLDIRNFFGSIRFPAVFHAIDHALRRNPEVGRHCKDYPHGSRESHNYNSVLSFYLAQFCTLDGVLPQGAPSSPILSNLVFDSLDCKIAAYCERRNIQYTRYSDDMTFSGCFHPEVLIHFVRRLLAEYGFTLHEEKTVLAGRGCRKSVTGVVINETPQVSRSYRRNLRQQIYYIRRFGLREHLLHLGRTADAGQPEQYLRQLLGKVSFVLQICPEDPEFQQYRAYCLGLLRAHAGKKAL

SEQ ID NO: 2425 - protein, 367 aa, unidentified
  source 1..367: note = Related to CP042469.1; note = Clostridiales bacterium
MRRAMNHTLREFLESIKSKHTYLLFRYTDEAYKLRRCYRPVILKKKNGGFRVLQVPDENLKRLQRQLLTYLQHAEISPCAAAYVKGRGLSEHAHYHAGRSMLLKLDIEDFFGSISFSKVLFAVKEALKRSPLVGQEQRSEIGWFIAKACTLDGVLPQGAPTSPILSNMVFLHLDQEINSYCIQRGIHYTRYSDDLFFSGDFRPSEIIPLIRKLLRRNGYTLNENKIVAAGRGSKKLVTGVVVNQRPQADRSYRREIRQSIYYIGKFGLEEHLKRKGLLDEGMQPEDMRSEAAGNEDFGREDVIIRAQMVKELQRLIGRIVFVLQIDPQNREFQDYKKFCIGLLNRLPVIFNGRLLSEAEINEGWGSA

SEQ ID NO: 2426 - protein, 344 aa, unidentified
  source 1..344: note = Candidatus Anaerotruncus excrementipullorum; note = Related to DXES01000132.1
MLHTLEAFCAWHYGGGDPLRLARRTRWLMRLARGRRLEGEYRPQEIPKRKGGTRKLLVPSHRLAHLQRGILRLLEAGEVSAAATAYEPGCSLRQNALPHRGARLLVRLDLADFFGSISFQQVFQAVDRALRRSPLVGRHLLDGYDRLQREERVYNQVLSFYFARFCTYRGHLPQGAPTSPHLSNLVFFPLDEALLRYCTRRGITYTRYSDDLAFSGETFSVGELLRFVQRLLAAHGFRLNEGKTVVAGPGQRKRLPGVVVSHKLQADVGLRRQLRQEFYYIGRFGLASHLERTGEQRPPSAYLRRLLGRTGFVLQVNPEDREFQEYLERGKRWLKEQEERAAEG

SEQ ID NO: 2427 - protein, 331 aa, unidentified
  source 1..331: note = Related to VFMF01000001.1; note = Clostridium sp.
MLHTLEDFCRYLYHNRDERKFYRCYYQLLRLSREKYRCSCYTLRELPKGEAGTRLLCVPNRALRRVQKGILGLLPAAGPCCVTAYLPGKSVLDNARPHLGQPLVVKLDIRAFFDSISFAQVFRAVDRALEASPYVGCHYLNADDRSSLENRNYNSVLSFYFARFCTRGGSLPQGAPTSPLLSNLVFGPIDGQISAYCGRRGIAYTRYSDDMTFSGTFNPLALIDFVRRVLAENGFTLNDRKTRILNRGQRRKITGVVANQKLQAPREYRRDIRKELYYIRKYGWESHLSHENIAQGPEEYRRGLLGRVGFVLQLCPADGEFQQYRQWLLEN

SEQ ID NO: 2428 - protein, 352 aa, unidentified
  source 1..352: note = Related to JAFXOM010000274.1; note = Oscillibacter sp.
MEDAARFERETGLPYFPDAHQFADAYLPTDRSEEHGENVRRLYDLANAPRWYYRSVSIPKQSGGTRTLHIPYGTLKSVQHFLLHSVLERLPVSPCAVAYVRGVSLSESVRVHVGKPLLVRLDLKDFFDHIGFLQVYQNAFAAYPKAVRVLLSRLCTYTLPSGRSCLPQGAPTSPYLANLCMRRADDAIYAYCARRSIAYTRYADDMTFSGSFEPERLIETVRSILRREGGFELNEEKTRILRACRRQSVTGAVVNERPRASATYRREIRQECFYCKKFGVRSHLLRTKKAPFVRPSESVKDGYYVSQTRYLEHLLGKINFTLSLDPKDREMRLCRKEVLLWLAERNAAPRER

SEQ ID NO: 2429 - protein, 353 aa, Flavobacterium sp.
  source 1..353: note = Related to NZ_QNVY02000005.1
MDFNHYKEAFIKESRKIGFSLPNIQHCLDYAEVLFSHHVPVIYNPSHLSALVGYKKEYLKKASLFPNYFYRDFEVAKKNGTKRLISEPLPSLKEIQIWILRSILYKIPVSPFAKAYKPNVTLLENLRFHKNQSKIFTLDLENFFPSISAELVEAEFLELGYSKIVSKLLSRLCTRNGNLPQGAPTSPYLSNLIFKKADAEIASYCKDYKIRYTRYADDMSFSGDFDHEELLKKVTETVEKLNLRINAKKTKLMTPNMRQTVTGVVVNQKPQVIFYKRNELRQTLYYIQKFGFEEHKIFKKNNHNNYLEHLLGKINFVLQINPKDAEFIKYKAVLFDLKHKQDLTAIENELFPI

SEQ ID NO: 2430 - protein, 353 aa, Flavobacterium sp.
  source 1..353: note = Related to NZ_SMFN01000003.1; note = Flavobacterium sandaracinum
MDFTHYKDAFIKEAHKTGYSLTNIQRCLDYAEALFLHEVPVIYNPSHLSSLVGYKKEYLKKASLFPNYFYRDFEVAKKNGTKRLISEPLPSLKEIQIWILRSILYKVPISPFAKAYKPKVTLMENLRFHKKQPKVFTLDLENFFPSIRMETVQNVFLKLGYSKIISKFLTRLCTRDGTLPQGSPTSPYLSNLIFKQADAEIASYCKDYKIRYTRYADDMSFSGDFDENELLQKVTETVEKMGLRINAKKTNLMTPNMRQTVTGIVVNQKPQVIFKKRNELRQALYYIQKFGFEEHREYKEIDQKNYLEHLLGKINFVLQINPKDAEFIKYKAVLFDLKHKKGIKTIDNEFFPI

SEQ ID NO: 2431 - protein, 353 aa, Flavobacterium sp.
  source 1..353: note = Related to NZ_FODN01000006.1; note = Flavobacterium sinopsychrotolerans
MDFAHYKDAFIKEAHKTEYSLTDIQRCLDYAEALYLHQVPVIYNPTHLSGLVGYKKEYLKKASLFPNYFYRDFEVAKKNGGKRLISEPLPSLKEIQIWILRNILYKVPSSAFAKAYRPTVTLLENLRFHKNQPKVFTLDLENFFPSIRVEAVENEFLKLGYSKIVSKLLSKLCTRNGTLPQGAPTSPYLSNLVFKEADAAIATYCKEHKIRYTRYADDMSFSGDFDENELLQKVTETVEKIGFRINAKKTKLMTTGMRQTVTGVVVNEKPQVVFYKRNELRQALYYIQKFGFEEHREYKEIDQKNYLEHLLGKINFVLQINPKDAEFIKYKSLLIDLKNKQDLKALEDELLPI

SEQ ID NO: 2432 - protein, 353 aa, Flavobacterium sp.
  source 1..353: note = Related to NZ_SMLH01000005.1; note = Flavobacterium ranwuense
MDFAQYKETFTDKSHKIGYSLPNIQRCLDYAEVLFSHDVPIIYNPTHLSLLVGYKKEYLKKAAVYPRYFYRDFEIAKKNGTKRLISEPLPSLKEIQIWILRNILNKVPISPFAKAYKTNVSLIENLKFHKNQPKVFTLDLENFFQSITIKLVEKEFHQLGYSKMVSRLLSKLCTRDKTLPQGAPTSPYLSNLILKDADAQIAAYCKLHKIRYTRYADDMSFSGDFDENKLLHKVIEIVEKLNLRINKNKTKLMTSNTRQTVTGIVVNEKPQVVFHKRNDLRQAMYYIKKFGIEEHREYKEINQKNYLEHLLGKINFVLQINPKDIEFLEYKSILKDLKKKQDLKAMEDELLPI

SEQ ID NO: 2433 - protein, 353 aa, Flavobacterium sp.
  source 1..353: note = Related to NZ_JQMS01000001.1
MDFTQYKESFTEEAHKMGYIEQNIEHCLEYAEVLFSHDVPVIYNPSHLSLLLGYKKEYLKKVSLFPRYFYRDFEILKKNGSKRLISEPLPSLKEIQIWILRNILYKVAISPFAKAYKPNVCILENLRFHKNQPKVFTLDLEHFFPSITIEKVEKEFRELGYSKMVSKLLSRLCTKDGSLPQGAPTSPYLSNLIFKDADEAISDYCKQHKIRYTRYADDLSFSGDFNENKLLHKVTEVIEKLNLKINKNKTKLMMPNTRQTVTGIVVNEKPQVVFYKRNDLRQAMYYIKKFGFQEHREYKEIDQKNYLEHLLGKINFVLQINPRDTEFISYKSILIDLKKKQDQKELEDALIPI

SEQ ID NO: 2434 - protein, 353 aa, Flavobacterium sp.
  source 1..353: note = Related to NZ_JSYM01000001.1
MDFIQYKETFSHDAQKKGYSEQNIKRCLDYAEVLFAHDVPVIYNTTHLSLLVGYKKEFLKKAALYPKRYYRDFEILKKNGSKRLISEPLPSLKEIQIWILRNILYKVPISPFAKAYKPNISILENLRFHKNQPKVFTLDLEHFFPSISFEAVEKEFLELGYSKMVSKLLSKLCIRDGSLPQGAPTSPYLSNLIFKKADAVISDYCKQHKIRFTRYADDLSFSGDFDENKLLHKVTETVGKLNLRINKNKTKLMMPNTRQTVIGIVVNEKPQVVFHKRNELRQAMYYIKKFGFEEHREYKEIDQKNYLEHLLGKINFVLQINPKDEEFIGYKTILIALKKKQDLKTMEDELIPI

SEQ ID NO: 2435 - protein, 353 aa, Flavobacterium sp.
  source 1..353: note = Related to NZ_SMFM01000002.1; note = Flavobacterium caseinilyticum
MDFPHYTCVFTREASKLGYSPKNIQRCLEYAEVLFSHGVPVLYNPSQFALLVGYKKEYLQKAALYPNYFYRNFHITKKNGSKRLISEPLPSLKEIQLWILRNILYKVPVSAFAKAYKPTVSILENLKFHKKQPKVFTLDVENFFPSIKYDSIQKVFLQLGYSKMMSRLLTRLCSCNGALPQGACTSPYLSNLIFKEADAAISNFCMQRKIRYTRYADDLTFSGDFDENELLKHVTEIIERQNFRINGNKTKLMTPNSRQEVTGIIVNEKPQVVFHKRNDLRQALYYIKKFGFEEHLEYKEINHRNYLEHLLGKINFVLQINPRDMEFISYKSFLIDLKKKKDLKMTTVFPLLM

SEQ ID NO: 2436 - protein, 353 aa, Flavobacterium sp.
  source 1..353: note = Related to NZ_QKXH01000002.1; note = Flavobacterium aquariorum
MDFEQYRNNFSKEALKLGYSEQNVVRCLDYAAVLFSNNVPVIYNISHLGQLVGYKKEYLKKASTYGDNFYRNFEITKRNGTKRLISEPLPSLKEIQLWILKNILYKIPVSPVAKAYKPKARIIENLKFHRNQPKVLTLDLENFFPSIKMKATQNVFLNLGYSKYMANILSKLCTKEDSLPQGAPTSPYLSNLIFKSADALIFDFCRQREIRYTRYADDLSFSGDFDEKMLLGKVTDIIESLGFKINNTKTKLMTPNTRQTVTGIVVNQKPQVVAHKRNALRQALYYIKKFGLKEHQEYKEIVQKNYLEHLLGKVNFVLQINPNDNEYKNYKDFLIDLKKKNELGIKNASPSLI

SEQ ID NO: 2437 - protein, 350 aa, Flavobacterium sp.
  source 1..350: note = Related to JAHWYN010000011.1
MDFTQYSFAFSKEALKFGYTEQNIKRCLDYAVVLFSHDVPVIYNTSHLAQLVGYKKEYLKKATLYTNSFYRNFEIVKKNGSKRLISEPLPSLKEIQLWILKNILYKIPVSPVAKAYKPNVRIIENLKFHRNQPKVLTLDLKNFFPSIKINAIKNIFIDLGYSKFVSRLLAKLCTKEDALPQGAPTSPYLSNLIFKKADALIFDFCKQRKIRYTRYADDLCFSGDFNEEELLEKVTDIVEDMNFSINKSKTKLMLPNTRQTVIGIVVNEKPQVVFHKRNALRQAVYYIKKFGLNEHQECKGILQNNYLEHLLGKINFVLQINPKDTEFRNYKDFLIDLKKKNEWSKPVFHH

SEQ ID NO: 2438 - protein, 353 aa, Flavobacterium sp.
  source 1..353: note = Related to JAGGNA010000001.1
MDFAQYKNTFTQEASKNGYSEQNIQRCLDYAELLFSHEVPVIYNTSHLSNLVGYNKKYLKKASYYPQYFYRDFEITKKNGTKRPISEPLPSLKEIQIWILKNILYKIPVSPFAKAYKPNTALIENLKFHKKQPKVLTLDLENFFPSISVKSIEKIFIEMGYSRMVSQLLAKLCTRDKTLPQGAPTSPTLSNLIFKDADVAIADFCKQRKIRYTRYADDLSFSGDFDEKELFEKITETVENLNFHINKSKTKLMTPNTRQVVTGIVVNEKPQVVFHKRNELRQAMHYIKKFGIDEHREYKEINQRNYLEHLLGRINFVLQINPKDLEFIGYKAVLIDLKKKQALKMKKNQPLLM

SEQ ID NO: 2439 - protein, 352 aa, Flavobacterium sp.
  source 1..352: note = Related to NZ_FRCL01000005.1; note = Flavobacterium xinjiangense
MDFTHYKEAFIQEASKNSFSEHNIERCLEYAAVLFSNNVPVIYNTSHLSALVGYKKEYLKKASLYPKYFYRDFEITKKNGSKRAISEPLPSLKEIQIWVLKNILYKIPISPFAKAYKPNSGLIENLKFHKKQPKVFTLDLENFFPSISIKSIEKVFLTAGYSRMVSKLLSKLCTRDGTLPQGAPTSPYLSNLIFKDADAVISSYCIERKIRYTRYADDLSFSGDFDEKELLSKITSIVENLNLHLNTAKTKLMTPNMRQTVTGIVVNDKPQVAFHKRNELRQDMHYIKKFGIDEHREYKEINHSNYLEHLLGKVNFVLQINAKDLEFIGYKAVLIALKKKQQKTQMIQPLLM

SEQ ID NO: 2440 - protein, 351 aa, Flavobacterium sp.
  source 1..351: note = Related to NZ_FOFZ01000005.1; note = Flavobacterium frigoris
MDFSNYKDTFTNEAIKRGYSEQNIKRCLDYAAPLFSNDVPVIYNTSHLSVLVGYKKEYLKKAALHTKYFYRDFEIVKRNGKKRPISEPLPSLKEIQHWILKNILYNIPVSPFAKAYKPNISLIENLKFHRNQPKVFTLDLENFFPSITIDSIEKIFIELGYSKSVSDLLAKLCTRDGTLPQGAPTSPSLSNLIFIEADALIADYCIQRKIRYTRYADDLSFSGDFDEKELFDKVNGIIKKMNFNINTAKTKLMTPGSRQTVTGIVVNEKPQVVFHKRNELRQAMYYIQKFGIDQHREYREINQRNFLEHLLGKINFVLQINPKDTEFIGYKSFLIDLKKKRDLNYDTLKII

SEQ ID NO: 2441 - protein, 353 aa, Flavobacterium sp.
  source 1..353: note = Related to NZ_FNMV01000002.1; note = Flavobacterium degerlachei
MDFSQYEDAFTKEATKMGYSPQRIERCLDYAEMLYSNDVPVIYNSSHLAGLVGYKKEYLKKAALHTKYFYRDFEILKKNGKKRPISEPLPSLKEIQHWILKNILYKRPVSAFAKAYKPNVSLIENLKFHKNQAKVFTLDLENFFPSIGIESVEKVFADVGYTRSISDLLSKLCTRDGSLPQGAPTSPYLSNLIFEEADKVISQYCIQKKIRYTRYADDLSFSGDFDEKELFNIVTEAVEKLKLKINPSKTKLMTPDSRQTVTGIVVNEKPQVVFHKRNALRQAMYYIQKFGIDEHREYKEINQANYLEHLLGKINFVLQINPKDSEFIGYKSFLKDLKKKREASNNRIMPLLM

SEQ ID NO: 2442 - protein, 370 aa, Flavobacterium sp.
  source 1..370: note = Related to NZ_PVUB01000001.1; note = Flavobacterium granuli
MGVSDSKSPHSINDSDAMDFVHYKDSFTKEALKIGYSQQNILSCLDYAQILLTKDVPVIYNSSHLAVLVGYKKEYLKKAAHHTKYFYRDFEITKKNGKKRPISEPLPSLMEIQHWILKEILYKLPVSPFAKAYRPNISIIENLKFHKNQPKVFTLDLENFFPSIKIEAVERIFTELGYSKNISNLLAQLCTRDGRLPQGAPTSPFLSNLIFKDADLMISDYCKEHKIRYTRYADDLSFSGDFDEKKLLHKVTETIEKLDFKINAAKTKLMTPDRRQTVTGIVVNEKPQVVFHKRNTLRQTMYYIKKFGIDEHREFKEIDQTNFLEHLLGQINFVLQINPKDSEFIHYKAFLIDLKKKQDAKNIKRGLLLM

SEQ ID NO: 2443 - protein, 353 aa, Flavobacterium sp.
  source 1..353: note = Related to NZ_JADHEC010000014.1; note = Flavobacterium soyangense
MDFTKYKKDFTDEATKMGLSKRNIQDCLDYAEVLVSHNVSVIYNPSHLSALVGYKKEYLKKAALHTSYFYRNFEITKKNGKKRPISEPLPSLKEIQIWILKNILENIPVSPFAKAYKPKMRLIENLKFHKNQPKVFTLDLENFFPSIKIEAVEKIFLKLGYSKIVSELLAKLCTKDNALPQGAPTSPYLSNLVFRDADAIISEFCKQRKIKYTRYADDLSFSGDFDENELLDKVTETIKTLNLRINESKTKLMTPDMRQTVTGIVVNNKPQVEFNKRNELRQAMYYIKKFGFEEHRVYKEISQANYLEHLLGKINFVLQINPKDYEFSAYKALLIELKKKQNLKIKKELPLLL

SEQ ID NO: 2444 - protein, 353 aa, Flavobacterium sp.
  source 1..353: note = Related to PNNA01000057.1
MDFTKYKVDFTAEASKKGLSKNNVQRCLNYAEALISKGIAVIYNPSHLSALLGYKIEYLKKAALHPSYFYRDFEIAKKNGKKRAISEPLPSLKEIQVWILKDILEKVPVSPFAKAYKPKTSLTENLKFHRNQPKVFTLDLENFFPSIKIDLVEKVFLELGYSKMVANLLAKLCTRDNALPQGAPTSPYLSNLIFKEADAIIADYCKQQKIRYTRYADDLSFSGDFDENKLFEKVTNVVEKLDLRINKSKTRLMTPDKRQSVTGIVVNNKPQVAFKKRNALRQAMYYIKKFGIDEHRVYKEIKQANYLEHLLGKINFILQINPKDTEFMEYKTLLFDLKKKEDLKIRKPLPLLV

SEQ ID NO: 2445 - protein, 345 aa, unidentified
  source 1..345: note = Related to NZ_QNUG01000026.1; note = Epilithonimonas hispanica
MKFEQYKEAFEKKASIFGYSEDNIQLCLIYAELLFKNNVPVIYNTSHLSALVGYNKEYLKNATKHTPSFYRDFQIKKKNGTLRTISEPLPSLKEIHIWILENILANVKLSPFAKAYRKKIRIFENLKFHKNQPIVYTIDLKDFFCSINTDAVEAIFKSLGYSLLISNLLAKLCTKDNSLPQGAPTSPCLSNIFFKETDNLIANYCLEQKIKYTRYADDLSFSGEFNENVLLEFVKNSIEKIGLKINEDKIRLMRTGSRQTVTGIVVNEKPQVVFYKRNKLRQDLFYIKKFGLAGHMSHRKIEKTNYLEHLLGQINFVLQINPDDKEFQGYMTYLIELKKLSEIRD

SEQ ID NO: 2446 - protein, 344 aa, unidentified
  source 1..344: note = Related to JACPUU010000004.1; note = Bacteroidetes bacterium
MNFERYKEAFEKAASNSGYSEENINYCLGYAEVLFRNNVPVIYNTSHLSALVGYKKEYLKKAVVHTPFFYRDFQIKKKNGKLRTISEPLPSLKEIQTWILDSILSNVSVSPFAKAYRKNVGLLENIKFHKNQPLVLTMDLTDFFTSVKTNSVEEIFRSLGYSDLIANLLAKLCTKDNSLPQGAPTSPALSNLFFKPVDERIAAYCKLNHIRYTRYADDLNFSGDFDAEKLKAYVKGAVESVGLMVNDSKTRVMKSGSRQLVTGIVVNEKPQVAFQKRNKLRQDLFYIRKFGLEDHMKRRKIKQANYLSHLLGQVNFIVHINPDDKEFQDYKTYLVGLKQTLGHA

SEQ ID NO: 2447 - protein, 345 aa, unidentified
  source 1..345: note = Related to NZ_FTOB01000002.1; note = Zobellia uliginosa
MTFEQYKIAFEKAASNSGYSELNIKRCLDYAKPLIENNVPIIYNTSHFSSLVGYKKAYIKKAVYYTKSFYTDYAIKKKNGKTRTISEPLPSLKEIQTWILQNIFQQLKVSPYAKAYKRKVSIVENLKFHYNQPKVFTLDLKDFFPSIKIHSVEQIFKSLGYSDLISNLLAKLCTKENCLPQGAPTSPYISNLYFLPADNHISEFCKQHSIRYTRYADDLTFSGNFDENAVLNFVSEQIVKLELVIHPDKIKLMTPNQRQSVTGIVVNQKPQVVFHKRNKVRQELYYIKKFGLANHMERKGIKKRNYLEHLLGKVNFIIQINPTDTEFIEYKEYLIKLKSEISGQT

SEQ ID NO: 2448 - protein, 342 aa, unidentified
  source 1..342: note = Related to NZ_AMGM01000138.1; note = Cecembia lonarensis
MKFEQYKQEFEIKASQSGYSAENITRCLNYAKPLIDKGFPVIYNTSHLSVLVGYRKDYIKRAVVYTPYFYRDFEIKKRNGKMRKISEPLPSLKEIQDWILVNILEVEKVSPFAKAYRKKVGLIENVKFHKNQPKVLTLDLKDFFPSIKRENVESIFRSFGYSALISNLLSKLCTRGGCLPQGAPTSPYLSNIFFKSADDIIIKYCLANDIRYTRYADDLSFSGNFDEKMLIELVDDTVRQLGLTLHPDKIKIMKPNERQTVTGIVVNEKPQVVFHKRNKLRQEMHYIIKFGIQDHMQRKNIKYRNYIEHLLGKINFVLHLNPKDTEFQKYKEHLIELKKQTI

SEQ ID NO: 2449 - protein, 342 aa, unidentified
  source 1..342: note = Candidatus Sulfidibacterium hydrothermale; note = Related to NZ_CP083760.1
MNFEQYKVIFEKEASNSGYSETNIRRCLTYAEILFANKVPVIYNTSHLSVLVGYNKRYLKRAVVYTPYFYRDFQIKKKNGKFRKISEPLPSLKEIQTWILENILSNIPISPFAKAYKKNTSIIENLRFHVNQPKVFTLDLENFFPSIKTDSIESIFLNVGYSKILSNLMAKLCTRDNSLPQGAPTSPYLSNIFFKPVDDIISRYCIDNKIRYTRYADDLSFSGDFDENSLMEFVSNVISELNLTINKNKTRLMTPNMRQTVTGIVVNKKTQVVFHKRNNLRKDIYYIKKYGLHNHMKFRNIKQSNYLEHLLGKVNFVLQLNPNDIEFKRYKNFLIELKNKIE

SEQ ID NO: 2450 - protein, 346 aa, Flavobacterium sp.
  source 1..346: note = Related to NZ_MUHA01000018.1; note = Flavobacterium oncorhynchi
MDFDQYKTEFATLASSVGYTEQNIQKCLKYAKPLLDKKLPVIYNTSNLSNLVGYKKEYLKKAVRYTSSYYRDFEITKNNGGKRKISEPLPSLKEIQIWILDNILSQIEISPYAKAYRQNVTLIENLKFHKNQPKVFTIDLENFFTTIKQDSIQKIFGEMGYSRLISNLLSKLCTRDDSLPQGAPTSPYLSNIFFKSLDIEITKYCNENKIRYTRYADDLSFSGDFDEKILLEFVTEKITKAKLVINPDKVKLMKKNTRQIVTGIVVNEKMQVVFHKRNKIRQDMFYIKKYGLVNHMEHLKIKKNNYLEHLIGKINFILHINPNDKEFIDYKSFLNDLKNKVNKTNA

SEQ ID NO: 2451 - protein, 343 aa, unidentified
  source 1..343: note = Related to nan
MTFTQYKRKFTAEAFKSGYSQQNIDRCLVYAERLFSNKVPVIYNTSHLSGLVGYRKSYLKKAALFTTYFYRDFEILKKNGKKRQISEPLPSLKEIQLWILENILYKVKISKFAKAYIPKVNLKQNLKYHVGKPLILAIDIENFFPSIRQNNVEKIFQELGYSNLISNLLAKLCCRGESLPQGAPTSPYLSNIYLKPLDDDVSEYCLERNIHYTRYADDLTFSGMFNDKELCKYLHIEIEKLNLKINNDKTKVMTPNTRQTVTGIVVNEKPQVCFVKRNGIRQTIYYIKKFGLENHMDRIKIKKQNYLKHLLGQVNFVLFINPSDKEFIEYKNYLRTLIIHPLS

SEQ ID NO: 2452 - protein, 340 aa, Flavobacterium sp.
  source 1..340: note = Related to MQTN01000055.1
MSFEHYQKEFTSKAVNSGYSEQNIFDCLEYAKKLISNNVPVIYNTTNLSALVGYKKSYLKRAAIYTPYFYREFDILKKNGKKRKISEPLPSLKEIQLWILNNILYKVEVSKFAKAYIPKVSIKQNLVFHKKQAKVLTIDLENFFPSIKIDQVIVIFKSLGYSNIISSLIAKLCCLNDCLPQGASTSPYLSNIFLRNSDDIISKYCLGRNIRYTRYADDMTFSGDFDEVELLKFVRTEIKTLNLQVNDEKTKLMLPNSRQVVTGIVVNNKPQVEFNKRNKIRQEMYYIIKFGLENHMNRKNIKKANYVPHLLGKINFILQINPLDNEFIEYKKHLKALTLV

SEQ ID NO: 2453 - protein, 347 aa, unidentified
  source 1..347: note = Related to JADJAG010000004.1; note = Chitinophagaceae bacterium
MNFEQYSLAFSREASQSGYTEQSIIRCLKYAEKLFSNKVPVIYNTSHLSVLVGYRKNYLKKASFYTPYFYRNFEILKKNGSKRIISEPLPSLKEIQIWILNNILYNIEVSRFAKAYIRKSHIKQNLVFHKGQLQVLKLDIENFFTSIKLSSIQDIFMSVWYSQLISNLLAKLCCHRGSLPQGGPTSPYLSNLYLKSVDESIYHYCMQKEIRFTRYADDMTFSGVFEEKGLIKFVTEELRILDLKINEKKTKMMSRSSRQLVTGVVVNEKLQVPFYKRNKLRQDLYYIKKFGLENHMQRRKITKSSYIEHLLGKINFILSINQEDQEFLSYKNYLIELKRKSREIRPE

SEQ ID NO: 2454 - protein, 343 aa, Citrobacter sp.
  source 1..343: note = Related to QFQQ01000035.1; note = Citrobacter freundii
MSFIVYEKLFTAKAVKAGFSQDNIQKCLAYAKPLIDKGLPVIYNTANLCALVGYNKNYLKRAALHTQFFYRKFFIRKRNGKARLIVEPLPSLKEIQLWILHNILYEVKASRYAKAYIKGRNIVDNVRYHREKDIVLRIDIKDFFPSIGFSKIQLLFEQLGYSSNISNLLTKLCCVYETLPQGAPTSPYLSNLVLKNFDKRLAEFCVAKNIRYTRYADDLTFSFAKTIDPNEVRLFVENELSKEGFSANPDKTQILTPNKRQIVTGIVVNKVLQIPKIDRKLIRQEMYYISKFGLRDHMKKTQNTKASYLLHLLGKTNYALQINPEDKEMKKYKAIIWQMLNQE

SEQ ID NO: 2455 - protein, 349 aa, unidentified
  source 1..349: note = Related to NZ_UGYW01000002.1; note = Sphingobacterium spiritivorum
MDFLEYKVKFVKKALEAGYSEVEIDQYLTYAKVLLDKKLPLIYNTSHLAALTGYSTRYITRAALYPKSFYRTFKIKKKNGKMREINEPLPSLKEIQLWINKNILLNIKPNKFAKAYIKKTNILDNVKYHKRKKYVFNLDLVNFFPSISTKTVEMFFKKLGYSDNLSNLLAKLCCFGDGLAQGAPTSPALSNHILYEFDDLLGSFAVENNLRYTRYADDLTFSFNDEFDVSIIEEKVINTLDKTVLYSKLTVNREKTKLLRQNDRQIVTGVVVNDKTQVPSSYRKQIRQEIYYIRKFGLSNHLNRLNEVRYNYLYHLLGKINFVLLVNSEDKEMKEYRNAIKMLISNRPT

SEQ ID NO: 2456 - protein, 362 aa, unidentified
  source 1..362: note = Related to NZ_JAFEWD010000003.1; note = Pedobacter sp.
MFKGPARKLAGLNEINMTAAQYESAFRKKALVAGYSEENIQKCLSYAIPLLSKGFPIIYNTTNFAGLVGYNKLYLKKAALFTASYYRTFKVKKKKKKDYREIKEPLPSLKEIQLWILYNILYQERPSKYAKAYIQKRNLRENVKFHVGKNKVLNLDFKHFFPSIKQDAIEKIFLSFGYSSNISNLLSKLCCLDGSLPQGAPTSPYLSNLYLKTFDEDVFGFCKNKHIRYTRYADDMTFSGDFNELEVINFIKEKIEDSPLEINDEKTRVMRRNQRQVVTGILVNDKTQVSKKYRNNIRLEMYYISKYGIAEHLAKSKNSRANYLSHLLGKIEYTLHFNPDDVEFLEYRSKLKQLLPKKQDAE

SEQ ID NO: 2457 - protein, 344 aa, unidentified
  source 1..344: note = Related to JACHBZ010000008.1; note = Mucilaginibacter sp.
MNFQQYSEAFRKKALAATFSEDEIIYCLDYAKPIIEKGLPVVYNTTHLAALVGYRKVYLKKAVLYTSYFYRRFVISKRNGKPRTISEPLPSLKEIQIWILKNILENLPVSKFAKAYLAKKDVRDNVRYHIGKPIVLKLDIKDFFGSITQQSVQQIFLDANYSSNIANLFSKLCTLRGTLPQGASTSPYLSNLFMNKFDEVVGGYAIKEKTRYTRYADDLTFSGNFNPDNVIEFVQTEIEKIGLRLNLSKTAVMRQNSRQFVTGIVVNEKMQVPKKDRQNLRLEMHFIQKFGLENHLRRVKNKKANYLPHIIGRINYFITINPDDEEFVSYKKYLIETYVNENLT

SEQ ID NO: 2458 - protein, 355 aa, unidentified
  source 1..355: note = Related to BMHZ01000001.1; note = Pedobacter zeae
MGPEISFWPHKKMNFSQYEKTFRIKATKIGFSEEEITACLNYAEPLISNKLPVIYSTANLAALVGYKTNYLKRAVKFTKYFYRDFQIKKKDGKLRTLYEPLPSLKEIQSWVLKNILSEVKPNRFAKAYIKNKSLIENVKYHKGREGVLTLDILDFFGSIKTAHVAGIFSEMGYSANIASLLAKLCTYDGYLPQGAPTSPYLSNLYLKNFDDIVSKYCSENNIKYTRYADDMTFSGKEEDLNITSFIEVQLFNIGLYLNSDKSKLMKRNEKQVVTGIVVNDKLQVPREDRDFIRNEVHFLTKFGLNDHLNRTLNKKANYIEHLLGKINFALHINPDDLKMKRYKAKVIEYAKSIEE

SEQ ID NO: 2459 - protein, 343 aa, unidentified
  source 1..343: note = Related to NZ_FOAF01000001.1; note = Olivibacter domesticus
MNFAQYEKKFRLKALKSGFSEDNIVACLNYAKPILEKGLPVIYNTANLAALVGYRTTYLKRAAKFTKFYYRSFTIKKSNGKLRTLMEPLPSLKEIQTWILENMLSEIPVSKFAKAYVKHRSLKENVKHHNNKEGVLTCDIATFYDSVRFKDIEKIFNELGYSEVMSNLLAKLTTFNGSLPQGAPTSPYLSNLVLREFDQKISDYCINNNIRYTRYADDLTFSGEVKSLKLKNLVEAELNKLGLELNPDKTKLRKFSQRQMVTGIVVNEKTQIPKFERNFIRNEVHFLTRFGLKDHLRKTKNKRENYLLHLLGKINFALHINPADKKMESYRSQVQKIIQTDAG

SEQ ID NO: 2460 - protein, 346 aa, unidentified
  source 1..346: note = Related to QGTG01000019.1; note = Chitinophaga sp.
MTFPQYEKKFRVKAIKSGFSEYEISACLLYAKPLIESNLPVIFNTANFGALVGYKTNYLKRAVKYTPYFYRAFTIRKKNGGSRELVEPLPSLKEIQTWILENILREVKVSKYAKAYVKSRTLLENVRYHKGREAVLTLDIENFFGSITLLHIEHIFLGLGYSSNISNLLAKLCTYEGVLAQGAPTSPYLSNLYLRRFDEIISKFCNQNDIRYTRYADDLTFSGQKDALDIVEFIRKTLQKFSLKLNKDKEKLMVRNQRQVVTGIVVNEKLQIPKAARNFIRNEIFFIKKFGLDSHLEKTDNKKSHYLEHLIGKINFALHINPNDLKMQSYKSIVLKIYQSRDEDKI

SEQ ID NO: 2461 - protein, 339 aa, unidentified
  source 1..339: note = Related to NZ_CP094326.1; note = Zhouia spongiae
MTNQQLYAKKFTEKAIENGFSSDYIEKCLSYASPLLENNLPVVYNINHLSGLVGYNVSYLKRAVKFPKYFYREFEIEKSNGKKRKLHEPLPSLKEIQLWILDEILYKLKVSRYAKAYVPKRSIKEHTIYHTDEPFVLTLDIKNFFNSIQFDSVESLFKKIGYSEKMANLFTKLCFRDDELPQGAPTSPYISNLILKDFDFAVSKYCMEHNIKYTRYADDLAFSGDLNAEEIEKLIKDELSKIGMELNDEKRKLMKPNQPQLISGIIVNKKAQLPKKIRNSLRNEMYYIKKFGLPSHLERTNQKKPNYLKHLMGRINYILQINPRDKEFIEYRKHLHELK

SEQ ID NO: 2462 - protein, 339 aa, unidentified
  source 1..339: note = Related to NZ_VTZS01000003.1; note = Pareuzebyella sediminis
MNNQQLYVRKFTEKASENGFSSDYIKKCLSYANPLLEKNLPVVYNINHLSGLVGYSVSYLKRAVKFQKYFYREFQIEKRNEQKRTLYEPLPSLKEIQLWILDEILYKLKVSRYAKAYVPKRSIKEHTMYHTDEPFVLTLDIKEFFKSIKFESVESLFRNIGYSEKMSNLFTKLCFRENELPQGAPTSPCISNLILKDFDNAISGYCIKNEVKFTRYADDLAFSGNLNAEEIEKLVKDELSKIGLVLNDEKRRLMKPNQPQLISGIIVNKKPQLPKKVRNSLRNEIYYIKKFGLTDHLERTNQKKPNYLKHLMGRINYVLQINPRDEEFIEYKKYLHELR

SEQ ID NO: 2463 - protein, 342 aa, unidentified
  source 1..342: note = Related to NZ_AFPB01000170.1; note = Aquimarina agarivorans
MNNQQLYLEKFTQKALEHGFSSEYINKCLSYANPLLENNLPVIYSINHLSGLVGYSVSYLKRAVKFQKYFYREFEIKKRNGKNRTLYEPLPSLKEIQLWILDEILYKLKVSRYAKAYVPKRSIKEHTIYHTNEPLVLTLDIKEFFNSIKFESVEYLFFSIGYSRKMSNLFAKLCFRENELPQGAPTSPYISNLILKDFDTEVSKYCMKNKIKFTRYADDLAFSGNLNAEEIKKLVKKELSKIGLELNEEKTKLMKPNQPQIISGIVVNKKAQLPKKIRNSLRNEMYYIKNYGLASHIERTNQKKSNYLKHLMGKVNYVLQINPRDVEFKKYKEYLQEQYKSS

SEQ ID NO: 2464 - protein, 339 aa, unidentified
  source 1..339: note = Related to NZ_AFXZ01000051.1; note = Bizionia argentinensis
MNDQQIYTKKFTEKALENGFSSDYIKKCLNYAKPILANNLPVIYNIDHFSNLVGYNVSYLKRAVKFQKFFYRKFEIDKRNGKKRILNEPLPSLKEIQLWILNEILYKNKVSRYAKAYVPNRSIKEHTIYHTDEKFVLTLDIKEFFKNIKFEFVESLFKSMGYSRKVSNLLTKLCYLEKELPQGASTSPYISNLILKDFDNVISNYCISNKIKYTRYADDLAFSGNLNTDEIGILVNKELSKIGLELNDEKTKLMKPNQPQLISGIIVNKKAQLPKKIRNSLRNDMFFIKKFGLVNHMERTNQTKSNYLKHLIGRINYVLQINPRDKEFIEYRKYLYDLK

SEQ ID NO: 2465 - protein, 344 aa, unidentified
  source 1..344: note = Related to NZTP01000067.1; note = Proposed Altibacter sp.
MEKAFDKYKKQFVTKARKNGFSEDNINKCLDYSKPLITKDLPVIYNTTHLSQLVGYNLIYLRRAARFTKYFYRSFKVLKNDKTYRTISEPLPSLKEIQIWILKEILYKNKVSKYAKGYVPKRSIKDHVRYHTKESKVLTLDIKNFFDSIKIDYTLKMFIQMGYSKSVSNLLTQLCYLEKGLPQGAPTSPYITNVLLYEFDESIAKYCRQKELKYTRYADDLAFSGQIKKTELIKLVRSELRKIGLKLNNDKIILMKRNQRQTISGIVVNDKTQVPKYKRNSIRNEMFYIKKFGLNNHQKRTNQTRDNYLKHLIGKINYILMLNPKDKEFLDYKKYLYEQNKASR

SEQ ID NO: 2466 - protein, 349 aa, unidentified
  source 1..349: note = Related to JABXHT010000059.1; note = Tenacibaculum sp.
MNITFNKYKKLFTEKAINSGYSEDNIVKCLSYAEPIINKGFPVIYNTSHLSSLVGYNKNYLKRAVNHTKYFYRKFEISKKDGTKRVLLEPLPSLKEIQNWILNEILYKHKVSRYAKGYIPNRSIKDHVRYHTKEEKVLTLDIKKFFDNVSFELVEKIFIHIGYSKIISNLLTKLCFLDGKLPQGAPTSPYISNIILFEFDEKISKYCSNNNLKFTRYADDLAFSGKIKKTELVKLVRSELKALGLKLNNEKIKLMKRNQPQIISGIIVNEKAQVPKRTRNQIRNEMFYIKRFGIDSHMQKTNQTKSKLAYLKHLIGKINYLLTINPKDNEFIEYKNILHKEIKPAGNNV

SEQ ID NO: 2467 - protein, 352 aa, unidentified
  source 1..352: note = Crocinitomicaceae bacterium; note = Related to PAVO01000044.1
MDYNKYKTQFSAKAKNAGYSEDNISRCLAYAKPILEEGYPVIFNTTHLSSLVGYNKNYLKRAVAYQKYFYREFSITKKNGELRTLREPLPSLKEIQSWILNNILYKHEVSRYAKGYIPKRSIKDHAKYHTNELKVLTLDIKSFFDSISFGQVEAIFSNIGYSNIVSNLLAKLCFLEKNLPQGAPTSPCISNILLLEFDNVISAYCSEKKIKYTRYADDLAFSGDVKKTALIKLVRSELKKLGLRLNNQKIKLMKQSQPQIISGIIVNKKVQVPKKNRNKIRNEMFYIKKFGFQSHMEKTKQTKSNYLKHLIGRINYLLTLNPKDTEFLEYKKILYQLESTADNSTQMSNRPS

SEQ ID NO: 2468 - protein, 360 aa, unidentified
  source 1..360: note = Related to NZ_JADPVI010000001.1; note = Kaistella gelatinilytica
MKDFTKYKKKFREKAEDIGFSEDNIVKCLNYSEKLSNNNLPIIYDSSHLAGLVGYHRSYLTRALISTEFFYRTFKIPKKNGKIRIISEPLPSLKEIQYFILNEILYKQKVSKYCKSYIPKRKFREYLRFHTDEKQVLTLDIKDFFPSIKFNHIHEYFLNLGFAKDVSLYLACLSTYTHKENDFIEFKRFLPQGAPTSPYLSNLILTPFDDKVAEFCFDKKIKFTRYADDMAFSGEYIDQEELLIFIKNELNVYGLELNEEKINFMKQNVPQIISGVIVNKKLQLPKAQRNEIRKVMYFINEFGIDNHLEKTNETREYYLSHLLGRIQYALNLNPDDSAMKEYKNQIIEIKNEQNLKFLIE

SEQ ID NO: 2469 - protein, 358 aa, unidentified
  source 1..358: note = Related to NZ_JAELVM010000001.1; note = Chryseobacterium endalhagicum
MKDFESYKKIFREKALNSAYSEENIIKCLKYSENLVNNNLPIIYNSYHLSGLVGYQHDYLSRAILSTEFFYRHFKIEKKNGKSRKISEPLPSLKEIQYFILKEILYKQKVSKFCKSYIPKKKFKEYLRFHSNEKEVLTLDIKDFFPSIKFNLIHNYFSKIGYSKDVALYLSCLCTYTDVNVEKKNNTSIRYLPQGAPTSPYLSNLVLIDFDNDVANYCSEKKLKYTRYADDMAFSGDLIVKNELVEFVNAQLKKYNLELNDEKINYMKQNVPQIISGVVVNKKLQLPRKERNDIRKVMYFIIKYGIESHIEKTQETREYYISYLLGRIQYALNLNPNDAELKKYKDFLVELKKNILIL

SEQ ID NO: 2470 - protein, 359 aa, Flavobacterium sp.
  source 1..359: note = Related to CP013992.1; note = Flavobacterium covae
MDLELYKRHFREKALNSGFSEETIIKCLKYSEVLASKNLPVIYNSYHLAGLVGYKHSYLSRAIISTDFFYRKFKIQKKNGKYREISEPLPSLKEIQYFILKEILYKQKVSKYCKSYIPKKKFREYLKYHSNEKQVLTLDIKDFFPSIKYEFIYTYFMNLGYARDVSYFLATLCSYVPKAPKGEKTDLSKRFLPQGAPTSPYLSNLILSNFDDLVAKYCNENKLKYTRYADDMTFSGDIIQEDELISFVQSELNKIGLKLNIDKINFMKQNVPQIVSGVIINKKVQLTKEDRNKIRNVMYYISKFGLEDHLNRTNEKRDYFVFHLLGKIQYGLSLNPNDHELKRYKEILIEEKKKYYSKS

SEQ ID NO: 2471 - protein, 358 aa, unidentified
  source 1..358: note = Related to NZ_FWXS01000003.1; note = Moheibacter sediminis
MVDFELYKKHFREKALNIGFSEEIIIKCLNYSENLVSKKLPIIYNSYHLAGLVGYQHSYLSRAINSTEFFYRKFKIQKKNGNFREISEPLPSLKEIQYFILEEILYKQKVSRYCKSYTPKRKFREYLKYHTNEKQILTLDIEDFFPSIKFNNIFNYFLALGYAKDVSYYLSNLCTYVTKGKKGQRVNISNRYLPQGAPTSPYLSNLILSEFDDSVAKFCIQNQLKYTRYADDMTFSGGNINKEDLITFIIVELNKIGLRLNIEKTNFMKQNVPQIISGVIVNKKVQLPKAERNKIRNSMYYISKFGLEDHLKRTNEERNYYVFHLIGKIQYGLSLNPEDLELKRYKEILIEEKKKYYS

SEQ ID NO: 2472 - protein, 358 aa, unidentified
  source 1..358: note = Related to CP040516.1; note = Elizabethkingia miricola
MKDFELYKKQFREKALNNSFSEDIIQKCLNYSENLFSKNLPIIYNSYHLAGLVGYEHSYLTRAIISTDFFYRKFNIVKKNGLLREISEPLPSLKEIQYFILKEILYKQKVSRFCKSYIPKRKFREYLKYHSNEKQVLTLDIENFFPSIKYKHINNYFTELGYAEDVSSFLASLCTYSISKKKKEKVELNERFLPQGAPTSPYLSNLILMKFDDTIANYCKEKSIKYTRYADDMAFSGSDFDKEILIKLVQSELNKVDLKLNKSKINFMKQNVPQVISGVLVNKKIQLPKEIRNEIRNTMYFITKYGYEDHIKRTNETRDYYLLHLLGRIQYALNLNPNDSELIKYKSVLLEYKKKYYN

SEQ ID NO: 2473 - protein, 353 aa, unidentified
  source 1..353: note = Related to NZ_CP075682.1; note = Chryseobacterium sp.
MEKTNSYKKKFTELAISSGYSEEYIEKCLKYSEPLLNKNLPVIYSINHLSALVGYSQSYLTRSMISTSFFYRHFKIKKRNGNLRSISEPLPSLKEIQNFILKEILYTQKVSKYCKSYIPKKSIIEYLKYHVNEKEILTLDLQDFFPSIKFELIKNFFLQLGYSDEVSYYLSTLTTYCDKQEKFDDSQRYLPQGASTSPYLSNLILKDFDNNIGKFCNNKIKYTRYADDLAFSGDKIPSEDIIDFVNKELEKLGLKLNPKKVNFMKQNIPQIISGVVVNNKMQLPKQQRNEIRQKMYFINRFGIESHLERIQEKRENYIPHLLGRIQYGLNLNPDDLELKKYKKDLQEIYNKVK

SEQ ID NO: 2474 - protein, 343 aa, unidentified
  source 1..343: note = Related to CACSGR010000184.1; note = Tenacibaculum maritimum
MKTFEIYKQEFTKKALDAGYSADELNKCLIYAEPLYNRRLPIIYNLSHFSAYVGYNAKYIRRAIKTDSTKFFYREYSILKKNGSLRVINEPLPSLKEIQKWILDNALNNMAISAYAKAYTFNRSIKDHVKYHKNQKSLLTLDIENFFNNITADKVEKLFINKGYSLLVSNLMSKICTLKNCLPQGAPTSPRISNILMLPFDDKISKYCKTKGNIKYTRYADDLAFSGEINKEEIVELVTNELKELGLTLNIDKTIEKKQSQQQIISGIVVNKKIQVPRKKRDELRQSMYYIEKFGLENHLVKIKCSKSNYLKHLLGIANYIIFINPKDEKTIEIRTKLFKMIE

SEQ ID NO: 2475 - protein, 349 aa, unidentified
  source 1..349: note = Related to NZ_CP058984.1; note = Polaribacter sp.
MNTFNIYKKEFTKKALESGYSADELNKCLVYAEPLFNKRLPIIYNLSHFAAHVGYSTKFIRRAIKTNGTEFFYRKYSIPKKNGSSRVINEPLPSLKEIQKWVLDNILNNMPISAYAKAYTFNRSIKDHVKYHENQNVVLTMDIENFFNNITSDKVERLFIDKGYSPLVSNLLSRICTLNNSLPQGAPTSPRISNILMLPFDNEIAKYCKPKFIGGKKVQVKYTRYADDIAFSGEINKAEFVELVSNELQKLDLSLNEDKTIEKKRNQQQIISGIIVNQKIQVPRKKRDELKQAMYYIEKFGLENHLARIKCTKANYVSHLLGIANYIVFINPKDKKTLEIRTKLFEMKD

SEQ ID NO: 2476 - protein, 344 aa, unidentified
  source 1..344: note = Related to NZ_JPJI01000026.1; note = Nonlabens ulvanivorans
MKNFESYKSEFTKRAYNEGFSSDEISKCLNYSETLLKKNLPIIFNSSHLSALVGYNKDYLNRVSKVNKTSYFYRDYYIPKKNGEKRLIREPLPSLKQIQRWLLDNLFIKLPISPYAKAYRAKKGIRDHVRYHKKEEVVITMDIEKFFDNLESGLIVNILLSKGYSFQVANLITKICTLNDVLPQGAPTSPAISNILLYEFDNEISKYTNSKGLKYTRYADDLAFSGSIQDVDTLIKIVKENLAKINLKINHSKTRVMSKKARQIISGIVVNDKIQVPRKDRDDLRQAMYYIEKFSLEEHLKKIDCNKANYIEHLLGKANYMLKINPKDEKIKVIYNKLKVMKTG

SEQ ID NO: 2477 - protein, 351 aa, unidentified
  source 1..351: note = Related to JAGGDU010000099.1; note = Trichodesmium erythraeum
MRFSSYEKEFRRIAEKRNYPSSVIENCLKYAKVLLDNGVPVIYNTTHLSNLIGYTKSYIKRATHHTPYFYRKYSILKKNGSKRFLSEPLPSLKEIQIFILTNILSSIKVSRYAKAYVSGRTLIDHLKFHKGQKCVLTLDIENFFSSISTESIEKIFLEIGYTDIVSNLLARLCTLENSLPQGAPTSPYLSNLYLKGFDQELAKIVRPMGINYTRYADDMAFSGDTIDKEAIIEHVSRMLSGLGLVLNPDKTLLMVKPSRQVISGIVVNEKIQVPRKIRRSIRQSVYYIRKFGFESHKQKTKIYKRNYDKHLLGLINYILFINPKDQEFQSYKEELEKIIKDADNNGYTQAG

SEQ ID NO: 2478 - protein, 342 aa, unidentified
  source 1..342: note = Related to JH719942.1; note = Saprospira grandis
MTFSSYEKRFTDLAKKRNYSSEVITKCLSYAEPLIRKKVPVIYNIAHFSSHVGYTVKYIKRAIKHTDYFYRHYEISKKNGGKRKISEPLPSLQEIQNFILTKILYKQKVSRYSKAYVPGRSILMHAKYHVNNHTVLTIDLKDFFSSIRTHHIEAIFKEIGYSQIVSNMLAKICTLNGGLPQGASTSPALSNIFFSKIDELIAKEVRPEINYTRYADDLAFSGETIDKEVLVAKVQSILEPYELKINASKTKLMTQHQQQIITGIVVNKKLQLPSKDRRKIRQELYYIKKYNMASHMSKKNIHNKKYAARLLGKINFALLLNPKDKEFIEYKKVMHEIIQHTI

SEQ ID NO: 2479 - protein, 338 aa, unidentified
  source 1..338: note = Related to NZ_RBCJ01000001.1; note = Ulvibacterium marinum
MEFEIYKKKFEAKALKTGLTDLEITDCLNYALPLIEKGLPVIYNTSHLSKLVGLRKTYVKRAAIYTKSYYRNFTIAKRSGMPREISEPLPNLKIIHKFILEEILENIKVSAFAKAYKKKSNILENTRYHINQNKVVTLDIENFFPSITTDKVENIFRGLGYSDLISNLLSKLCTLNNSLPQGAPTSPYLSNLFMKGFDSKLADFCLSKKIRYTRYADDITLSGDFNEKEAIDYISVLLKELDLDLNCKTKIMKRGQQQIVTGIVVNEKSQVPRKERLKLRQEIYHIKTKDLDSHKKFKQITQRNYLYHLYGKISYVVFVNPKDEEFIEYKKFLKTLMN

SEQ ID NO: 2480 - protein, 339 aa, unidentified
  source 1..339: note = Related to JAGIPR010000013.1; note = Chryseobacterium jejuense
MEYNIYKEKFTKKAIKEGLTETEVNECLIYAKPLIENGLPIIFNTSHFSKLVGVRKTYIKRAAIYSRSYYRSFTIAKRNGNPREISEPLPNLKLIQNYILSEILYNVKISAFAKAYKKKTTIIENTRYHVNQKKLVTLDIRNFFSSIKKEQVYIIFNKLGYSEIISDLFSKLCTLNDQLPQGAPTSPFLSNIFMSDFDMFVADYCTSKNIRYTRYADDISLSGDFDEKEIIELIIERLKEKGLELNNEKTKIMLRNQRQIVTGIVVNEKNQVPRKERLKLRQEVFHIRTKTLEVHKEIKNIKNRNYLYHLYGKISYVVFINPNDKEFIEYKEYIRTLFK

SEQ ID NO: 2481 - protein, 343 aa, unidentified
  source 1..343: note = Related to NZ_FSRQ01000001.1; note = Chryseobacterium scophthalmum
MDFTTYQKRFTEKATRQKMSDSDIADCLEYANVLFKNNVVTVYNTSHLSKLVGIRKAYIKRASIYTKSYYRSFEIAKRNGNPRTISEPLPNLKVIQDFILEEILNKVTVSAFAKAYKKNSSIKENVRYHVDQKIVLSLDIQDFFSSVSIEMVEKVFLDLGYSELLSDLFSKLCTLNKCLPQGASTSPYISNIILKGFDKKIADYCLDQNIRYTRYADDITLSGDFDTGTAITLIEDELLKLNLSINRNKTKVMTRNMRQVVTGIVVNEKIQVSGKERNKLRQNIFYLKKFGLLDYIEHEKIKFNNYLYHLYGKLSYIVYINPKDQEFIDYKIYVKDLIKKHYY

SEQ ID NO: 2482 - protein, 345 aa, unidentified
  source 1..345: note = Related to NZ_QBKT01000004.1; note = Kordia periserrulae
MSFEIYTRKFREKAENLGYSESNIVKCIDYASPIYEKGLPIIYNLTHLSRLVGYEKNYIIQAAIASKHSEAYYRYHKVLKKNGDVRKIKEPLPNLKAIQYWLLHNILEKIEPSAYAKAYVKKRGLKQNIRFHKGQKKVLSIDIKDFFPSITFEKVENIFLTIGYSVELSNYLAKLCCLKEKLPQGAPTSPYISNLIFKNIDEIIAVYCKNLNIRYTRYADDLTFSGDFDETSLLNYINEIMTENNFILNKDKTKLMLYSERQIVTGIVVNDKPQLDKETRKEIRQHLYYIKKYGLESHMERNNINSNTFLTNLMGKISFGLYLNPKDEHLRDSINYLSQLYKQIM

SEQ ID NO: 2483 - protein, 345 aa, unidentified
  source 1..345: note = Related to NZ_SNZW01000015.1; note = Maribacter caenipelagi
MSFEVYAKKFRVNAENLGYSEENVVKCINYARPIYENGLPIIYNLTHLSKLVGFEKNYIIQAAVVSKHSEAYYRYHKVLKKNGDFRKIKEPLPNLKAIQHWILANILEEIEPSVYAKAYVKKRGLKQNIRFHKAQKKVFTIDIKNFFPSININQIEKIFIETGYSIELSNYLAKLCCLKNTLPQGAPTSPYISNLILKDIDNSIAIFCKELKVRYTRYADDLTFSGDFEEESLYEFVNALLEKNGFELNKEKTRLMLSSQRQIVTGIIVNSKPQLDKETRKLIRQEIYYIKKFGLESHMERAKLSGSLYLNQLMGKISFGLYLNPSDMKLRSYIKYLAGLYKELY

SEQ ID NO: 2484 - protein, 347 aa, unidentified
  source 1..347: note = Related to NZ_VFPD01000001.1; note = Chryseobacterium aquifrigidense
MDYKTYSERFKIEAYNVGYSESSVALCLNYAKILFDKNLPVIYNVTHLSNLTGIKKNYIIQAATVSKHSHAYYRDFSIAKKKKGERRFISEPLPNLKQIQYWILNNILYQVKVSPYAKAYIKNFGLKQNLRFHKNKKKVLNLDIENFFSAIKFEKVEKVFLNLGYSNTVSKTLSKLCTLKEQLPQGSPTSPYLSNIIMMSFDTEVSLFAKNLNISYTRYADDLTFSGDFDENVVEDFIETKLLEIGFTLNRNKKKLMYDSQRQIVTGVVVNKKIQLSKEQRKKLRQIHYYIKRFGIESHLERQKLSKKKYLSKILGQINFGLYLNKQDKNLLEMKACILKYKKEFDL

SEQ ID NO: 2485 - protein, 518 aa, unidentified
  source 1..518: note = Related to JABZUV010000100.1; note = Prevotella pallens
MDFKEYKQLFSEKAKNKGRDLNYIDSCLAYAERLYDKQVPVIYDITHLSLLVGVKEDYIRRSITYTKKYYWSFDIPKSNNKKRTINEPLPLLKEIQLWILHNILEKQATHPCAKAYVPHKKLKENAKYHTRQKIVISFDVQNFFPSINLEGVSKIFNIIGYSKKNSYLLAKLCCLDDKLPQGAPTSPYLSNLYMFSFDENLICYCRKNGMIYTRYADDITISSQKDVDINALTKLVEEELSKKGLSLNISKSKVMHKSDSQVVTGIVVNERMRLPKKKRQKLRQEMYYLITRGLEDHINFIKCKKRNYLKHLAGKVMYALHLEPSNTEFKDYYIFLQRLINPDFKRKKKRLILDSNVILNEVLIEKLPEDYTTYIANNNSIKKIKNLDLCYGPNLCHANSLLFAIMLKEQYPTIEVNISEGIVVRTNGFAYTHFWVHILHNNEQEFCDVTRDCFEKKILQAKERRYYKVKNHTIDEMTQRMASNNVFLDSKEYLSLYYKKYPKYFELYNTLNIMLHQQ

SEQ ID NO: 2486 - protein, 468 aa, unidentified
  source 1..468: note = Related to NZ_HE999448.1; note = Prevotella sp.
MDFKEYKRLFTEKAQNNGRDSDYINLCLSYAEKLYNQQVPVIYDIKHLSLLVGVKEDYIRRAITYTNKYYWNFHIPKLNGGKRTINEPLPLLKDIQLWILHHILEKQETHPCAKAYVPQRKLKENAKYHTRQKLVISFDVHNFFPSIDLEAISKIFINIGYSKKNSFLLAKLCCLNNELPQGAPTSPYLSNLYMFSFDDNIMRYCREKGIIYTRYADDITFSSKSDINIKTLTEFIKHELRNKKLSLNPAKSKVMYKSDAQIVTGIVVNERMRLPKKKRQELRQEMYYVITRGLENHINFIKCNKKNYLKHLAGKIMYALYLEPSNTEFQDYHTFLQRLMNPNYKRKKKKLALDSNIILNEVLIEQLSENYITCIENDNSIQRVGSLELHYGLNLCHANSLLFAIMLKEQYPTVKVNISEGIVVLTNGFAYTHFWIHVVQNNKEEFCDVTRDCFEKKYYKQKNVDIIR

SEQ ID NO: 2487 - protein, 345 aa, unidentified
  source 1..345: note = Related to JADYUK010000009.1; note = Prevotella loescheii
MEFDKYSFQFAQLAILNGYTTEYVDSCLKYAKKLADNNLPIIYDSEHFSELVGFKLSYIKTVVEYPKSFYWMYKIKKHSGGIRKINAPLPNLKQIQYWILENILNTQKVSPYAKAFVQGKKLKENVRFHRNRKIVIKFDVHDFFGSIRENSIKAIFRSLGYINPVADLLAMLCCLDHVLPQGAPTSPYLSNLYMLDFDTHIAQYCKEHTIYYTRYADDLTFSSDSNIDEYELTSLVKKELNIIGLYLNNDKTKVMPRNTRQVVTGIVVNQKLQVDKDKRRKIRQEVFYIKKWGLESHLQKIGCSKKNYLKHLLGEMTFMLSLTPQNLQLKADIEYIRKLWEENLM

SEQ ID NO: 2488 - protein, 354 aa, unidentified
  source 1..354: note = Related to JACOOE010000015.1; note = Bacteroides sp.
MTFDEYRIKFSTKAYQYGYSEVYVSKCLNYAARLFDKNLPVIYDFEHFCRLVGYSSSYIKRAVNSPRSFYYDYNVPKKNGNGVRLISQPFPSLKEIQYWILNNILYKLEVSPYAKAYVPHRKFKDNLRFHKNKKFVITYDVANFFPSIKKEKIEAYFIELGYTELLSNLFSKLVTHRGYLPQGAPTSPYLSNLYMKQFDNKIAAYCKCRKIFYTRYADDLTFSSNEDVDINDLFNTIKIELSILNLELNQDKTHIMNSSSRQIVTGVVVNKRLQVPKEFRSEIRKECYYINKFGLSEHLARIKQTNEKYYIKGLLGRINYVLQIDPTNKEFKSYKKEMQRFVIRDINLDDYDVL

SEQ ID NO: 2489 - protein, 342 aa, unidentified
  source 1..342: note = Related to SEFL01000207.1; note = Sphingobacteriales bacterium
MNYNDYKREFTEKALRSGFSYEVLQACLQYAEKLFSNDLPVIFNLTHFASLVGYKQTYIQRAIVFTHHFYRKFEISKANGSQRKISEPLPSLKEIQGWILKHILYKLKVSRFAKAYSPGISIKQNLQYHRDQPLVLSIDVKDFFTSLTRDKVEQVFKMAGYSSSLSNLFSKICTLDGRLPQGASTSPYLSNLILYKFDEEIGSFCKQQSIRYTRYADDITISGNFDPDLLRQKVQIELDKLSLVVNEKKVKVMKAGVRQVVTGVVVNKKIQVPRNKRKEIRQAIYYITKFGLQGHLSRESVNRRNYINHLLGQVSFVLFLNPLDKEFIGYKDFLVMQKQQDS

SEQ ID NO: 2490 - protein, 341 aa, unidentified
  source 1..341: note = Related to JACHWX010000002.1; note = Mucilaginibacter gotjawali
MELELYKRRFTEKALATGYSAEKIERCLKYAEKLLSYDLPVIYNLEHLCALVGYHSSYLLRAVDHPNFFYRSFKIKKNNNQFRDIDEPLPSLKEIQDWILTNILYQIAPSKYAKAYVPGTSLKQNILFHRDQPIVLTMDIKDFFPSVKRSQITALFFRLGYSIAISDLLAKLCCLNDCLPQGASTSPYLSNLILASFDDAIAVYCIPLGIRYTRYADDLTFSGKFDCEVLKLQVIKHLSIHGLKINEQKTRIMRFGERQIVTGVVVNKKMQVSKEKRMAIRQQMHFIKRFGLEEHMKARKLSKGNYVRHLLGKINFILYINPDDLEFIKYRDDLLKLGIEK

SEQ ID NO: 2491 - protein, 341 aa, unidentified
  source 1..341: note = Related to NZ_WQOA01000003.1; note = Oscillibacter sp.
MRWDSYERKFRDLAGKSGAAQEKIESWLLYAKELTSNNLPIIFDQTHLALLLGIDNEYLHRMSNAPEYFYRTFYIRKRNGKQRRIDEPLPDLKKVQSWILTEILYKVPCSKFAKAYVPHTSIKDNSRFHRNQKIVAGVDLKNFFPSIKSGSVLSVFLSMGYNLPTAVFLTRLCCLRESLPQGAPTSAYLSNLIMRHFDEQISAYCMERKIRYTRYADDLTFSGDFDVAALLYRIDGELKYLHLRRNPQKLKVMRGGDRQKTTGIVVNEKQQLPREYRMKIRQEIHYIQKFGLDDHLAHIGETRTHYLQHLMGKIEYALFINPKDEKMKAYREVLRAYRPRE

SEQ ID NO: 2492 - protein, 341 aa, unidentified
  source 1..341: note = Related to JAFQBT010000084.1; note = Oscillospiraceae bacterium
MRWDLYEPRFRDLAERQGILDKNINEYLAYAENLYKKNLPVIFDHTHLSLLIGIDNEYLHRISNAPKYFYRTFHIKKRNGKLRRIDEPLPDLKKVQTWILKEILYKIPCSKFAKAYVPKTSIKDNTRFHKKQKIVLTLDIKDFFPSIKSGYVLNLFLSCGYNLPVAVFLTRLCCLNESLPQGAPTSAYLSNLVLKKFDYNISEYCKKNNIRYTRYADDLTFSGDFNIASVLFLVDTELKYLNLKRNNKKVKVMRNNSRQCVTGIVVNDIQQLCREYRMKIRQEVHFIEKFGLDDHLAHIGEQRVNYVEHLSGKINYVLSVNPKDEKMQEYKKSIDTIKYQT

SEQ ID NO: 2493 - protein, 345 aa, unidentified
  source 1..345: note = Related to NZ_BJEY01000003.1; note = Listeria newyorkensis
MMEWNEYKDRFTKKAEQSGYKESYIEKNLAYAEVIVKKGYPIIYDVVHLSKLVGVSYEYIFKVSNASKYFYRRFEIKKKNGKKRTIHEPLPLLKSVQMWILRNILEKKEVSIYAKAYKKEVSLKENVRFHRGQKIVMKLDVLDFFSSIEPRFVDNFFRSIGYSKNLSRVLTNICVLNHGLPQGAPTSPYLSNIVMYNLDRKISSYCRVEKIRYTRYADDMTFSGDFKPAKIIHFLKKELSKLNLELNYKKTKILRQNDRQNVTGVVVNQKIQIDRTTRNNLRLEMYFKKKNQKKHLSNACEAGQERKYLIGLLGRVNYGLHINEKDTVLLNYKEIIYEVLSRYRI

SEQ ID NO: 2494 - protein, 344 aa, unidentified
  source 1..344: note = Related to JAARWV010000001.1; note = Listeria booriae
MEWSEYKDKFTEKAKQSGYTERYIEKNLAYAEIIANKGYPIIYDVAHFSKLVGVSYEYIYKVSNASKYFYRKFDVKKKNGKKRVIHEPLPLLKSLQMWILRNILEKKEVSIYAKAYKKRVSLKENVRFHRGQKIVLKLDILNFFSSIESIYVYDFFRSIGYNKSVSRVLTNLCTLNRGLPQGASTSPYLSNIVMYNLDRKISNYCKKKKIRYTRYADDMTFSGDFKPAGIIHFVKKELSKLNLELNYEKTKILGQNDRQNVTGVVVNQKIQIDRITRNNLRLEIYFLKKNQENHLRNICEAGQESKYLMGLLGRVNYGLHINEKDTVLLKYKEIIYEALSHYRT

SEQ ID NO: 2495 - protein, 343 aa, Bacillus sp.
  source 1..343: note = Related to NUVJ01000020.1; note = Bacillus cereus
MEWELYKESYEKEAQNHNLSDETIKSNLKYAYNLYKQNVPIIYDQLHFSLLVGISYEYILKVTNAPKQSYRRFSIAKKNGDKRIIHEPLPTLKIIQEWILHEILNNIDVSPYAKAYRKKVSLKDNVKFHRNQKKVLRLDIKDFFGSIKQNQVLSIFLKIGYTIDVSTLLAKICTLSGKLPQGSPTSAALSNLVMRGFDKEISLYCNEKKIRYTRYADDMTFSGDFKEQKLIKKVKSYLSWIRLELNLDKTNLMRKHNRQLVTGITVNEKIQVNVQKRRKLRQEVYFIRKYGLCSHLRHRGFAEYDSEMYIKSLIGKIGYCLFINPKDEEFREYLKFLKSELSK

SEQ ID NO: 2496 - protein, 348 aa, unidentified
  source 1..348: note = Related to CP065770.1; note = Enterococcus faecium
MNNDEWENYKKIFEKIARKNGKSQNYINKNLQYAEMLVKNNMPIIYNADHLGLLIGIKSSYFYKVTNEDKLFYRKFSIKKKNGDSRIIHEPLPNLKIIQKWILENILYKLEVSKFAKAYIPTISVKDNVRFHRKQKYVLKLDIKDFFSSLSEIHVYKIFKKIGYTDSLSVLLSKLCTLKGVLPQGASTSAYLSNLILLDFDKSVSLYCLERSIRYTRYADDLTFSGEFDHKALLNFIDYKLKALGLKLNQSKTRLLRQNQAQVITGIVVNEKIQVPRDYRKRIRLEVYYIKKFGIYNHLKSNHSKVDAKTYLKALNGKINYCLFINPNDLDMKNYRDIIEDAYQKLSI

SEQ ID NO: 2497 - protein, 353 aa, unidentified
  source 1..353: note = Related to NZ_CP032418.1; note = Paenisporosarcina cavernae
MDWEYYKKKYCLVAFENNISSHEIENNLFYAKKLYDRGLPIIYDEIHLGQLIGISHEYMFKVANDASYFYKSFRIKKLNGGSRKISEPLPNLKIIQKWILEEILYKLNIHPSAKAYVKGLSIKDNVKFHRNQKTVLKLDIIRFFNNVKEDLIYRIFKEIGYSKEISWLLTRLCILNGALPQGAVTSPYLSNLVMLNFDRKIYSYCKKKRIRYTRYADDLTFSGEINKHHVISRVKNELLKIHLQLNESKIRVLKNHQRQIITGIVVNKKIQTSIIYRKKIRQEVYYIKKFGIYNHISKTLGITDINTELELKYLKSLIGRIHFVIFVNKFDKEMSTYLHDLKMVYDELSNTHE

SEQ ID NO: 2498 - protein, 352 aa, Bacillus sp.
  source 1..352: note = Related to NUJF01000002.1; note = Bacillus thuringiensis
MDWSIYKQKYTSMALDQGIETKTIEENLSYAEVLYNKQLPIVYDEVHLGQLTGISHDYMFKVSNDSKKFYKTFRIKKRTGGYRKISEPLPNLKIIQNWILNEILYKIVAHPSAKAYRKDISIRENVKFHRNQEIVLKLDIQSFFNNIREKYVYRIFKELGYKKNIANLLTKLCTLSGSLPQGAVTSPYLSNLILRKFDKKIYTYCRRKGIRYTRYADDLSFSGEFNKRHLISRVENELSKLKLKLNTKKIRVLRSHQQQIITGIVVNEKIQVSKKYRKLIRQEVYYINKYGLNNHLSVKYNLEESDEFKKTVYLKSLIGKAEYVLFINKNDKEMPEYIALLRNLLVKLKLEN

SEQ ID NO: 2499 - protein, 364 aa, unidentified
  source 1..364: note = Related to PJWF01000007.1; note = Enterococcus faecalis
MILNWEEYEIAFREKNSELNRFSQSELENKLRYAKKIYENRATVIYDAKHLAELVGVKYFEVYKIANSNSRFFYKEFLLQKKNGGERKIKAPLPTLNIIQKWIFENILANLKCSVYCKSYQKNLSLKDNAKFHRRQPILMKLDISSFFDNISWGLIYNIFKNLGYSVEVSTLITKLVMYTENGKVKGIPQGAITSPMLSNLVLKKFDENIGYYCVNNKIRYTRYADDLTFSGNFDTYKLKAFVNKELHKNGFFLNNRKTKILKSNDRQVVTGIVVNEKMQVSRKYRKNLRLEIYHLLFRTQQHFEYKKLKNYDEKSMYLKTIIGKVNFVLQVNSSDKEFKTYKKEIYKIIDSINNSELNKNNWN

SEQ ID NO: 2500 - protein, 352 aa, unidentified
  source 1..352: note = Related to NZ_JACCEL010000030.1; note = Ruoffia tabacinasalis
MNWEEYKKKFIERNELTKRFSESELNEKLNYAKNLHNNKMPIIYNVDHLSRLIGVSYSEIYKITNSESKYYYKEFKLKKKSGGFRKIKAPLPTLNIIQKWIFENILQNTKASIYCKSYSKGVSLKDNAKFHRRQNIVLKLDIANFFDEISYEVVYKLFKDFGYSNEIVIVLARLVMYTNNKITKGIPQGASTSPIISNLILKKFDNEIASICLKENIRYTRYADDLTFSGDFEVTFIEEIIKEKLRLLGLKLNAKKRKILHKNNRQIVTGIVVNEKLQAPRKYRKNLRLELYYILNHSKNHFNKNGLYNHDARKNYLITVLGKVNYVLQINPQDSEFIDFKKKLYKLLTTQF

SEQ ID NO: 2501 - protein, 356 aa, unidentified
  source 1..356: note = Related to FSLI01000179.1; note = Mycobacteroides abscessus
MNWEQYKNNFIQKNKIHKKFDENELSLKLNYAYNLYENNLPILYNVDHLSKVMGINKEYLYKVSNSNFKYFYRTFYLPKKNGGTRRIDTPLPNLKLAQKWIYDNILLKLETSIYCKSYKPNFSIKDNAKFHRNQNLVLKLDIKNFFKNIRHKDIYLLFKEIGYNNDICNLLTKLVILNDDTKIKKIGIAQGAITSPSISNLILKGFDNKIAEYCKQSKIRYTRYADDLTFSGDFNPNNIINFVEKNLNKQGFVLNKNKIKKIYKNESQIVTGIVVNEKLQVSRQYRKNIRLEIYHLLNHTKEHLNKKEVTNYFEQREYILALMSKINFVLSINKNDKKMIEYKNKLYKLLRSLDRM

SEQ ID NO: 2502 - protein, 316 aa, unidentified
  source 1..316: note = Related to NZ_KE136496.1; note = Enterococcus columbae
MNVKYLTIEKLLTDCNLSKKDFLTLCDLDSKYVYDIFLIPKKTTGFRTIRVPNAQLKILQCWINKNVLSKADISKFCKSYRKNMSIVTNARLHKNQKIVLKLDIADFFSSISWSQVYKIFVELNINEEISEYFAKLVTINDGEVRLGIPQGACTSPTISNCILKDFDNKLGSYCIKRKIRYTRYADDLTFSGDFNYKKVILFVKKLLDKFGFKLNNSKIRVMKSGQSQIVTGIQVNEKIQVPRKYRHNLRLEIYHILNHPNDHFKMKNLYNSAEKSQYLKSVLGKVNYILQVNKKDGEFIKYKNLLHKILVEVLTI

SEQ ID NO: 2503 - protein, 346 aa, unidentified
  source 1..346: note = Related to CP007689.1; note = Listeria monocytogenes
MNDKQWEDYKSKFIELAKLNNKTQKYIDQNINYAFNLFQKGLPIIYDTTHLGLLTGIKKEYIYLVVSSPRHYYRHFKIPKSNGFLREIDEPLPNLKIIQKWILNNILQNVPVSPYAKAYLHKTTLIDNAKFHKRQKIVYKLDIQNFFPSISSHMIYNFFCEAGYDLKLSRVLSRIVTLNNGLPQGAPTSPYLSNIIFKEIDLKIAKYCQQHKIRYTRYADDLTFSGDFNYNKLKTFVEWNIQKSGFNLNNSKTKILPKNKRQIVTGIVVNEKLQISKNERKKIRHELHYLKLDTNKHLSLRANNEKAQIKYLQQLLGKINYGLQINGKSKELLLGKIFILNILKQF

SEQ ID NO: 2504 - protein, 362 aa, unidentified
  source 1..362: note = Related to FPKH01000001.1; note = Janthinobacterium lividum
MMSSCFFFAKEMNWENYATSFENAALSNNFDASYVKRCLAYGKVLFDKSLPIIYSLDHLANLVGYDSEFIVAVSFRQNGYYRNFFIPKKSGDYREISEPLPSLKIIQRWITENILYRISASRFAKAFVPTRSIKDNARFHKNQKLVLTVDIKDFFLSLSSKLVYKFFLGCGYSKRVSYFLTRLTTLNGSLPQGAPSSPYLSNLLFSESDEEISTFSRSEAIRYTRYADDLTFSGDFSPCKIITRVRRVLGKLDLRINEKKTRVMKPHQRQIVTGIVVNNKLQAVREIRRNLRQNIHYIEKFGFEYHVARIREHRANYQFHLMGQANFILFINPRDKDAIFALEVLRKNLQHSANSESQHDNN

SEQ ID NO: 2505 - protein, 348 aa, Nitrosomonas sp.
  source 1..348: note = Related to JAHBZZ010000012.1
MNWIDYQKEFTAKSISAGYKKDYIERCLTYAHRLYERNLPIIYSLDHFASLVGYEKSYLNYIAYRQNPFYRNFEIPKKSSGKREISEPLPNLKKIQRWVLDNILYRVSPSQYAKAFVPGRSIKANARFHRNQKMVLTLDINNFFPRLSSKLVKQFFTKCGYSKKVTYYLTRLCVLNGGLPQGAPTSPALANLMLKDFDLNIAKYCKSKTIRYTRYADDLTFSGVFAENELIKQVKKELKKIDLELKNSKTRLMLKHQRQEVTGIVVNNKLQAPREFRRNLRQAIFYIEKYGLENHLAKLNEFRANYVSHLLGQANFVLFINPRDQDALKALEILKDCRSSNFMITSDD

SEQ ID NO: 2506 - protein, 326 aa, unidentified
  source 1..326: note = Related to NZ_JWZY01000031.1; note = Herbaspirillum rubrisubalbicans
MDWEIYSSRFAKAAQDRGDHYIERCLAYAKRLNDQSLPIIYSPDHLGKLTGYDPAYLRYVAYKQRSFYREFSIPKKSGGVRSISEPLPNLKSIQQWILTSILYKLEPSVYAKAFVPQRSIKENARFHRSQEMVFTVDIRDFFPSLSVKRINNIFLSLGYERRVAYYLTRLCSLDGGLPQGAPTSPALSNIIFSPTDNRIAKYCTPLGIRYTRYADDLTFSGNFSVSDLLKIIRRELSALELTLNDSKTRLMKKHERQIVTGVVVNEKLNATRELRRGLRQSAYYIQKYGLENHINRIDEKRGNYLLHLIGQATLGVSEFLCKRDFV

SEQ ID NO: 2507 - protein, 353 aa, unidentified
  source 1..353: note = Related to NZ_CP014167.1; note = Paenibacillus yonginensis
MNWNEYKNKFYYFAKFHNKDDNYINDCINYAEKLFSKNLPVIYDVTHFSYLVGYKESYIMKVANSQSPFYREFLIPKKNKDEYREISEPLPNLKVIQRWILDEILHKLNPSPFSKAFRIGYSIKDNAKYHRKQKLVLNMDIKDYFNSISNDKVFMFFKSLGYSKQVALVLSKLCILDNGLPQGAPTSPMLSNLVTQQIDKRIASFSAKHNLRYTRYADDLTLSGDFDEGFVINCVKRILNSEGFCINEKKTRVRKQNQQQEVTGIVVNEKLQASKKYRKNLRQKMHYIKKYGFEDHISKLEIDNKIKYLYHLLGTANFILNVNPYDKEAKDSFEYLKQLLFHYKLKTSISEFD

SEQ ID NO: 2508 - protein, 353 aa, unidentified
  source 1..353: note = Related to NZ_FNAZ01000007.1; note = Paenibacillus sp.
MNWDDYKNRFYHFAKYDNKDDNYIDSCLNYAEKLFLKDIPVIYDVTHFSKLVGYKEAYIMKVSNSQGSFYREFKIPKKKKGEYRDIYEPLPNLKNIQRWILDEILNKLKPSPYSKAFRVGYSIKDNAKYHRNQKKLLNLDIKDYFKSIGYKKVYNFFRSLGYSKHVSVVLANVCTLDDELPQGAPTSPMLSNLITQRLDLRIAKFASKNKIRYTRYADDLTFSGDFEEGIVINFVRKVLLSDGFLINEQKTRVRKQNQQQEVTGIVVNEKLQASKKYRKSLRQKIYYIKRYGLEDHISKIEFDNKIRYLYHLLGTANFILNVNPNDEEAKEYFNYLKQLLFQYKLKKLDQEVE

SEQ ID NO: 2509 - protein, 346 aa, unidentified
  source 1..346: note = Related to NZ_JADBEL010000024.1; note = Sporosarcina limicola
MNWEVYRDNFYSSAKTKGYKENYINRCLEYSKILFDQKLPIIYDQKHLSLLIGYQEIYLIKVSNSQEPFYREFKIPKKNKNEFRKIHEPLPNLKNIQRWILEEILNILEPSPYSKGFRKGYSIKDNARFHKKQKKVLSIDIENYFGSISYDMVYSFFRNLGYSKQVSVMLANLCVLEGRLPQGSPTSPMLSNLITKRLDNRIGGYAKKRGIRYTRYADDLTFSGDFNEGALINFVKNVFESEGFVINEKKTRVRLQSQQQEVTGIVVNEKMQASRKYRREFRTKMFFIKKYGLDSHLDYVEEEKKIEYVYHLLGTANFIVNVNPNDLETREHYIYLKELLSDLKKS

SEQ ID NO: 2510 - protein, 344 aa, unidentified
  source 1..344: note = Related to NZ_VCBL01000006.1; note = Rummeliibacillus suwonensis
MEWEEYKSKFYHYASFEGKDPDYIDNCLNYAEKLFNKGLPVIYDQLHLSLLVGYEEIYLIKVSNSQDSFYRKFDILKKNKRDYRTISEPLPNLKNIQRWILSEILSKLKPSEYSKAFRPGLSIKDNARFHRKQKKLLTVDIKDYFGSIDFKKVFIFFRNLGYSKQVSVMLANICTLNNGLPQGAPTSPMLSNLITKNLDQRIAGFSKKNNLRYTRYADDLTFSGDFNEGHVIEFVKEVFKSEGFTINDSKTRVRKRNQRQEVTGIVVNEKMQASRSYRRDFRQQMYYIKKYGLDSHVNNIEGGDTLKYLYHLLGMANFIININPNNQETKEDYHYLKDLLQKLK

SEQ ID NO: 2511 - protein, 343 aa, Bacillus sp.
  source 1..343: note = Related to JAEACL010000003.1; note = Bacillus halotolerans
MNWEEYKFKFYHYASFNGKDQDYINSCLNYAEKLFNKGLPVIYDQFHLSLLVGYDEKYLIKVSNSQELFYREFNILKKNKKDYRTISEPLPNLKNIQRWISKEILSNLEPSEYSKAFRTGYSIKDNAKFHRRQKKVLTIDLKDYFGSIDYKKVFTFFRDLGYSKPVSVMLAKICTLNDGLPQGSPTSPMLSNLITKNLDHRIAGFSRKQNIRYTRYADDLTFSGDFSEGYVIKFVKMILNSEGFTLNDSKTRVRKRNQRQEVTGIVVNEKMQASRKYRRDFRKRMYYIKKYGLNSHVEKIEAGNSLNYLYYLLGMANFIININPNDKATKEDYNYLKNLLLKS

SEQ ID NO: 2512 - protein, 355 aa, unidentified
  source 1..355: note = Related to NZ_LFXJ01000013.1; note = Lysinibacillus xylanilyticus
MVIGLNENGDIMKWEEYKKKFYHYATYNQKSEEYISSCLDYAERLFMKDLPVIYDQKHLSQLVGYREEYLFKVANASELFYRNFKVLKKNKKDYREISEPLPNLKDIQRWILDQILYKLEPSEYSKAFRKGVSIKDNAKFHRKQKKVLTIDIENYFGTIKFKAVFKFFKSLGYTKQVSMMLAKLCVIDDELPQGAPTSPMLATLITKNIDKRLSAFANKEKIRYTRYADDLTFSGDFNEGYVIKFAEKVINSEGFKVNPFKTRVRLQHQRQEVTGIVVNEKLQASRQYRRKFRQNMFFIRKFGLESHIININVSDPKSYVYQLIGTANFIRNINPKDIDVQVDYEYLKELLQTYK

SEQ ID NO: 2513 - protein, 347 aa, Bacillus sp.
  source 1..347: note = Related to JAEKFM010000007.1
MIWEKYKRNFTESALKAGYDSMYIEENLKKAHSLHLQGIPIIYDQMHLSYLVGYDIEYLLKVSNSQKGFYRYFKIPKKNGGFRNIAEPLPNLKSIQKWILEEMLYSCKTSEFAKAYKKNVSLKDNARFHRGQKMVLTIDIKDFFGSIRHIDVYNFFSSLGYSQDVATLLTNLCTLKGALPQGAITSPALSNLLMKDIDKRISAFSKKKKIRYTRYADDLTFSGDFQVGEIIKFVTTVLRSKGFSINDKKTRVRFPHQRQEVTGIIVNQKIQAPCEMRKELRKNIYFIKKYGLNSHLEFIKKDKYQYLKHLLGIANHIYFINPTDSRVYEYLNYLKELWQVEKITSED

SEQ ID NO: 2514 - protein, 338 aa, Bacillus sp.
  source 1..338: note = Related to NZ_CP071813.1; note = Bacillus mycoides
MNWKSYSEAFSKKAKQNKYDQNYINECLGYAKPLFEKKIPIIYNQEHLSLLVGYSEEYLLKVSNASDRFYRNFSVPKKNGSSRQIFEPLPNLKDIQRWILEEILYKCPISDYAKSYVPRRSTKDNARFHRRQKKVLTLDIKDFFPSIRFHKIYLFFFNLGYTESLSMMLANLCCLNGSLPQGAISSPALSNLIFKSFDKRISVFCKSNNIRYTRYADDLTFSGDFQPGMLIKFVENILVPEGFQLNNKKTRVRLQHQRQEVTGIVVNQKLQAPRKMRRELRQKIHYIEKYGLDSHLERSQITRVNYIKHLLGIAHYIRHINPGDEKINSYIEKLKAYL

SEQ ID NO: 2515 - protein, 338 aa, unidentified
  source 1..338: note = Related to LR134338.1; note = Brevibacillus brevis
MNWETYRVNFTLRAKEFEYDEEYINKCLQYSKNLFDRSLPVIYDQQHLSALLGYKYSFLLKVSNSAKNFYRNFAISKKNGGFRKISEPLPNLKEIQRWILEEILYKNNVSEFAKAYLKGKSIRDNVRFHRGQKYVITIDIKNFFPSISEEKVFVLFIEMGYSKPVSVMLAKLCCLNGKLPQGAVTSPMLSNIIMKRLDKRIAAFAVKNRVRYTRYADDLTFSGDIEPGKVINFVKKVLDADNFKINDSKTRVMTKNQRQLVTGSVVNEKLQAPREVRRKIRQELYYIKKFGLASHLEKLNSYKANYLKRLLGLINYCLLLNPKDAELIKGKNYLKELL

SEQ ID NO: 2516 - protein, 351 aa, unidentified
  source 1..351: note = Related to JAFQBM010000021.1; note = Lachnospiraceae bacterium
MNWNEYENNYIRLAKLSGKSDEYCIKQLEYAKHLFEQDLPVIYTQEHLCRLVGYATEYVYAISNSASCFYRTFSIKKKNGKERIINEPLPSLKEIQDWILKEILERINISPYAKAYVKGRSIKDNARFHKRQNKVLTMDLKDFFPSITFGRVLNVFRKVGYRENVAVMLANLCCLHNELPQGAPTSPALSNIIVSGLDYKIAEFLKGKEIRYTRYADDLTFSGDFIEGDIIKSIERIVCRQGFKINHSKTRIRKRNQRQEVTGVVVNEKLQVNRELRRRIRSDAYYIEKYGFYSHVDYTSQNRSNYLYYLIGIASYSLFINPYDDKMREYLEIFKKELARCKQEGVDVCSP

SEQ ID NO: 2517 - protein, 347 aa, unidentified
  source 1..347: note = Related to NZ_LT969517.1; note = Eisenbergiella sp.
MKWNEYENNFIQIAKMQGKTEEYCIQQLEYAKKLFANNFPIIYNQVHFCKLVGYAEEYVFSACNQPKSFYRTYYIPKRNGKKREISEPLPSLKEIQNWIYQEILCNVKVSSYAKAYVKGKSIKDNARFHKRQIKVLSMDIKDFFPSIGFKRVLNVFRNIGYRENVAVLLANLCCLNNSLPQGAPTSPVLSNIITSKLDDKIVNYVSKERIRYTRYADDLTFSGDFNEGDVIKNVERIANSLGFKINEEKTRVRKRNQRQEVTGIVVNEKMQLSRKIRKRIRSDMYYIQKYGVESHLEHIGESRENYLYHMMGLVSYAAFINPYDENLKKYRLFLKEELNKHVALVDN

SEQ ID NO: 2518 - protein, 338 aa, unidentified
  source 1..338: note = Related to NZ_FOLQ01000021.1; note = Spirosoma endophyticum
MKWSDYASKLIEEAIKLDYTKEAIDEYLSYAEHLHRAKLPIIFDQIHLSFLVGYKYEYLLGVSNAPQSFYKIFYIPKKNGEVRTISEPLTSLKEIQSWILKEILYKCKVSSNAKAYVIGKSIRDNARFHKKQNKVLTIDIEDFFPSIKINKVIGVFRRAGYSKAVSTLLARLCCTDNGLPQGAPTSPAISNLVMYYLDMRIFGFCRKRAIRYTRYADDLTFSGDFDDNELISFTRSILERKNLFINNQKTRLRKRHQQQEVTGVVVNEKLQVPRDYRERFRQELYFIKKYGLVGHVKHINAGDPDRYIRVLIGKANFISQINPNDTEIKDYLKILYTL

SEQ ID NO: 2519 - protein, 346 aa, unidentified
  source 1..346: note = Related to QRIC01000038.1; note = Dorea longicatena
MKWIEYKSKFIEVAQKNNKNKKYCDRWLKYARNLWERDVPIIYTQDHLCALLGYEPTYVYAVSNSPHNFYHCYQISKKNGGKRSISEPLPNLKEIQRWILENILYRFEVSPYAKAYIKDKSIKDNVRFHRRQRKVLSLDVKNFYDHLTDWMVYQLFIEVGYSESVAMMLTNLCCLEGSLPQGAPTSAALSNILMKDFDYKIGAFCKMYKIRFTRYADDMTFSGDFDEVKVISFVRKSLKDLQLTINDAKTRVRKQGQQQEVTGIVVNYKPQLAKSVRKGIRKDVYYINKYGLQSHLKYVQEERSNYLEHLFGLINYALFINPNDEEMKRYKIDIKYLMKKENDEFK

SEQ ID NO: 2520 - protein, 342 aa, unidentified
  source 1..342: note = Related to FMEZ01000001.1; note = Ruminococcus sp.
MEWIEYELKFAEIAKKHNKSQKYCKRWMEYAKKLWDRGLPIIFTQNHLCALLGYQPVYVYAVSNAPCNFYHYYKVQKKNGGTRNISEPLPNLKEIQRWILENILYRFEISPYAKAYVKNRSIKDNVRFHRRQRKVLSLDVKDFFGHLTDWMVYQLFIESGYSESVAMMLTNLCCLEGSLPQGAPTSAALSNILMKDFDYKIGDFCKMFKIRFTRYADDMTFSGDFDETKVISFVKKNLRDMQLTINDAKTRVRKQGQQQEVTGIVVNYKPQLARSIRKDIRKDVYYIKKYGLQSHLQYIQEERSHYLEHLFGLINYALFINSDDKEMKRYKMDIKYLMSNEK

SEQ ID NO: 2521 - protein, 350 aa, unidentified
  source 1..350: note = Related to JACRSZ010000030.1; note = Proposed Jingyaoa shaoxingensis
MEWNEYKIAFIEAARKSGKNNAYCEKYLNYAEQLWMHHMPVIYTQEHLCALLGYLPTYVYAAANAPEDFYRQFLIPKKNGGSRMISEPLPNLKEIQEWILKNILYKAEISTYAKAYIPGKSVKDNVRFHRRQKKVLSLDIKAFYDHLTDWMVFQFFIEKGYNEAVAMMLTGLCCLRGCLPQGAPTSAALSNLLMVEFDEKVGLFCKEKKIRYTRYADDMTFSGDFDELEVIRFVRQELKSIGLRLNMKKTRTRKQGQQQEVTGIVVNYKTQLPKSIRKEIRKNMYYIQKFGLESHLEYIGLECRNYREHLLGQIGYALFINPKDQEMKRYKEIIHDVDICCKKQTPDRFV

SEQ ID NO: 2522 - protein, 342 aa, unidentified
  source 1..342: note = Related to RKBT01000103.1; note = Solobacterium sp.
MNWDIYKENFIHEAKKHHKNENYINKWLEYAHNLNSKKLPIIYDQNHLCELIGFDKNYVYAISNGGKHFYRTFEIKKKNGGTRIIHEPLPNLKDIQHWILKNILDYVEVSPYAKAYRKGYSVKDNVKFHRRQKKVLCLDIHSFYDSLKSNLVLDVFIELGYKNDVAIMLTNLCCLNYKLPQGAPTSSSLSNIIMKNFDYSVSDFCKDNAIRYTRYADDMTFSGDFDEINVIRFVRNELKKINLRLNNQKTRVRIQGQQQLITGIVVNEKTQLPKKKRKEIRQTMYYIKKYGINEHMNFKNIDKSYYLEHIMGIVNYGLFLNPRDSELIEYRSILQVLKNSQD

(The sequence listing continues in the following parts.)

The invention claimed is:

1. A gene editing system comprising one or more delivery vehicles, wherein:
the delivery vehicle(s) comprise RNA cargo,
said RNA cargo comprises (a) at least one mRNA molecule encoding (i) a nucleic acid programmable nuclease and (ii) a retron reverse transcriptase, (b) an engineered retron ncRNA, and (c) guide RNA for the nucleic acid programmable nuclease;
wherein the engineered retron ncRNA comprises an HDR nucleotide sequence substituted into a retron ncRNA;
wherein the retron ncRNA nucleotide sequence has about 85% to 98% sequence identity to any one of SEQ ID NO:15833, SEQ ID NO:18547, or SEQ ID NO:19053;
wherein the HDR nucleotide sequence is substituted at a hairpin loop of the retron ncRNA;
wherein the retron reverse transcriptase and the retron ncRNA are from the same phylogenetic clade;
each delivery vehicle contains (a)(i) and/or (a)(ii) and/or (b) and/or (c),
whereby one delivery vehicle or more than one delivery vehicle delivers (a)(i), (a)(ii), (b), and (c).

2. The gene editing system of claim 1, wherein the retron ncRNA nucleotide sequence has at least about 85% to 98% sequence identity to SEQ ID NO:15833, and the retron reverse transcriptase comprises an amino acid sequence at least about 90% identical to any one of SEQ ID NO:1983 to SEQ ID NO:2158.

3. The gene editing system of claim 2, wherein the retron reverse transcriptase comprises an amino acid sequence at least about 90% identical to SEQ ID NO:2042.

4. The gene editing system of claim 2, wherein the HDR nucleotide sequence is substituted at the L4 loop of the ncRNA.

5. The gene editing system of claim 1, wherein the retron ncRNA nucleotide sequence has about 85% to 98% sequence identity to SEQ ID NO:18547, and the retron reverse transcriptase comprises an amino acid sequence at least about 90% identical to any one of SEQ ID NO:6974 to SEQ ID NO:7002.

6. The gene editing system of claim 5, wherein the retron reverse transcriptase comprises an amino acid sequence at least about 90% identical to SEQ ID NO:6083.

7. The gene editing system of claim 5, wherein the HDR nucleotide sequence is substituted at the L2 loop of the ncRNA.

8. The gene editing system of claim 1, wherein the retron ncRNA nucleotide sequence has about 85% to 98% sequence identity to SEQ ID NO:19053, and the retron reverse transcriptase comprises an amino acid sequence at least 90% identical to any one of SEQ ID NO:6919 to SEQ ID NO:6972.

9. The gene editing system of claim 8, wherein the retron reverse transcriptase comprises an amino acid sequence at least 90% identical to SEQ ID NO:6943.

10. The gene editing system of claim 8, wherein the HDR nucleotide sequence is substituted at the L2 loop of the ncRNA.

11. The gene editing system of claim 1, wherein (a)(i) and (a)(ii) comprise a single mRNA molecule encoding the nucleic acid programmable nuclease and the retron reverse transcriptase.

12. The gene editing system of claim 11, wherein (a)(i) and (a)(ii) are encoded and expressed as a fusion protein.

13. The gene editing system of claim 12, wherein the fusion protein comprises the C-terminal end of the nucleic acid programmable nuclease fused to the N-terminal end of the retron reverse transcriptase (nuclease:RT fusion).

14. The gene editing system of claim 12, wherein the fusion protein comprises the N-terminal end of the nucleic acid programmable nuclease fused to the C-terminal end of the retron reverse transcriptase (RT:nuclease fusion).

15. The gene editing system of claim 1, wherein (a)(i) and (a)(ii) comprise a first mRNA molecule encoding the nucleic acid programmable nuclease and a second mRNA molecule encoding the retron reverse transcriptase.

16. The gene editing system of claim 1, wherein (c) is separate from (a)(i), (a)(ii) and (b) or is provided in trans.

17. The gene editing system of claim 1, wherein (b) the engineered retron ncRNA, and (c) the guide RNA are fused or are provided in cis.

18. The gene editing system of claim 17, wherein the engineered ncRNA comprises a first guide RNA fused to the 5' end of the retron ncRNA, and a second guide RNA fused to the 3' end of the retron ncRNA, and the first and second guide RNAs target different sequences.

19. The gene editing system of claim 1, wherein (a) the at least one mRNA molecule encoding (i) the nucleic acid programmable nuclease and (ii) the retron reverse transcriptase, and (b) the engineered retron ncRNA are in the same delivery vehicle.

20. The gene editing system of claim 1, where the HDR nucleotide sequence encodes of a donor polynucleotide comprising an intended edit to be integrated at a target sequence in a cell, and wherein the donor polynucleotide is flanked by a 5' homology arm that hybridized to a sequence 5' to the target sequence and a 3' homology arm that hybridizes to a sequence 3' to the target sequence.

21. A method of genetically modifying a cell comprising:
contacting the gene editing system of claim 20 with the cell, thereby delivering the RNA cargo to the cell, wherein:
the nucleic acid programmable nuclease forms a complex with the guide RNA, wherein said guide RNA directs the complex to the target sequence,
the nucleic acid programmable nuclease creates a double-stranded break in the target sequence,
the retron reverse transcriptase and engineered retron ncRNA create RT DNA that comprises the donor polynucleotide, and
the donor polynucleotide becomes integrated at the target sequence.

22. The gene editing system of claim 1, wherein the nucleic acid programmable nuclease comprises a Cas9 nuclease, a TnpB nuclease, or a Cas12a nuclease.

23. The gene editing system of claim 1, wherein the nucleic acid programmable nuclease comprises a Cas9 nuclease.

24. The gene editing system of claim 1, wherein the engineered retron ncRNA comprises:
A) a pre-msr sequence having a first complementary region of the retron ncRNA;
B) an msr sequence including an msr stem-loop structure;
C) an msd sequence including an msd stem-loop structure and comprising the HDR nucleotide sequence, wherein said msd sequence templates a single strand DNA product (RT-DNA) in the presence of the retron reverse transcriptase; and
D) a post-msd sequence having a second complementary region, wherein the first and second complementary regions form an a1/a2 duplex region of the retron ncRNA.

25. The gene editing system of claim 24, wherein the HDR nucleotide sequence encodes a donor polynucleotide comprising an intended edit to be integrated at a target sequence of a cell, wherein the donor polynucleotide is flanked by a 5' homology arm that hybridizes to a sequence 5' to the target sequence and a 3' homology arm that hybridizes to a sequence 3' to the target sequence.

26. An isolated cell comprising the gene editing system of claim 1.

27. The isolated cell of claim 26, wherein the isolated cell is a mammalian cell.

28. The isolated cell of claim 27, wherein the mammalian cell is a human cell.

29. A composition comprising:
   a) the gene editing system of claim 1; and
   b) a pharmaceutically or veterinarily acceptable carrier.

30. The composition of claim 29, wherein the delivery vehicle is a lipid nanoparticle comprising:
   a) one or more ionizable lipids;
   b) one or more structural lipids;
   c) one or more PEGylated lipids; and
   d) one or more phospholipids.

* * * * *

UNITED STATES PATENT AND TRADEMARK OFFICE
CERTIFICATE OF CORRECTION

| | |
|---|---|
| PATENT NO. | : 11,866,728 B2 |
| APPLICATION NO. | : 18/087673 |
| DATED | : January 9, 2024 |
| INVENTOR(S) | : Alim Ladha et al. |

It is certified that error appears in the above-identified patent and that said Letters Patent is hereby corrected as shown below:

In the Claims

Column 292, Claim 20 should read as:
20. The gene editing system of claim 1, where the HDR nucleotide sequence encodes a donor polynucleotide comprising an intended edit to be integrated at a target sequence in a cell, and wherein the donor polynucleotide is flanked by a 5' homology arm that hybridized to a sequence 5' to the target sequence and a 3' homology arm that hybridizes to a sequence 3' to the target sequence.

Signed and Sealed this
Nineteenth Day of March, 2024

Katherine Kelly Vidal
*Director of the United States Patent and Trademark Office*